United States Patent 11,096,956 (ANTISENSE OLIGOMERS AND USES THEREOF) - sequence listing, part 6

SEQ ID NO: 45518 - RNA, 18 nt, Artificial Sequence
  Description of Artificial Sequence: Synthetic oligonucleotide
aagcaaacgcccuccccu

SEQ ID NO: 45519 - RNA, 18 nt, Artificial Sequence
  Description of Artificial Sequence: Synthetic oligonucleotide
gagccaagcaaacgcccu

SEQ ID NO: 45520 - RNA, 18 nt, Artificial Sequence
  Description of Artificial Sequence: Synthetic oligonucleotide
gagaagagccaagcaaac

SEQ ID NO: 45521 - RNA, 18 nt, Artificial Sequence
  Description of Artificial Sequence: Synthetic oligonucleotide
guaucgagaagagccaag

SEQ ID NO: 45522 - RNA, 18 nt, Artificial Sequence
  Description of Artificial Sequence: Synthetic oligonucleotide
cuccaguaucgagaagag

SEQ ID NO: 45523 - RNA, 18 nt, Artificial Sequence
  Description of Artificial Sequence: Synthetic oligonucleotide
ugcuucuccaguaucgag

SEQ ID NO: 45524 - RNA, 18 nt, Artificial Sequence
  Description of Artificial Sequence: Synthetic oligonucleotide
gccccugcuucuccagua

SEQ ID NO: 45525 - RNA, 18 nt, Artificial Sequence
  Description of Artificial Sequence: Synthetic oligonucleotide
gcccagccccugcuucuc

SEQ ID NO: 45526 - RNA, 18 nt, Artificial Sequence
  Description of Artificial Sequence: Synthetic oligonucleotide
uaagggcccagccccugc

SEQ ID NO: 45527 - RNA, 18 nt, Artificial Sequence
  Description of Artificial Sequence: Synthetic oligonucleotide
guucuuaagggcccagcc

SEQ ID NO: 45528 - RNA, 18 nt, Artificial Sequence
  Description of Artificial Sequence: Synthetic oligonucleotide
gggcuguucuuaagggcc

SEQ ID NO: 45529 - RNA, 18 nt, Artificial Sequence
  Description of Artificial Sequence: Synthetic oligonucleotide
cgggcgggcuguucuuaa

SEQ ID NO: 45530 - RNA, 18 nt, Artificial Sequence
  Description of Artificial Sequence: Synthetic oligonucleotide
aaacucgggcgggcuguu

SEQ ID NO: 45531 - RNA, 18 nt, Artificial Sequence
  Description of Artificial Sequence: Synthetic oligonucleotide
uucgaaaacucgggcggg

SEQ ID NO: 45532 - RNA, 18 nt, Artificial Sequence
  Description of Artificial Sequence: Synthetic oligonucleotide
gcagcuucgaaaacucgg

SEQ ID NO: 45533 - RNA, 18 nt, Artificial Sequence
  Description of Artificial Sequence: Synthetic oligonucleotide
cuaccgcagcuucgaaaa

SEQ ID NO: 45534 - RNA, 18 nt, Artificial Sequence
  Description of Artificial Sequence: Synthetic oligonucleotide
uuucucuaccgcagcuuc

SEQ ID NO: 45535 - RNA, 18 nt, Artificial Sequence
  Description of Artificial Sequence: Synthetic oligonucleotide
ggguuucucuaccgcagc

SEQ ID NO: 45536 - RNA, 18 nt, Artificial Sequence
  Description of Artificial Sequence: Synthetic oligonucleotide
ugaguuacaggauuuggg

SEQ ID NO: 45537 - RNA, 18 nt, Artificial Sequence
  Description of Artificial Sequence: Synthetic oligonucleotide
gggugugaguuacaggau

SEQ ID NO: 45538 - RNA, 18 nt, Artificial Sequence
  Description of Artificial Sequence: Synthetic oligonucleotide
gggucagagcccgggcag

SEQ ID NO: 45539 - RNA, 18 nt, Artificial Sequence
  Description of Artificial Sequence: Synthetic oligonucleotide
ccagccccucucuccggg

SEQ ID NO: 45540 - RNA, 18 nt, Artificial Sequence
  Description of Artificial Sequence: Synthetic oligonucleotide
ucagcccagccccucucu

SEQ ID NO: 45541 - RNA, 18 nt, Artificial Sequence
  Description of Artificial Sequence: Synthetic oligonucleotide
ccugaucagcccagcccc

SEQ ID NO: 45542 - RNA, 18 nt, Artificial Sequence
  Description of Artificial Sequence: Synthetic oligonucleotide
cccgcccugaucagccca

SEQ ID NO: 45543 - RNA, 18 nt, Artificial Sequence
  Description of Artificial Sequence: Synthetic oligonucleotide
uucgccccgcccugauca

SEQ ID NO: 45544 - RNA, 18 nt, Artificial Sequence
  Description of Artificial Sequence: Synthetic oligonucleotide
aagacuucgccccgcccu

SEQ ID NO: 45545 - RNA, 18 nt, Artificial Sequence
  Description of Artificial Sequence: Synthetic oligonucleotide
aggagaagacuucgcccc

SEQ ID NO: 45546 - RNA, 18 nt, Artificial Sequence
  Description of Artificial Sequence: Synthetic oligonucleotide
caacuaggagaagacuuc

SEQ ID NO: 45547 - RNA, 18 nt, Artificial Sequence
  Description of Artificial Sequence: Synthetic oligonucleotide
ucgcucaacuaggagaag

SEQ ID NO: 45548 - RNA, 18 nt, Artificial Sequence
  Description of Artificial Sequence: Synthetic oligonucleotide
ccuucucgcucaacuagg

SEQ ID NO: 45549 - RNA, 18 nt, Artificial Sequence
  Description of Artificial Sequence: Synthetic oligonucleotide
ggccuccuucucgcucaa

SEQ ID NO: 45550 - RNA, 18 nt, Artificial Sequence
  Description of Artificial Sequence: Synthetic oligonucleotide
gggccuccuucucgcuca

SEQ ID NO: 45551 - RNA, 18 nt, Artificial Sequence
  Description of Artificial Sequence: Synthetic oligonucleotide
uuggcuaagcccaaaggg

SEQ ID NO: 45552 - RNA, 18 nt, Artificial Sequence
  Description of Artificial Sequence: Synthetic oligonucleotide
cagucuuggcuaagccca

SEQ ID NO: 45553 - RNA, 18 nt, Artificial Sequence
  Description of Artificial Sequence: Synthetic oligonucleotide
acuuucagucuuggcuaa

SEQ ID NO: 45554 - RNA, 18 nt, Artificial Sequence
  Description of Artificial Sequence: Synthetic oligonucleotide
uggagacuuucagucuug

SEQ ID NO: 45555 - RNA, 18 nt, Artificial Sequence
  Description of Artificial Sequence: Synthetic oligonucleotide
guugguggagacuuucag

SEQ ID NO: 45556 - RNA, 18 nt, Artificial Sequence
  Description of Artificial Sequence: Synthetic oligonucleotide
gccggguugguggagacu

SEQ ID NO: 45557 - RNA, 18 nt, Artificial Sequence
  Description of Artificial Sequence: Synthetic oligonucleotide
accccgccggguuggugg

SEQ ID NO: 45558 - RNA, 18 nt, Artificial Sequence
  Description of Artificial Sequence: Synthetic oligonucleotide
ccccaaccccgccggguu

SEQ ID NO: 45559 - RNA, 18 nt, Artificial Sequence
  Description of Artificial Sequence: Synthetic oligonucleotide
gaagcccccaaccccgcc

SEQ ID NO: 45560 - RNA, 18 nt, Artificial Sequence
  Description of Artificial Sequence: Synthetic oligonucleotide
ggagagaagcccccaacc

SEQ ID NO: 45561 - RNA, 18 nt, Artificial Sequence
  Description of Artificial Sequence: Synthetic oligonucleotide
gggagagaagcccccaac

SEQ ID NO: 45562 - RNA, 18 nt, Artificial Sequence
  Description of Artificial Sequence: Synthetic oligonucleotide
cccugagagugacuuggg

SEQ ID NO: 45563 - RNA, 18 nt, Artificial Sequence
  Description of Artificial Sequence: Synthetic oligonucleotide
agcugcccugagagugac

SEQ ID NO: 45564 - RNA, 18 nt, Artificial Sequence
  Description of Artificial Sequence: Synthetic oligonucleotide
ggaggagcugcccugaga

SEQ ID NO: 45565 - RNA, 18 nt, Artificial Sequence
  Description of Artificial Sequence: Synthetic oligonucleotide
gggaggagcugcccugag

SEQ ID NO: 45566 - RNA, 18 nt, Artificial Sequence
  Description of Artificial Sequence: Synthetic oligonucleotide
uucuaggcccguaguggg

SEQ ID NO: 45567 - RNA, 18 nt, Artificial Sequence
  Description of Artificial Sequence: Synthetic oligonucleotide
aucccuucuaggcccgua

SEQ ID NO: 45568 - RNA, 18 nt, Artificial Sequence
  Description of Artificial Sequence: Synthetic oligonucleotide
uccccaucccuucuaggc

SEQ ID NO: 45569 - RNA, 18 nt, Artificial Sequence
  Description of Artificial Sequence: Synthetic oligonucleotide
uggguucuacagauccca

SEQ ID NO: 45570 - RNA, 18 nt, Artificial Sequence
  Description of Artificial Sequence: Synthetic oligonucleotide
aaccauggguucuacaga

SEQ ID NO: 45571 - RNA, 18 nt, Artificial Sequence
  Description of Artificial Sequence: Synthetic oligonucleotide
ccgcaaaccauggguucu

SEQ ID NO: 45572 - RNA, 18 nt, Artificial Sequence
  Description of Artificial Sequence: Synthetic oligonucleotide
ugucaccgcaaaccaugg

SEQ ID NO: 45573 - RNA, 18 nt, Artificial Sequence
  Description of Artificial Sequence: Synthetic oligonucleotide
cugagugucaccgcaaac

SEQ ID NO: 45574 - RNA, 18 nt, Artificial Sequence
  Description of Artificial Sequence: Synthetic oligonucleotide
ccccucugagugucaccg

SEQ ID NO: 45575 - RNA, 18 nt, Artificial Sequence
  Description of Artificial Sequence: Synthetic oligonucleotide
aagauccccucugagugu

SEQ ID NO: 45576 - RNA, 18 nt, Artificial Sequence
  Description of Artificial Sequence: Synthetic oligonucleotide
ucccaaagauccccucug

SEQ ID NO: 45577 - RNA, 18 nt, Artificial Sequence
  Description of Artificial Sequence: Synthetic oligonucleotide
aaaucucccaaagauccc

SEQ ID NO: 45578 - RNA, 18 nt, Artificial Sequence
  Description of Artificial Sequence: Synthetic oligonucleotide
ucuauaaaucucccaaag

SEQ ID NO: 45579 - RNA, 18 nt, Artificial Sequence
  Description of Artificial Sequence: Synthetic oligonucleotide
ccggcucuauaaaucucc

SEQ ID NO: 45580 - RNA, 18 nt, Artificial Sequence
  Description of Artificial Sequence: Synthetic oligonucleotide
aagaaccggcucuauaaa

SEQ ID NO: 45581 - RNA, 18 nt, Artificial Sequence
  Description of Artificial Sequence: Synthetic oligonucleotide
gcgcuaagaaccggcucu

SEQ ID NO: 45582 - RNA, 18 nt, Artificial Sequence
  Description of Artificial Sequence: Synthetic oligonucleotide
acaaagcgcuaagaaccg

SEQ ID NO: 45583 - RNA, 18 nt, Artificial Sequence
  Description of Artificial Sequence: Synthetic oligonucleotide
aacccacaaagcgcuaag

SEQ ID NO: 45584 - RNA, 18 nt, Artificial Sequence
  Description of Artificial Sequence: Synthetic oligonucleotide
cucugaacccacaaagcg

SEQ ID NO: 45585 - RNA, 18 nt, Artificial Sequence
  Description of Artificial Sequence: Synthetic oligonucleotide
ccagccucugaacccaca

SEQ ID NO: 45586 - RNA, 18 nt, Artificial Sequence
  Description of Artificial Sequence: Synthetic oligonucleotide
ugcagccagccucugaac

SEQ ID NO: 45587 - RNA, 18 nt, Artificial Sequence
  Description of Artificial Sequence: Synthetic oligonucleotide
aacacugcagccagccuc

SEQ ID NO: 45588 - RNA, 18 nt, Artificial Sequence
  Description of Artificial Sequence: Synthetic oligonucleotide
ucauaaacacugcagcca

SEQ ID NO: 45589 - RNA, 18 nt, Artificial Sequence
  Description of Artificial Sequence: Synthetic oligonucleotide
ccucuucauaaacacugc

SEQ ID NO: 45590 - RNA, 18 nt, Artificial Sequence
  Description of Artificial Sequence: Synthetic oligonucleotide
cugccccucuucauaaac

SEQ ID NO: 45591 - RNA, 18 nt, Artificial Sequence
  Description of Artificial Sequence: Synthetic oligonucleotide
gcccacugccccucuuca

SEQ ID NO: 45592 - RNA, 18 nt, Artificial Sequence
  Description of Artificial Sequence: Synthetic oligonucleotide
ccccagcccacugccccu

SEQ ID NO: 45593 - RNA, 18 nt, Artificial Sequence
  Description of Artificial Sequence: Synthetic oligonucleotide
aguguccccagcccacug

SEQ ID NO: 45594 - RNA, 18 nt, Artificial Sequence
  Description of Artificial Sequence: Synthetic oligonucleotide
ccagcaguguccccagcc

SEQ ID NO: 45595 - RNA, 18 nt, Artificial Sequence
  Description of Artificial Sequence: Synthetic oligonucleotide
uaaccccagcaguguccc

SEQ ID NO: 45596 - RNA, 18 nt, Artificial Sequence
  Description of Artificial Sequence: Synthetic oligonucleotide
agccauaaccccagcagu

SEQ ID NO: 45597 - RNA, 18 nt, Artificial Sequence
  Description of Artificial Sequence: Synthetic oligonucleotide
acuacagccauaacccca

SEQ ID NO: 45598 - RNA, 18 nt, Artificial Sequence
  Description of Artificial Sequence: Synthetic oligonucleotide
accucacuacagccauaa

SEQ ID NO: 45599 - RNA, 18 nt, Artificial Sequence
  Description of Artificial Sequence: Synthetic oligonucleotide
cauggaccucacuacagc

SEQ ID NO: 45600 - RNA, 18 nt, Artificial Sequence
  Description of Artificial Sequence: Synthetic oligonucleotide
guacacauggaccucacu

SEQ ID NO: 45601 - RNA, 18 nt, Artificial Sequence
  Description of Artificial Sequence: Synthetic oligonucleotide
aacaaguacacauggacc

SEQ ID NO: 45602 - RNA, 18 nt, Artificial Sequence
  Description of Artificial Sequence: Synthetic oligonucleotide
caaggaacaaguacacau

SEQ ID NO: 45603 - RNA, 18 nt, Artificial Sequence
  Description of Artificial Sequence: Synthetic oligonucleotide
caugccaaggaacaagua

SEQ ID NO: 45604 - RNA, 18 nt, Artificial Sequence
  Description of Artificial Sequence: Synthetic oligonucleotide
agacacaugccaaggaac

SEQ ID NO: 45605 - RNA, 18 nt, Artificial Sequence
  Description of Artificial Sequence: Synthetic oligonucleotide
gagucagacacaugccaa

SEQ ID NO: 45606 - RNA, 18 nt, Artificial Sequence
  Description of Artificial Sequence: Synthetic oligonucleotide
acacagagucagacacau

SEQ ID NO: 45607 - RNA, 18 nt, Artificial Sequence
  Description of Artificial Sequence: Synthetic oligonucleotide
cagcaacacagagucaga

SEQ ID NO: 45608 - RNA, 18 nt, Artificial Sequence
  Description of Artificial Sequence: Synthetic oligonucleotide
ugcagcagcaacacagag

SEQ ID NO: 45609 - RNA, 18 nt, Artificial Sequence
  Description of Artificial Sequence: Synthetic oligonucleotide
uguacugcagcagcaaca

SEQ ID NO: 45610 - RNA, 18 nt, Artificial Sequence
  Description of Artificial Sequence: Synthetic oligonucleotide
cccacuguacugcagcag

SEQ ID NO: 45611 - RNA, 18 nt, Artificial Sequence
  Description of Artificial Sequence: Synthetic oligonucleotide
cccugcccacuguacugc

SEQ ID NO: 45612 - RNA, 18 nt, Artificial Sequence
  Description of Artificial Sequence: Synthetic oligonucleotide
cgugccccugcccacugu

SEQ ID NO: 45613 - RNA, 18 nt, Artificial Sequence
  Description of Artificial Sequence: Synthetic oligonucleotide
gcaaccgugccccugccc

SEQ ID NO: 45614 - RNA, 18 nt, Artificial Sequence
  Description of Artificial Sequence: Synthetic oligonucleotide
uccaagcaaccgugcccc

SEQ ID NO: 45615 - RNA, 18 nt, Artificial Sequence
  Description of Artificial Sequence: Synthetic oligonucleotide
cccaguccaagcaaccgu

SEQ ID NO: 45616 - RNA, 18 nt, Artificial Sequence
  Description of Artificial Sequence: Synthetic oligonucleotide
ggcagcccaguccaagca

SEQ ID NO: 45617 - RNA, 18 nt, Artificial Sequence
  Description of Artificial Sequence: Synthetic oligonucleotide
caucgggcagcccagucc

SEQ ID NO: 45618 - RNA, 18 nt, Artificial Sequence
  Description of Artificial Sequence: Synthetic oligonucleotide
ccagacaucgggcagccc

SEQ ID NO: 45619 - RNA, 18 nt, Artificial Sequence
  Description of Artificial Sequence: Synthetic oligonucleotide
ccaugccagacaucgggc

SEQ ID NO: 45620 - RNA, 18 nt, Artificial Sequence
  Description of Artificial Sequence: Synthetic oligonucleotide
accagccaugccagacau

SEQ ID NO: 45621 - RNA, 18 nt, Artificial Sequence
  Description of Artificial Sequence: Synthetic oligonucleotide
ggaccaccagccaugcca

SEQ ID NO: 45622 - RNA, 18 nt, Artificial Sequence
  Description of Artificial Sequence: Synthetic oligonucleotide
caacaggaccaccagcca

SEQ ID NO: 45623 - RNA, 18 nt, Artificial Sequence
  Description of Artificial Sequence: Synthetic oligonucleotide
aaggacaacaggaccacc

SEQ ID NO: 45624 - RNA, 18 nt, Artificial Sequence
  Description of Artificial Sequence: Synthetic oligonucleotide
aaauaaaggacaacagga

SEQ ID NO: 45625 - RNA, 18 nt, Artificial Sequence
  Description of Artificial Sequence: Synthetic oligonucleotide
cgaucaaauaaaggacaa

SEQ ID NO: 45626 - RNA, 18 nt, Artificial Sequence
  Description of Artificial Sequence: Synthetic oligonucleotide
gcuaucgaucaaauaaag

SEQ ID NO: 45627 - RNA, 18 nt, Artificial Sequence
  Description of Artificial Sequence: Synthetic oligonucleotide
ucccugcuaucgaucaaa

SEQ ID NO: 45628 - RNA, 18 nt, Artificial Sequence
  Description of Artificial Sequence: Synthetic oligonucleotide
ucaguucccugcuaucga

SEQ ID NO: 45629 - RNA, 18 nt, Artificial Sequence
  Description of Artificial Sequence: Synthetic oligonucleotide
ggcggucaguucccugcu

SEQ ID NO: 45630 - RNA, 18 nt, Artificial Sequence
  Description of Artificial Sequence: Synthetic oligonucleotide
accucggcggucaguucc

SEQ ID NO: 45631 - RNA, 18 nt, Artificial Sequence
  Description of Artificial Sequence: Synthetic oligonucleotide
ugccaaccucggcgguca

SEQ ID NO: 45632 - RNA, 18 nt, Artificial Sequence
  Description of Artificial Sequence: Synthetic oligonucleotide
accugugccaaccucggc

SEQ ID NO: 45633 - RNA, 18 nt, Artificial Sequence
  Description of Artificial Sequence: Synthetic oligonucleotide
ugccaaccugugccaacc

SEQ ID NO: 45634 - RNA, 18 nt, Artificial Sequence
  Description of Artificial Sequence: Synthetic oligonucleotide
cccccugccaaccugugc

SEQ ID NO: 45635 - RNA, 18 nt, Artificial Sequence
  Description of Artificial Sequence: Synthetic oligonucleotide
cucaucccccugccaacc

SEQ ID NO: 45636 - RNA, 18 nt, Artificial Sequence
  Description of Artificial Sequence: Synthetic oligonucleotide
gcauccucaucccccugc

SEQ ID NO: 45637 - RNA, 18 nt, Artificial Sequence
  Description of Artificial Sequence: Synthetic oligonucleotide
acaaugcauccucauccc

SEQ ID NO: 45638 - RNA, 18 nt, Artificial Sequence
  Description of Artificial Sequence: Synthetic oligonucleotide
caaccacaaugcauccuc

SEQ ID NO: 45639 - RNA, 18 nt, Artificial Sequence
  Description of Artificial Sequence: Synthetic oligonucleotide
ggagacaaccacaaugca

SEQ ID NO: 45640 - RNA, 18 nt, Artificial Sequence
  Description of Artificial Sequence: Synthetic oligonucleotide
gaggaggagacaaccaca

SEQ ID NO: 45641 - RNA, 18 nt, Artificial Sequence
  Description of Artificial Sequence: Synthetic oligonucleotide
gagaggaggaggagacaa

SEQ ID NO: 45642 - RNA, 18 nt, Artificial Sequence
  Description of Artificial Sequence: Synthetic oligonucleotide
agaaggagaggaggagga

SEQ ID NO: 45643 - RNA, 18 nt, Artificial Sequence
  Description of Artificial Sequence: Synthetic oligonucleotide
gaggaagaaggagaggag

SEQ ID NO: 45644 - RNA, 18 nt, Artificial Sequence
  Description of Artificial Sequence: Synthetic oligonucleotide
gggaagaggaagaaggag

SEQ ID NO: 45645 - RNA, 18 nt, Artificial Sequence
  Description of Artificial Sequence: Synthetic oligonucleotide
aaaggagaggaggaaggg

SEQ ID NO: 45646 - RNA, 18 nt, Artificial Sequence
  Description of Artificial Sequence: Synthetic oligonucleotide
agaaaggagaggaggaag

SEQ ID NO: 45647 - RNA, 18 nt, Artificial Sequence
  Description of Artificial Sequence: Synthetic oligonucleotide
agaacagaaaggagagga

SEQ ID NO: 45648 - RNA, 18 nt, Artificial Sequence
  Description of Artificial Sequence: Synthetic oligonucleotide
gaacaagaacagaaagga

SEQ ID NO: 45649 - RNA, 18 nt, Artificial Sequence
  Description of Artificial Sequence: Synthetic oligonucleotide
agggagaacaagaacaga

SEQ ID NO: 45650 - RNA, 18 nt, Artificial Sequence
  Description of Artificial Sequence: Synthetic oligonucleotide
agaugagggagaacaaga

SEQ ID NO: 45651 - RNA, 18 nt, Artificial Sequence
  Description of Artificial Sequence: Synthetic oligonucleotide
gaggaagaugagggagaa

SEQ ID NO: 45652 - RNA, 18 nt, Artificial Sequence
  Description of Artificial Sequence: Synthetic oligonucleotide
aggaagaggaagaugagg

SEQ ID NO: 45653 - RNA, 18 nt, Artificial Sequence
  Description of Artificial Sequence: Synthetic oligonucleotide
gaagaaggaagaggaaga

SEQ ID NO: 45654 - RNA, 18 nt, Artificial Sequence
  Description of Artificial Sequence: Synthetic oligonucleotide
agggagaagaaggaagag

SEQ ID NO: 45655 - RNA, 18 nt, Artificial Sequence
  Description of Artificial Sequence: Synthetic oligonucleotide
agaagagggagaagaagg

SEQ ID NO: 45656 - RNA, 18 nt, Artificial Sequence
  Description of Artificial Sequence: Synthetic oligonucleotide
gaggaagaagagggagaa

SEQ ID NO: 45657 - RNA, 18 nt, Artificial Sequence
  Description of Artificial Sequence: Synthetic oligonucleotide
gugaagaggaagaagagg

SEQ ID NO: 45658 - RNA, 18 nt, Artificial Sequence
  Description of Artificial Sequence: Synthetic oligonucleotide
gcagagugaagaggaaga

SEQ ID NO: 45659 - RNA, 18 nt, Artificial Sequence
  Description of Artificial Sequence: Synthetic oligonucleotide
agagagcagagugaagag

SEQ ID NO: 45660 - RNA, 18 nt, Artificial Sequence
  Description of Artificial Sequence: Synthetic oligonucleotide
agagaagagagcagagug

SEQ ID NO: 45661 - RNA, 18 nt, Artificial Sequence
  Description of Artificial Sequence: Synthetic oligonucleotide
aaagaagagaagagagca

SEQ ID NO: 45662 - RNA, 18 nt, Artificial Sequence
  Description of Artificial Sequence: Synthetic oligonucleotide
ugauucacuccgcuguga

SEQ ID NO: 45663 - RNA, 18 nt, Artificial Sequence
  Description of Artificial Sequence: Synthetic oligonucleotide
cgagcugauucacuccgc

SEQ ID NO: 45664 - RNA, 18 nt, Artificial Sequence
  Description of Artificial Sequence: Synthetic oligonucleotide
accaccgagcugauucac

SEQ ID NO: 45665 - RNA, 18 nt, Artificial Sequence
  Description of Artificial Sequence: Synthetic oligonucleotide
aagacaccaccgagcuga

SEQ ID NO: 45666 - RNA, 18 nt, Artificial Sequence
  Description of Artificial Sequence: Synthetic oligonucleotide
ugacaaagacaccaccga

SEQ ID NO: 45667 - RNA, 18 nt, Artificial Sequence
  Description of Artificial Sequence: Synthetic oligonucleotide
cccguugacaaagacacc

SEQ ID NO: 45668 - RNA, 18 nt, Artificial Sequence
  Description of Artificial Sequence: Synthetic oligonucleotide
ggccgcccguugacaaag

SEQ ID NO: 45669 - RNA, 18 nt, Artificial Sequence
  Description of Artificial Sequence: Synthetic oligonucleotide
gcaguggccgcccguuga

SEQ ID NO: 45670 - RNA, 18 nt, Artificial Sequence
  Description of Artificial Sequence: Synthetic oligonucleotide
guccggcaguggccgccc

SEQ ID NO: 45671 - RNA, 18 nt, Artificial Sequence
  Description of Artificial Sequence: Synthetic oligonucleotide
guggaguccggcaguggc

SEQ ID NO: 45672 - RNA, 18 nt, Artificial Sequence
  Description of Artificial Sequence: Synthetic oligonucleotide
gccggguggaguccggca

SEQ ID NO: 45673 - RNA, 18 nt, Artificial Sequence
  Description of Artificial Sequence: Synthetic oligonucleotide
cuucugccggguggaguc

SEQ ID NO: 45674 - RNA, 18 nt, Artificial Sequence
  Description of Artificial Sequence: Synthetic oligonucleotide
acaaucuucugccgggug

SEQ ID NO: 45675 - RNA, 18 nt, Artificial Sequence
  Description of Artificial Sequence: Synthetic oligonucleotide
gcucuacaaucuucugcc

SEQ ID NO: 45676 - RNA, 18 nt, Artificial Sequence
  Description of Artificial Sequence: Synthetic oligonucleotide
agcuagcucuacaaucuu

SEQ ID NO: 45677 - RNA, 18 nt, Artificial Sequence
  Description of Artificial Sequence: Synthetic oligonucleotide
cugugagcuagcucuaca

SEQ ID NO: 45678 - RNA, 18 nt, Artificial Sequence
  Description of Artificial Sequence: Synthetic oligonucleotide
ccccgcugugagcuagcu

SEQ ID NO: 45679 - RNA, 18 nt, Artificial Sequence
  Description of Artificial Sequence: Synthetic oligonucleotide
ccgggccccgcugugagc

SEQ ID NO: 45680 - RNA, 18 nt, Artificial Sequence
  Description of Artificial Sequence: Synthetic oligonucleotide
cacggccgggccccgcug

SEQ ID NO: 45681 - RNA, 18 nt, Artificial Sequence
  Description of Artificial Sequence: Synthetic oligonucleotide
ugucgcacggccgggccc

SEQ ID NO: 45682 - RNA, 18 nt, Artificial Sequence
  Description of Artificial Sequence: Synthetic oligonucleotide
ggaaaugucgcacggccg

SEQ ID NO: 45683 - RNA, 18 nt, Artificial Sequence
  Description of Artificial Sequence: Synthetic oligonucleotide
auucgggaaaugucgcac

SEQ ID NO: 45684 - RNA, 18 nt, Artificial Sequence
  Description of Artificial Sequence: Synthetic oligonucleotide
gcagaauucgggaaaugu

SEQ ID NO: 45685 - RNA, 18 nt, Artificial Sequence
  Description of Artificial Sequence: Synthetic oligonucleotide
gauucacuccgcugugac

SEQ ID NO: 45686 - RNA, 18 nt, Artificial Sequence
  Description of Artificial Sequence: Synthetic oligonucleotide
gagcugauucacuccgcu

SEQ ID NO: 45687 - RNA, 18 nt, Artificial Sequence
  Description of Artificial Sequence: Synthetic oligonucleotide
ccaccgagcugauucacu

SEQ ID NO: 45688 - RNA, 18 nt, Artificial Sequence
  Description of Artificial Sequence: Synthetic oligonucleotide
agacaccaccgagcugau

SEQ ID NO: 45689 - RNA, 18 nt, Artificial Sequence
  Description of Artificial Sequence: Synthetic oligonucleotide
gacaaagacaccaccgag

SEQ ID NO: 45690 - RNA, 18 nt, Artificial Sequence
  Description of Artificial Sequence: Synthetic oligonucleotide
ccguugacaaagacacca

SEQ ID NO: 45691 - RNA, 18 nt, Artificial Sequence
  Description of Artificial Sequence: Synthetic oligonucleotide
gccgcccguugacaaaga

SEQ ID NO: 45692 - RNA, 18 nt, Artificial Sequence
  Description of Artificial Sequence: Synthetic oligonucleotide
caguggccgcccguugac

SEQ ID NO: 45693 - RNA, 18 nt, Artificial Sequence
  Description of Artificial Sequence: Synthetic oligonucleotide
uccggcaguggccgcccg

SEQ ID NO: 45694 - RNA, 18 nt, Artificial Sequence
  Description of Artificial Sequence: Synthetic oligonucleotide
uggaguccggcaguggcc

SEQ ID NO: 45695 - RNA, 18 nt, Artificial Sequence
  Description of Artificial Sequence: Synthetic oligonucleotide
ccggguggaguccggcag

SEQ ID NO: 45696 - RNA, 18 nt, Artificial Sequence
  Description of Artificial Sequence: Synthetic oligonucleotide
uucugccggguggagucc

SEQ ID NO: 45697 - RNA, 18 nt, Artificial Sequence
  Description of Artificial Sequence: Synthetic oligonucleotide
caaucuucugccgggugg

SEQ ID NO: 45698 - RNA, 18 nt, Artificial Sequence
  Description of Artificial Sequence: Synthetic oligonucleotide
cucuacaaucuucugccg

SEQ ID NO: 45699 - RNA, 18 nt, Artificial Sequence
  Description of Artificial Sequence: Synthetic oligonucleotide
gcuagcucuacaaucuuc

SEQ ID NO: 45700 - RNA, 18 nt, Artificial Sequence
  Description of Artificial Sequence: Synthetic oligonucleotide
ugugagcuagcucuacaa

SEQ ID NO: 45701 - RNA, 18 nt, Artificial Sequence
  Description of Artificial Sequence: Synthetic oligonucleotide
cccgcugugagcuagcuc

SEQ ID NO: 45702 - RNA, 18 nt, Artificial Sequence
  Description of Artificial Sequence: Synthetic oligonucleotide
cgggccccgcugugagcu

SEQ ID NO: 45703 - RNA, 18 nt, Artificial Sequence
  Description of Artificial Sequence: Synthetic oligonucleotide
acggccgggccccgcugu

SEQ ID NO: 45704 - RNA, 18 nt, Artificial Sequence
  Description of Artificial Sequence: Synthetic oligonucleotide
gucgcacggccgggcccc

SEQ ID NO: 45705 - RNA, 18 nt, Artificial Sequence
  Description of Artificial Sequence: Synthetic oligonucleotide
gaaaugucgcacggccgg

SEQ ID NO: 45706 - RNA, 18 nt, Artificial Sequence
  Description of Artificial Sequence: Synthetic oligonucleotide
uucgggaaaugucgcacg

SEQ ID NO: 45707 - RNA, 18 nt, Artificial Sequence
  Description of Artificial Sequence: Synthetic oligonucleotide
cagaauucgggaaauguc

SEQ ID NO: 45708 - RNA, 18 nt, Artificial Sequence
  Description of Artificial Sequence: Synthetic oligonucleotide
gggcggcgccgggaggau

SEQ ID NO: 45709 - RNA, 18 nt, Artificial Sequence
  Description of Artificial Sequence: Synthetic oligonucleotide
agaguggagggccgcggg

SEQ ID NO: 45710 - RNA, 18 nt, Artificial Sequence
  Description of Artificial Sequence: Synthetic oligonucleotide
cguugagaguggagggcc

SEQ ID NO: 45711 - RNA, 18 nt, Artificial Sequence
  Description of Artificial Sequence: Synthetic oligonucleotide
gagggcguugagagugga

SEQ ID NO: 45712 - RNA, 18 nt, Artificial Sequence
  Description of Artificial Sequence: Synthetic oligonucleotide
gaagagagggcguugaga

SEQ ID NO: 45713 - RNA, 18 nt, Artificial Sequence
  Description of Artificial Sequence: Synthetic oligonucleotide
gaaaugaagagagggcgu

SEQ ID NO: 45714 - RNA, 18 nt, Artificial Sequence
  Description of Artificial Sequence: Synthetic oligonucleotide
aguaagaaaugaagagag

SEQ ID NO: 45715 - RNA, 18 nt, Artificial Sequence
  Description of Artificial Sequence: Synthetic oligonucleotide
uuuacaguaagaaaugaa

SEQ ID NO: 45716 - RNA, 18 nt, Artificial Sequence
  Description of Artificial Sequence: Synthetic oligonucleotide
caucguuuacaguaagaa

SEQ ID NO: 45717 - RNA, 18 nt, Artificial Sequence
  Description of Artificial Sequence: Synthetic oligonucleotide
auuagcaucguuuacagu

SEQ ID NO: 45718 - RNA, 18 nt, Artificial Sequence
  Description of Artificial Sequence: Synthetic oligonucleotide
ccauaauuagcaucguuu

SEQ ID NO: 45719 - RNA, 18 nt, Artificial Sequence
  Description of Artificial Sequence: Synthetic oligonucleotide
ggguccauaauuagcauc

SEQ ID NO: 45720 - RNA, 18 nt, Artificial Sequence
  Description of Artificial Sequence: Synthetic oligonucleotide
gaaagugggaaggcaggg

SEQ ID NO: 45721 - RNA, 18 nt, Artificial Sequence
  Description of Artificial Sequence: Synthetic oligonucleotide
gggaaagugggaaggcag

SEQ ID NO: 45722 - RNA, 18 nt, Artificial Sequence
  Description of Artificial Sequence: Synthetic oligonucleotide
gaugguggaaggagaggg

SEQ ID NO: 45723 - RNA, 18 nt, Artificial Sequence
  Description of Artificial Sequence: Synthetic oligonucleotide
ggaaggaugguggaagga

SEQ ID NO: 45724 - RNA, 18 nt, Artificial Sequence
  Description of Artificial Sequence: Synthetic oligonucleotide
gauagggaaggauggugg

SEQ ID NO: 45725 - RNA, 18 nt, Artificial Sequence
  Description of Artificial Sequence: Synthetic oligonucleotide
aaagagauagggaaggau

SEQ ID NO: 45726 - RNA, 18 nt, Artificial Sequence
  Description of Artificial Sequence: Synthetic oligonucleotide
gguugaaagagauaggga

SEQ ID NO: 45727 - RNA, 18 nt, Artificial Sequence
  Description of Artificial Sequence: Synthetic oligonucleotide
acccagguugaaagagau

SEQ ID NO: 45728 - RNA, 18 nt, Artificial Sequence
  Description of Artificial Sequence: Synthetic oligonucleotide
aacugacccagguugaaa

SEQ ID NO: 45729 - RNA, 18 nt, Artificial Sequence
  Description of Artificial Sequence: Synthetic oligonucleotide
uauguaacugacccaggu

SEQ ID NO: 45730 - RNA, 18 nt, Artificial Sequence
  Description of Artificial Sequence: Synthetic oligonucleotide
uaucuuauguaacugacc

SEQ ID NO: 45731 - RNA, 18 nt, Artificial Sequence
  Description of Artificial Sequence: Synthetic oligonucleotide
ugaguuaucuuauguaac

SEQ ID NO: 45732 - RNA, 18 nt, Artificial Sequence
  Description of Artificial Sequence: Synthetic oligonucleotide
gcagaugaguuaucuuau

SEQ ID NO: 45733 - RNA, 18 nt, Artificial Sequence
  Description of Artificial Sequence: Synthetic oligonucleotide
cugaagcagaugaguuau

SEQ ID NO: 45734 - RNA, 18 nt, Artificial Sequence
  Description of Artificial Sequence: Synthetic oligonucleotide
uuuuucugaagcagauga

SEQ ID NO: 45735 - RNA, 18 nt, Artificial Sequence
  Description of Artificial Sequence: Synthetic oligonucleotide
caauauuuuucugaagca

SEQ ID NO: 45736 - RNA, 18 nt, Artificial Sequence
  Description of Artificial Sequence: Synthetic oligonucleotide
gcacacaauauuuuucug

SEQ ID NO: 45737 - RNA, 18 nt, Artificial Sequence
  Description of Artificial Sequence: Synthetic oligonucleotide
aauccgcacacaauauuu

SEQ ID NO: 45738 - RNA, 18 nt, Artificial Sequence
  Description of Artificial Sequence: Synthetic oligonucleotide
aaaaaaauccgcacacaa

SEQ ID NO: 45739 - RNA, 18 nt, Artificial Sequence
  Description of Artificial Sequence: Synthetic oligonucleotide
uuuuuaaaaaaauccgca

SEQ ID NO: 45740 - RNA, 18 nt, Artificial Sequence
  Description of Artificial Sequence: Synthetic oligonucleotide
agauuuuuuuaaaaaaau

SEQ ID NO: 45741 - RNA, 18 nt, Artificial Sequence
  Description of Artificial Sequence: Synthetic oligonucleotide
gagaaagauuuuuuuaaa

SEQ ID NO: 45742 - RNA, 18 nt, Artificial Sequence
  Description of Artificial Sequence: Synthetic oligonucleotide
aaaaagagaaagauuuuu

SEQ ID NO: 45743 - RNA, 18 nt, Artificial Sequence
  Description of Artificial Sequence: Synthetic oligonucleotide
caaauaaaaagagaaaga

SEQ ID NO: 45744 - RNA, 18 nt, Artificial Sequence
  Description of Artificial Sequence: Synthetic oligonucleotide
uuuaccaaauaaaaagag

SEQ ID NO: 45745 - RNA, 18 nt, Artificial Sequence
  Description of Artificial Sequence: Synthetic oligonucleotide
augucuuuaccaaauaaa

SEQ ID NO: 45746 - RNA, 18 nt, Artificial Sequence
  Description of Artificial Sequence: Synthetic oligonucleotide
aaugaaugucuuuaccaa

SEQ ID NO: 45747 - RNA, 18 nt, Artificial Sequence
  Description of Artificial Sequence: Synthetic oligonucleotide
cccacaaugaaugucuuu

SEQ ID NO: 45748 - RNA, 18 nt, Artificial Sequence
  Description of Artificial Sequence: Synthetic oligonucleotide
cuguucccacaaugaaug

SEQ ID NO: 45749 - RNA, 18 nt, Artificial Sequence
  Description of Artificial Sequence: Synthetic oligonucleotide
auaaacuguucccacaau

SEQ ID NO: 45750 - RNA, 18 nt, Artificial Sequence
  Description of Artificial Sequence: Synthetic oligonucleotide
gguucauaaacuguuccc

SEQ ID NO: 45751 - RNA, 18 nt, Artificial Sequence
  Description of Artificial Sequence: Synthetic oligonucleotide
auuacgguucauaaacug

SEQ ID NO: 45752 - RNA, 18 nt, Artificial Sequence
  Description of Artificial Sequence: Synthetic oligonucleotide
agcuuauuacgguucaua

SEQ ID NO: 45753 - RNA, 18 nt, Artificial Sequence
  Description of Artificial Sequence: Synthetic oligonucleotide
aacucagcuuauuacggu

SEQ ID NO: 45754 - RNA, 18 nt, Artificial Sequence
  Description of Artificial Sequence: Synthetic oligonucleotide
uauauaacucagcuuauu

SEQ ID NO: 45755 - RNA, 18 nt, Artificial Sequence
  Description of Artificial Sequence: Synthetic oligonucleotide
cgguuuauauaacucagc

SEQ ID NO: 45756 - RNA, 18 nt, Artificial Sequence
  Description of Artificial Sequence: Synthetic oligonucleotide
uaugccgguuuauauaac

SEQ ID NO: 45757 - RNA, 18 nt, Artificial Sequence
  Description of Artificial Sequence: Synthetic oligonucleotide
gaaauuaugccgguuuau

SEQ ID NO: 45758 - RNA, 18 nt, Artificial Sequence
  Description of Artificial Sequence: Synthetic oligonucleotide
agaaugaaauuaugccgg

SEQ ID NO: 45759 - RNA, 18 nt, Artificial Sequence
  Description of Artificial Sequence: Synthetic oligonucleotide
agagcagaaugaaauuau

SEQ ID NO: 45760 - RNA, 18 nt, Artificial Sequence
  Description of Artificial Sequence: Synthetic oligonucleotide
gggagagcagaaugaaau

SEQ ID NO: 45761 - RNA, 18 nt, Artificial Sequence
  Description of Artificial Sequence: Synthetic oligonucleotide
agguaagcaugggcuggg

SEQ ID NO: 45762 - RNA, 18 nt, Artificial Sequence
  Description of Artificial Sequence: Synthetic oligonucleotide
agcugagguaagcauggg

SEQ ID NO: 45763 - RNA, 18 nt, Artificial Sequence
  Description of Artificial Sequence: Synthetic oligonucleotide
ucaaaagcugagguaagc

SEQ ID NO: 45764 - RNA, 18 nt, Artificial Sequence
  Description of Artificial Sequence: Synthetic oligonucleotide
auaccucaaaagcugagg

SEQ ID NO: 45765 - RNA, 18 nt, Artificial Sequence
  Description of Artificial Sequence: Synthetic oligonucleotide
aacaaauaccucaaaagc

SEQ ID NO: 45766 - RNA, 18 nt, Artificial Sequence
  Description of Artificial Sequence: Synthetic oligonucleotide
gaauaaacaaauaccuca

SEQ ID NO: 45767 - RNA, 18 nt, Artificial Sequence
  Description of Artificial Sequence: Synthetic oligonucleotide
augaagaauaaacaaaua

SEQ ID NO: 45768 - RNA, 18 nt, Artificial Sequence
  Description of Artificial Sequence: Synthetic oligonucleotide
uaaacaugaagaauaaac

SEQ ID NO: 45769 - RNA, 18 nt, Artificial Sequence
  Description of Artificial Sequence: Synthetic oligonucleotide
auucauaaacaugaagaa

SEQ ID NO: 45770 - RNA, 18 nt, Artificial Sequence
  Description of Artificial Sequence: Synthetic oligonucleotide
auauuauucauaaacaug

SEQ ID NO: 45771 - RNA, 18 nt, Artificial Sequence
  Description of Artificial Sequence: Synthetic oligonucleotide
aauauauauuauucauaa

SEQ ID NO: 45772 - RNA, 18 nt, Artificial Sequence
  Description of Artificial Sequence: Synthetic oligonucleotide
aaaucaauauauauuauu

SEQ ID NO: 45773 - RNA, 18 nt, Artificial Sequence
  Description of Artificial Sequence: Synthetic oligonucleotide
uuuuaaaaucaauauaua

SEQ ID NO: 45774 - RNA, 18 nt, Artificial Sequence
  Description of Artificial Sequence: Synthetic oligonucleotide
uugccuuuuaaaaucaau

SEQ ID NO: 45775 - RNA, 18 nt, Artificial Sequence
  Description of Artificial Sequence: Synthetic oligonucleotide
agcauuugccuuuuaaaa

SEQ ID NO: 45776 - RNA, 18 nt, Artificial Sequence
  Description of Artificial Sequence: Synthetic oligonucleotide
uaaauagcauuugccuuu

SEQ ID NO: 45777 - RNA, 18 nt, Artificial Sequence
  Description of Artificial Sequence: Synthetic oligonucleotide
aggaguaaauagcauuug

SEQ ID NO: 45778 - RNA, 18 nt, Artificial Sequence
  Description of Artificial Sequence: Synthetic oligonucleotide
uagggaggaguaaauagc

SEQ ID NO: 45779 - RNA, 18 nt, Artificial Sequence
  Description of Artificial Sequence: Synthetic oligonucleotide
ugaguuagggaggaguaa

SEQ ID NO: 45780 - RNA, 18 nt, Artificial Sequence
  Description of Artificial Sequence: Synthetic oligonucleotide
aaaugugaguuagggagg

SEQ ID NO: 45781 - RNA, 18 nt, Artificial Sequence
  Description of Artificial Sequence: Synthetic oligonucleotide
ugaguaaaugugaguuag

SEQ ID NO: 45782 - RNA, 18 nt, Artificial Sequence
  Description of Artificial Sequence: Synthetic oligonucleotide
ucaauugaguaaauguga

SEQ ID NO: 45783 - RNA, 18 nt, Artificial Sequence
  Description of Artificial Sequence: Synthetic oligonucleotide
aauacucaauugaguaaa

SEQ ID NO: 45784 - RNA, 18 nt, Artificial Sequence
  Description of Artificial Sequence: Synthetic oligonucleotide
agcauuugccuuuuaaaa

SEQ ID NO: 45785 - RNA, 18 nt, Artificial Sequence
  Description of Artificial Sequence: Synthetic oligonucleotide
uaaauagcauuugccuuu

SEQ ID NO: 45786 - RNA, 18 nt, Artificial Sequence
  Description of Artificial Sequence: Synthetic oligonucleotide
aggaguaaauagcauuug

SEQ ID NO: 45787 - RNA, 18 nt, Artificial Sequence
  Description of Artificial Sequence: Synthetic oligonucleotide
uagggaggaguaaauagc

SEQ ID NO: 45788 - RNA, 18 nt, Artificial Sequence
  Description of Artificial Sequence: Synthetic oligonucleotide
ugaguuagggaggaguaa

SEQ ID NO: 45789 - RNA, 18 nt, Artificial Sequence
  Description of Artificial Sequence: Synthetic oligonucleotide
aaaugugaguuagggagg

SEQ ID NO: 45790 - RNA, 18 nt, Artificial Sequence
  Description of Artificial Sequence: Synthetic oligonucleotide
ugaguaaaugugaguuag

SEQ ID NO: 45791 - RNA, 18 nt, Artificial Sequence
  Description of Artificial Sequence: Synthetic oligonucleotide
ucaauugaguaaauguga

SEQ ID NO: 45792 - RNA, 18 nt, Artificial Sequence
  Description of Artificial Sequence: Synthetic oligonucleotide
aauacucaauugaguaaa

SEQ ID NO: 45793 - RNA, 18 nt, Artificial Sequence
  Description of Artificial Sequence: Synthetic oligonucleotide
uaaaaaauacucaauuga

SEQ ID NO: 45794 - RNA, 18 nt, Artificial Sequence
  Description of Artificial Sequence: Synthetic oligonucleotide
uucuuuaaaaaauacuca

SEQ ID NO: 45795 - RNA, 18 nt, Artificial Sequence
  Description of Artificial Sequence: Synthetic oligonucleotide
ucuucuucuuuaaaaaau

SEQ ID NO: 45796 - RNA, 18 nt, Artificial Sequence
  Description of Artificial Sequence: Synthetic oligonucleotide
uuacuucuucuucuuuaa

SEQ ID NO: 45797 - RNA, 18 nt, Artificial Sequence
  Description of Artificial Sequence: Synthetic oligonucleotide
uuuuuuuacuucuucuuc

SEQ ID NO: 45798 - RNA, 18 nt, Artificial Sequence
  Description of Artificial Sequence: Synthetic oligonucleotide
acugauuuuuuuacuucu

SEQ ID NO: 45799 - RNA, 18 nt, Artificial Sequence
  Description of Artificial Sequence: Synthetic oligonucleotide
aauaaacugauuuuuuua

SEQ ID NO: 45800 - RNA, 18 nt, Artificial Sequence
  Description of Artificial Sequence: Synthetic oligonucleotide
uaaaaaauaaacugauuu

SEQ ID NO: 45801 - RNA, 18 nt, Artificial Sequence
  Description of Artificial Sequence: Synthetic oligonucleotide
aaagguaaaaaauaaacu

SEQ ID NO: 45802 - RNA, 18 nt, Artificial Sequence
  Description of Artificial Sequence: Synthetic oligonucleotide
agaacaaagguaaaaaau

SEQ ID NO: 45803 - RNA, 18 nt, Artificial Sequence
  Description of Artificial Sequence: Synthetic oligonucleotide
uuuaaagaacaaagguaa

SEQ ID NO: 45804 - RNA, 18 nt, Artificial Sequence
  Description of Artificial Sequence: Synthetic oligonucleotide
uauguuuuaaagaacaaa

SEQ ID NO: 45805 - RNA, 18 nt, Artificial Sequence
  Description of Artificial Sequence: Synthetic oligonucleotide
ggcguuauguuuuaaaga

SEQ ID NO: 45806 - RNA, 18 nt, Artificial Sequence
  Description of Artificial Sequence: Synthetic oligonucleotide
aaaguggcguuauguuuu

SEQ ID NO: 45807 - RNA, 18 nt, Artificial Sequence
  Description of Artificial Sequence: Synthetic oligonucleotide
ugcuuaaaguggcguuau

SEQ ID NO: 45808 - RNA, 18 nt, Artificial Sequence
  Description of Artificial Sequence: Synthetic oligonucleotide
gaccuugcuuaaaguggc

SEQ ID NO: 45809 - RNA, 18 nt, Artificial Sequence
  Description of Artificial Sequence: Synthetic oligonucleotide
gugcugaccuugcuuaaa

SEQ ID NO: 45810 - RNA, 18 nt, Artificial Sequence
  Description of Artificial Sequence: Synthetic oligonucleotide
uuuuugugcugaccuugc

SEQ ID NO: 45811 - RNA, 18 nt, Artificial Sequence
  Description of Artificial Sequence: Synthetic oligonucleotide
auuuauuuuugugcugac

SEQ ID NO: 45812 - RNA, 18 nt, Artificial Sequence
  Description of Artificial Sequence: Synthetic oligonucleotide
gauaaauuuauuuuugug

SEQ ID NO: 45813 - RNA, 18 nt, Artificial Sequence
  Description of Artificial Sequence: Synthetic oligonucleotide
aaguagauaaauuuauuu

SEQ ID NO: 45814 - RNA, 18 nt, Artificial Sequence
  Description of Artificial Sequence: Synthetic oligonucleotide
aaacgaaguagauaaauu

SEQ ID NO: 45815 - RNA, 18 nt, Artificial Sequence
  Description of Artificial Sequence: Synthetic oligonucleotide
caucaaaacgaaguagau

SEQ ID NO: 45816 - RNA, 18 nt, Artificial Sequence
  Description of Artificial Sequence: Synthetic oligonucleotide
agaugcaucaaaacgaag

SEQ ID NO: 45817 - RNA, 18 nt, Artificial Sequence
  Description of Artificial Sequence: Synthetic oligonucleotide
ccugaagaugcaucaaaa

SEQ ID NO: 45818 - RNA, 18 nt, Artificial Sequence
  Description of Artificial Sequence: Synthetic oligonucleotide
cacugccugaagaugcau

SEQ ID NO: 45819 - RNA, 18 nt, Artificial Sequence
  Description of Artificial Sequence: Synthetic oligonucleotide
uuaaacacugccugaaga

SEQ ID NO: 45820 - RNA, 18 nt, Artificial Sequence
  Description of Artificial Sequence: Synthetic oligonucleotide
uuuucuuaaacacugccu

SEQ ID NO: 45821 - RNA, 18 nt, Artificial Sequence
  Description of Artificial Sequence: Synthetic oligonucleotide
aaaacuuuucuuaaacac

SEQ ID NO: 45822 - RNA, 18 nt, Artificial Sequence
  Description of Artificial Sequence: Synthetic oligonucleotide
aaaaaaaaacuuuucuua

SEQ ID NO: 45823 - RNA, 18 nt, Artificial Sequence
  Description of Artificial Sequence: Synthetic oligonucleotide
uuuuaaaaaaaaaacuuu

SEQ ID NO: 45824 - RNA, 18 nt, Artificial Sequence
  Description of Artificial Sequence: Synthetic oligonucleotide
gcuuuuuuuaaaaaaaaa

SEQ ID NO: 45825 - RNA, 18 nt, Artificial Sequence
  Description of Artificial Sequence: Synthetic oligonucleotide
uaaaagcuuuuuuuaaaa

SEQ ID NO: 45826 - RNA, 18 nt, Artificial Sequence
  Description of Artificial Sequence: Synthetic oligonucleotide
gaauuuaaaagcuuuuuu

SEQ ID NO: 45827 - RNA, 18 nt, Artificial Sequence
  Description of Artificial Sequence: Synthetic oligonucleotide
aaaacgaauuuaaaagcu

SEQ ID NO: 45828 - RNA, 18 nt, Artificial Sequence
  Description of Artificial Sequence: Synthetic oligonucleotide
acuaaaaaacgaauuuaa

SEQ ID NO: 45829 - RNA, 18 nt, Artificial Sequence
  Description of Artificial Sequence: Synthetic oligonucleotide
uuugaacuaaaaaacgaa

SEQ ID NO: 45830 - RNA, 18 nt, Artificial Sequence
  Description of Artificial Sequence: Synthetic oligonucleotide
aacaauuugaacuaaaaa

SEQ ID NO: 45831 - RNA, 18 nt, Artificial Sequence
  Description of Artificial Sequence: Synthetic oligonucleotide
uuucaaacaauuugaacu

SEQ ID NO: 45832 - RNA, 18 nt, Artificial Sequence
  Description of Artificial Sequence: Synthetic oligonucleotide
gauacuuucaaacaauuu

SEQ ID NO: 45833 - RNA, 18 nt, Artificial Sequence
  Description of Artificial Sequence: Synthetic oligonucleotide
augaugauacuuucaaac

SEQ ID NO: 45834 - RNA, 18 nt, Artificial Sequence
  Description of Artificial Sequence: Synthetic oligonucleotide
caaauaugaugauacuuu

SEQ ID NO: 45835 - RNA, 18 nt, Artificial Sequence
  Description of Artificial Sequence: Synthetic oligonucleotide
aacuacaaauaugaugau

SEQ ID NO: 45836 - RNA, 18 nt, Artificial Sequence
  Description of Artificial Sequence: Synthetic oligonucleotide
cuaaaaacuacaaauaug

SEQ ID NO: 45837 - RNA, 18 nt, Artificial Sequence
  Description of Artificial Sequence: Synthetic oligonucleotide
uagcccuaaaaacuacaa

SEQ ID NO: 45838 - RNA, 18 nt, Artificial Sequence
  Description of Artificial Sequence: Synthetic oligonucleotide
auuuguagcccuaaaaac

SEQ ID NO: 45839 - RNA, 18 nt, Artificial Sequence
  Description of Artificial Sequence: Synthetic oligonucleotide
auuacauuuguagcccua

SEQ ID NO: 45840 - RNA, 18 nt, Artificial Sequence
  Description of Artificial Sequence: Synthetic oligonucleotide
uuaaaauuacauuuguag

SEQ ID NO: 45841 - RNA, 18 nt, Artificial Sequence
  Description of Artificial Sequence: Synthetic oligonucleotide
uuuucuuaaaauuacauu

SEQ ID NO: 45842 - RNA, 18 nt, Artificial Sequence
  Description of Artificial Sequence: Synthetic oligonucleotide
gcuuuuuuucuuaaaauu

SEQ ID NO: 45843 - RNA, 18 nt, Artificial Sequence
  Description of Artificial Sequence: Synthetic oligonucleotide
agagagcuuuuuuucuua

SEQ ID NO: 45844 - RNA, 18 nt, Artificial Sequence
  Description of Artificial Sequence: Synthetic oligonucleotide
acuguagagagcuuuuuu

SEQ ID NO: 45845 - RNA, 18 nt, Artificial Sequence
  Description of Artificial Sequence: Synthetic oligonucleotide
aacuuacuguagagagcu

SEQ ID NO: 45846 - RNA, 18 nt, Artificial Sequence
  Description of Artificial Sequence: Synthetic oligonucleotide
augagaacuuacuguaga

SEQ ID NO: 45847 - RNA, 18 nt, Artificial Sequence
  Description of Artificial Sequence: Synthetic oligonucleotide
augguaugagaacuuacu

SEQ ID NO: 45848 - RNA, 18 nt, Artificial Sequence
  Description of Artificial Sequence: Synthetic oligonucleotide
cuucaaugguaugagaac

SEQ ID NO: 45849 - RNA, 18 nt, Artificial Sequence
  Description of Artificial Sequence: Synthetic oligonucleotide
uauaccuucaaugguaug

SEQ ID NO: 45850 - RNA, 18 nt, Artificial Sequence
  Description of Artificial Sequence: Synthetic oligonucleotide
aaaaauauaccuucaaug

SEQ ID NO: 45851 - RNA, 18 nt, Artificial Sequence
  Description of Artificial Sequence: Synthetic oligonucleotide
aacacaaaaauauaccuu

SEQ ID NO: 45852 - RNA, 18 nt, Artificial Sequence
  Description of Artificial Sequence: Synthetic oligonucleotide
ucuauaacacaaaaauau

SEQ ID NO: 45853 - RNA, 18 nt, Artificial Sequence
  Description of Artificial Sequence: Synthetic oligonucleotide
augggucuauaacacaaa

SEQ ID NO: 45854 - RNA, 18 nt, Artificial Sequence
  Description of Artificial Sequence: Synthetic oligonucleotide
ucugcaugggucuauaac

SEQ ID NO: 45855 - RNA, 18 nt, Artificial Sequence
  Description of Artificial Sequence: Synthetic oligonucleotide
uugcaucugcaugggucu

SEQ ID NO: 45856 - RNA, 18 nt, Artificial Sequence
  Description of Artificial Sequence: Synthetic oligonucleotide
gacuuuugcaucugcaug

SEQ ID NO: 45857 - RNA, 18 nt, Artificial Sequence
  Description of Artificial Sequence: Synthetic oligonucleotide
acuuggacuuuugcaucu

SEQ ID NO: 45858 - RNA, 18 nt, Artificial Sequence
  Description of Artificial Sequence: Synthetic oligonucleotide
ccagcacuuggacuuuug

SEQ ID NO: 45859 - RNA, 18 nt, Artificial Sequence
  Description of Artificial Sequence: Synthetic oligonucleotide
auuguccagcacuuggac

SEQ ID NO: 45860 - RNA, 18 nt, Artificial Sequence
  Description of Artificial Sequence: Synthetic oligonucleotide
uuuugauuguccagcacu

SEQ ID NO: 45861 - RNA, 18 nt, Artificial Sequence
  Description of Artificial Sequence: Synthetic oligonucleotide
uuacguuuugauugucca

SEQ ID NO: 45862 - RNA, 18 nt, Artificial Sequence
  Description of Artificial Sequence: Synthetic oligonucleotide
caagcuuacguuuugauu

SEQ ID NO: 45863 - RNA, 18 nt, Artificial Sequence
  Description of Artificial Sequence: Synthetic oligonucleotide
aaugacaagcuuacguuu

SEQ ID NO: 45864 - RNA, 18 nt, Artificial Sequence
  Description of Artificial Sequence: Synthetic oligonucleotide
uaaacaaugacaagcuua

SEQ ID NO: 45865 - RNA, 18 nt, Artificial Sequence
  Description of Artificial Sequence: Synthetic oligonucleotide
ugcauuaaacaaugacaa

SEQ ID NO: 45866 - RNA, 18 nt, Artificial Sequence
  Description of Artificial Sequence: Synthetic oligonucleotide
aaguaugcauuaaacaau

SEQ ID NO: 45867 - RNA, 18 nt, Artificial Sequence
  Description of Artificial Sequence: Synthetic oligonucleotide
uguuuaaguaugcauuaa

SEQ ID NO: 45868 - RNA, 18 nt, Artificial Sequence
  Description of Artificial Sequence: Synthetic oligonucleotide
aaaauuguuuaaguaugc

SEQ ID NO: 45869 - RNA, 18 nt, Artificial Sequence
  Description of Artificial Sequence: Synthetic oligonucleotide
aaaauaaaauuguuuaag

SEQ ID NO: 45870 - RNA, 18 nt, Artificial Sequence
  Description of Artificial Sequence: Synthetic oligonucleotide
agacaaaaauaaaauugu

SEQ ID NO: 45871 - RNA, 18 nt, Artificial Sequence
  Description of Artificial Sequence: Synthetic oligonucleotide
uuucaagacaaaaauaaa

SEQ ID NO: 45872 - RNA, 18 nt, Artificial Sequence
  Description of Artificial Sequence: Synthetic oligonucleotide
aauaauuucaagacaaaa

SEQ ID NO: 45873 - RNA, 18 nt, Artificial Sequence
  Description of Artificial Sequence: Synthetic oligonucleotide
uuauuaauaauuucaaga

SEQ ID NO: 45874 - RNA, 18 nt, Artificial Sequence
  Description of Artificial Sequence: Synthetic oligonucleotide
ccacauuauuaauaauuu

SEQ ID NO: 45875 - RNA, 18 nt, Artificial Sequence
  Description of Artificial Sequence: Synthetic oligonucleotide
gaaaaccacauuauuaau

SEQ ID NO: 45876 - RNA, 18 nt, Artificial Sequence
  Description of Artificial Sequence: Synthetic oligonucleotide
ggacagaaaaccacauua

SEQ ID NO: 45877 - RNA, 18 nt, Artificial Sequence
  Description of Artificial Sequence: Synthetic oligonucleotide
ucacacauccguuggaca

SEQ ID NO: 45878 - RNA, 18 nt, Artificial Sequence
  Description of Artificial Sequence: Synthetic oligonucleotide
uuuacucacacauccguu

SEQ ID NO: 45879 - RNA, 18 nt, Artificial Sequence
  Description of Artificial Sequence: Synthetic oligonucleotide
agaauuuuacucacacau

SEQ ID NO: 45880 - RNA, 18 nt, Artificial Sequence
  Description of Artificial Sequence: Synthetic oligonucleotide
ugcccagaauuuuacuca

SEQ ID NO: 45881 - RNA, 18 nt, Artificial Sequence
  Description of Artificial Sequence: Synthetic oligonucleotide
auaccugcccagaauuuu

SEQ ID NO: 45882 - RNA, 18 nt, Artificial Sequence
  Description of Artificial Sequence: Synthetic oligonucleotide
ucguaauaccugcccaga

SEQ ID NO: 45883 - RNA, 18 nt, Artificial Sequence
  Description of Artificial Sequence: Synthetic oligonucleotide
cagucucguaauaccugc

SEQ ID NO: 45884 - RNA, 18 nt, Artificial Sequence
  Description of Artificial Sequence: Synthetic oligonucleotide
ggagccagucucguaaua

SEQ ID NO: 45885 - RNA, 18 nt, Artificial Sequence
  Description of Artificial Sequence: Synthetic oligonucleotide
cugauggagccagucucg

SEQ ID NO: 45886 - RNA, 18 nt, Artificial Sequence
  Description of Artificial Sequence: Synthetic oligonucleotide
ugggucugauggagccag

SEQ ID NO: 45887 - RNA, 18 nt, Artificial Sequence
  Description of Artificial Sequence: Synthetic oligonucleotide
ugcccugggucugaugga

SEQ ID NO: 45888 - RNA, 18 nt, Artificial Sequence
  Description of Artificial Sequence: Synthetic oligonucleotide
ccgauugcccugggucug

SEQ ID NO: 45889 - RNA, 18 nt, Artificial Sequence
  Description of Artificial Sequence: Synthetic oligonucleotide
uaccaccgauugcccugg

SEQ ID NO: 45890 - RNA, 18 nt, Artificial Sequence
  Description of Artificial Sequence: Synthetic oligonucleotide
uuuacuaccaccgauugc

SEQ ID NO: 45891 - RNA, 18 nt, Artificial Sequence
  Description of Artificial Sequence: Synthetic oligonucleotide
cucgguuuacuaccaccg

SEQ ID NO: 45892 - RNA, 18 nt, Artificial Sequence
  Description of Artificial Sequence: Synthetic oligonucleotide
cuacucucgguuuacuac

SEQ ID NO: 45893 - RNA, 18 nt, Artificial Sequence
  Description of Artificial Sequence: Synthetic oligonucleotide
agucgcuacucucgguuu

SEQ ID NO: 45894 - RNA, 18 nt, Artificial Sequence
  Description of Artificial Sequence: Synthetic oligonucleotide
ucuggagucgcuacucuc

SEQ ID NO: 45895 - RNA, 18 nt, Artificial Sequence
  Description of Artificial Sequence: Synthetic oligonucleotide
caacuucuggagucgcua

SEQ ID NO: 45896 - RNA, 18 nt, Artificial Sequence
  Description of Artificial Sequence: Synthetic oligonucleotide
gcuuacaacuucuggagu

SEQ ID NO: 45897 - RNA, 18 nt, Artificial Sequence
  Description of Artificial Sequence: Synthetic oligonucleotide
auuuugcuuacaacuucu

SEQ ID NO: 45898 - RNA, 18 nt, Artificial Sequence
  Description of Artificial Sequence: Synthetic oligonucleotide
gggcuauuuugcuuacaa

SEQ ID NO: 45899 - RNA, 18 nt, Artificial Sequence
  Description of Artificial Sequence: Synthetic oligonucleotide
auacugggcuauuuugcu

SEQ ID NO: 45900 - RNA, 18 nt, Artificial Sequence
  Description of Artificial Sequence: Synthetic oligonucleotide
cgcuuauacugggcuauu

SEQ ID NO: 45901 - RNA, 18 nt, Artificial Sequence
  Description of Artificial Sequence: Synthetic oligonucleotide
acucccgcuuauacuggg

SEQ ID NO: 45902 - RNA, 18 nt, Artificial Sequence
  Description of Artificial Sequence: Synthetic oligonucleotide
cgggcacucccgcuuaua

SEQ ID NO: 45903 - RNA, 18 nt, Artificial Sequence
  Description of Artificial Sequence: Synthetic oligonucleotide
auggacgggcacucccgc

SEQ ID NO: 45904 - RNA, 18 nt, Artificial Sequence
  Description of Artificial Sequence: Synthetic oligonucleotide
caaagauggacgggcacu

SEQ ID NO: 45905 - RNA, 18 nt, Artificial Sequence
  Description of Artificial Sequence: Synthetic oligonucleotide
ccaagcaaagauggacgg

SEQ ID NO: 45906 - RNA, 18 nt, Artificial Sequence
  Description of Artificial Sequence: Synthetic oligonucleotide
auuucccaagcaaagaug

SEQ ID NO: 45907 - RNA, 18 nt, Artificial Sequence
  Description of Artificial Sequence: Synthetic oligonucleotide
cucggauuucccaagcaa

SEQ ID NO: 45908 - RNA, 18 nt, Artificial Sequence
  Description of Artificial Sequence: Synthetic oligonucleotide
ucugucucggauuuccca

SEQ ID NO: 45909 - RNA, 18 nt, Artificial Sequence
  Description of Artificial Sequence: Synthetic oligonucleotide
aguaaucugucucggauu

SEQ ID NO: 45910 - RNA, 18 nt, Artificial Sequence
  Description of Artificial Sequence: Synthetic oligonucleotide
cggacaguaaucugucuc

SEQ ID NO: 45911 - RNA, 18 nt, Artificial Sequence
  Description of Artificial Sequence: Synthetic oligonucleotide
ccccucggacaguaaucu

SEQ ID NO: 45912 - RNA, 18 nt, Artificial Sequence
  Description of Artificial Sequence: Synthetic oligonucleotide
cagacccccucggacagu

SEQ ID NO: 45913 - RNA, 18 nt, Artificial Sequence
  Description of Artificial Sequence: Synthetic oligonucleotide
ugguacagacccccucgg

SEQ ID NO: 45914 - RNA, 18 nt, Artificial Sequence
  Description of Artificial Sequence: Synthetic oligonucleotide
aucguugguacagacccc

SEQ ID NO: 45915 - RNA, 18 nt, Artificial Sequence
  Description of Artificial Sequence: Synthetic oligonucleotide
auguuaucguugguacag

SEQ ID NO: 45916 - RNA, 18 nt, Artificial Sequence
  Description of Artificial Sequence: Synthetic oligonucleotide
uugguauguuaucguugg

SEQ ID NO: 45917 - RNA, 18 nt, Artificial Sequence
  Description of Artificial Sequence: Synthetic oligonucleotide
cacacauccguuggacac

SEQ ID NO: 45918 - RNA, 18 nt, Artificial Sequence
  Description of Artificial Sequence: Synthetic oligonucleotide
uuacucacacauccguug

SEQ ID NO: 45919 - RNA, 18 nt, Artificial Sequence
  Description of Artificial Sequence: Synthetic oligonucleotide
gaauuuuacucacacauc

SEQ ID NO: 45920 - RNA, 18 nt, Artificial Sequence
  Description of Artificial Sequence: Synthetic oligonucleotide
gcccagaauuuuacucac

SEQ ID NO: 45921 - RNA, 18 nt, Artificial Sequence
  Description of Artificial Sequence: Synthetic oligonucleotide
uaccugcccagaauuuua

SEQ ID NO: 45922 - RNA, 18 nt, Artificial Sequence
  Description of Artificial Sequence: Synthetic oligonucleotide
cguaauaccugcccagaa

SEQ ID NO: 45923 - RNA, 18 nt, Artificial Sequence
  Description of Artificial Sequence: Synthetic oligonucleotide
agucucguaauaccugcc

SEQ ID NO: 45924 - RNA, 18 nt, Artificial Sequence
  Description of Artificial Sequence: Synthetic oligonucleotide
gagccagucucguaauac

SEQ ID NO: 45925 - RNA, 18 nt, Artificial Sequence
  Description of Artificial Sequence: Synthetic oligonucleotide
ugauggagccagucucgu

SEQ ID NO: 45926 - RNA, 18 nt, Artificial Sequence
  Description of Artificial Sequence: Synthetic oligonucleotide
gggucugauggagccagu

SEQ ID NO: 45927 - RNA, 18 nt, Artificial Sequence
  Description of Artificial Sequence: Synthetic oligonucleotide
gcccugggucugauggag

SEQ ID NO: 45928 - RNA, 18 nt, Artificial Sequence
  Description of Artificial Sequence: Synthetic oligonucleotide
cgauugcccugggucuga

SEQ ID NO: 45929 - RNA, 18 nt, Artificial Sequence
  Description of Artificial Sequence: Synthetic oligonucleotide
accaccgauugcccuggg

SEQ ID NO: 45930 - RNA, 18 nt, Artificial Sequence
  Description of Artificial Sequence: Synthetic oligonucleotide
uuacuaccaccgauugcc

SEQ ID NO: 45931 - RNA, 18 nt, Artificial Sequence
  Description of Artificial Sequence: Synthetic oligonucleotide
ucgguuuacuaccaccga

SEQ ID NO: 45932 - RNA, 18 nt, Artificial Sequence
  Description of Artificial Sequence: Synthetic oligonucleotide
uacucucgguuuacuacc

SEQ ID NO: 45933 - RNA, 18 nt, Artificial Sequence
  Description of Artificial Sequence: Synthetic oligonucleotide
gucgcuacucucgguuua

SEQ ID NO: 45934 - RNA, 18 nt, Artificial Sequence
  Description of Artificial Sequence: Synthetic oligonucleotide
cuggagucgcuacucucg

SEQ ID NO: 45935 - RNA, 18 nt, Artificial Sequence
  Description of Artificial Sequence: Synthetic oligonucleotide
aacuucuggagucgcuac

SEQ ID NO: 45936 - RNA, 18 nt, Artificial Sequence
  Description of Artificial Sequence: Synthetic oligonucleotide
cuuacaacuucuggaguc

SEQ ID NO: 45937 - RNA, 18 nt, Artificial Sequence
  Description of Artificial Sequence: Synthetic oligonucleotide
uuuugcuuacaacuucug

SEQ ID NO: 45938 - RNA, 18 nt, Artificial Sequence
  Description of Artificial Sequence: Synthetic oligonucleotide
ggcuauuuugcuuacaac

SEQ ID NO: 45939 - RNA, 18 nt, Artificial Sequence
  Description of Artificial Sequence: Synthetic oligonucleotide
uacugggcuauuuugcuu

SEQ ID NO: 45940 - RNA, 18 nt, Artificial Sequence
  Description of Artificial Sequence: Synthetic oligonucleotide
gcuuauacugggcuauuu

SEQ ID NO: 45941 - RNA, 18 nt, Artificial Sequence
  Description of Artificial Sequence: Synthetic oligonucleotide
cucccgcuuauacugggc

SEQ ID NO: 45942 - RNA, 18 nt, Artificial Sequence
  Description of Artificial Sequence: Synthetic oligonucleotide
gggcacucccgcuuauac

SEQ ID NO: 45943 - RNA, 18 nt, Artificial Sequence
  Description of Artificial Sequence: Synthetic oligonucleotide
uggacgggcacucccgcu

SEQ ID NO: 45944 - RNA, 18 nt, Artificial Sequence
  Description of Artificial Sequence: Synthetic oligonucleotide
aaagauggacgggcacuc

SEQ ID NO: 45945 - RNA, 18 nt, Artificial Sequence
  Description of Artificial Sequence: Synthetic oligonucleotide
caagcaaagauggacggg

SEQ ID NO: 45946 - RNA, 18 nt, Artificial Sequence
  Description of Artificial Sequence: Synthetic oligonucleotide
uuucccaagcaaagaugg

SEQ ID NO: 45947 - RNA, 18 nt, Artificial Sequence
  Description of Artificial Sequence: Synthetic oligonucleotide
ucggauuucccaagcaaa

SEQ ID NO: 45948 - RNA, 18 nt, Artificial Sequence
  Description of Artificial Sequence: Synthetic oligonucleotide
cugucucggauuucccaa

SEQ ID NO: 45949 - RNA, 18 nt, Artificial Sequence
  Description of Artificial Sequence: Synthetic oligonucleotide
guaaucugucucggauuu

SEQ ID NO: 45950 - RNA, 18 nt, Artificial Sequence
  Description of Artificial Sequence: Synthetic oligonucleotide
ggacaguaaucugucucg

SEQ ID NO: 45951 - RNA, 18 nt, Artificial Sequence
  Description of Artificial Sequence: Synthetic oligonucleotide
cccucggacaguaaucug

SEQ ID NO: 45952 - RNA, 18 nt, Artificial Sequence
  Description of Artificial Sequence: Synthetic oligonucleotide
agacccccucggacagua

SEQ ID NO: 45953 - RNA, 18 nt, Artificial Sequence
  Description of Artificial Sequence: Synthetic oligonucleotide
gguacagacccccucgga

SEQ ID NO: 45954 - RNA, 18 nt, Artificial Sequence
  Description of Artificial Sequence: Synthetic oligonucleotide
ucguugguacagaccccc

SEQ ID NO: 45955 - RNA, 18 nt, Artificial Sequence
  Description of Artificial Sequence: Synthetic oligonucleotide
uguuaucguugguacaga

SEQ ID NO: 45956 - RNA, 18 nt, Artificial Sequence
  Description of Artificial Sequence: Synthetic oligonucleotide
ugguauguuaucguuggu

SEQ ID NO: 45957 - RNA, 18 nt, Artificial Sequence
  Description of Artificial Sequence: Synthetic oligonucleotide
gcagauguucucaaugaa

SEQ ID NO: 45958 - RNA, 18 nt, Artificial Sequence
  Description of Artificial Sequence: Synthetic oligonucleotide
ggagggcagauguucuca

SEQ ID NO: 45959 - RNA, 18 nt, Artificial Sequence
  Description of Artificial Sequence: Synthetic oligonucleotide
ggcagggagggcagaugu

SEQ ID NO: 45960 - RNA, 18 nt, Artificial Sequence
  Description of Artificial Sequence: Synthetic oligonucleotide
cuuagggcagggagggca

SEQ ID NO: 45961 - RNA, 18 nt, Artificial Sequence
  Description of Artificial Sequence: Synthetic oligonucleotide
uugggcuuagggcaggga

SEQ ID NO: 45962 - RNA, 18 nt, Artificial Sequence
  Description of Artificial Sequence: Synthetic oligonucleotide
gagcauugggcuuagggc

SEQ ID NO: 45963 - RNA, 18 nt, Artificial Sequence
  Description of Artificial Sequence: Synthetic oligonucleotide
ggagagagcauugggcuu

SEQ ID NO: 45964 - RNA, 18 nt, Artificial Sequence
  Description of Artificial Sequence: Synthetic oligonucleotide
aaagaggagagagcauug

SEQ ID NO: 45965 - RNA, 18 nt, Artificial Sequence
  Description of Artificial Sequence: Synthetic oligonucleotide
gagguaaagaggagagag

SEQ ID NO: 45966 - RNA, 18 nt, Artificial Sequence
  Description of Artificial Sequence: Synthetic oligonucleotide
gggaggagguaaagagga

SEQ ID NO: 45967 - RNA, 18 nt, Artificial Sequence
  Description of Artificial Sequence: Synthetic oligonucleotide
agggugggaggagguaaa

SEQ ID NO: 45968 - RNA, 18 nt, Artificial Sequence
  Description of Artificial Sequence: Synthetic oligonucleotide
gagagagggugggaggag

SEQ ID NO: 45969 - RNA, 18 nt, Artificial Sequence
  Description of Artificial Sequence: Synthetic oligonucleotide
guggagagagaggguggg

SEQ ID NO: 45970 - RNA, 18 nt, Artificial Sequence
  Description of Artificial Sequence: Synthetic oligonucleotide
agacaguggagagagagg

SEQ ID NO: 45971 - RNA, 18 nt, Artificial Sequence
  Description of Artificial Sequence: Synthetic oligonucleotide
cuaagagacaguggagag

SEQ ID NO: 45972 - RNA, 18 nt, Artificial Sequence
  Description of Artificial Sequence: Synthetic oligonucleotide
acagacuaagagacagug

SEQ ID NO: 45973 - RNA, 18 nt, Artificial Sequence
  Description of Artificial Sequence: Synthetic oligonucleotide
aggacacagacuaagaga

SEQ ID NO: 45974 - RNA, 18 nt, Artificial Sequence
  Description of Artificial Sequence: Synthetic oligonucleotide
gggagaggacacagacua

SEQ ID NO: 45975 - RNA, 18 nt, Artificial Sequence
  Description of Artificial Sequence: Synthetic oligonucleotide
gagcagggagaggacaca

SEQ ID NO: 45976 - RNA, 18 nt, Artificial Sequence
  Description of Artificial Sequence: Synthetic oligonucleotide
auguggagcagggagagg

SEQ ID NO: 45977 - RNA, 18 nt, Artificial Sequence
  Description of Artificial Sequence: Synthetic oligonucleotide
gacaaauguggagcaggg

SEQ ID NO: 45978 - RNA, 18 nt, Artificial Sequence
  Description of Artificial Sequence: Synthetic oligonucleotide
aaggagacaaauguggag

SEQ ID NO: 45979 - RNA, 18 nt, Artificial Sequence
  Description of Artificial Sequence: Synthetic oligonucleotide
guacaaaggagacaaaug

SEQ ID NO: 45980 - RNA, 18 nt, Artificial Sequence
  Description of Artificial Sequence: Synthetic oligonucleotide
cccagguacaaaggagac

SEQ ID NO: 45981 - RNA, 18 nt, Artificial Sequence
  Description of Artificial Sequence: Synthetic oligonucleotide
guucccccagguacaaag

SEQ ID NO: 45982 - RNA, 18 nt, Artificial Sequence
  Description of Artificial Sequence: Synthetic oligonucleotide
ucucuguucccccaggua

SEQ ID NO: 45983 - RNA, 18 nt, Artificial Sequence
  Description of Artificial Sequence: Synthetic oligonucleotide
auuccucucuguuccccc

SEQ ID NO: 45984 - RNA, 18 nt, Artificial Sequence
  Description of Artificial Sequence: Synthetic oligonucleotide
agggcauuccucucuguu

SEQ ID NO: 45985 - RNA, 18 nt, Artificial Sequence
  Description of Artificial Sequence: Synthetic oligonucleotide
aagucagggcauuccucu

SEQ ID NO: 45986 - RNA, 18 nt, Artificial Sequence
  Description of Artificial Sequence: Synthetic oligonucleotide
aagaaaagucagggcauu

SEQ ID NO: 45987 - RNA, 18 nt, Artificial Sequence
  Description of Artificial Sequence: Synthetic oligonucleotide
agucaaagaaaagucagg

SEQ ID NO: 45988 - RNA, 18 nt, Artificial Sequence
  Description of Artificial Sequence: Synthetic oligonucleotide
cagacagucaaagaaaag

SEQ ID NO: 45989 - RNA, 18 nt, Artificial Sequence
  Description of Artificial Sequence: Synthetic oligonucleotide
uuuuccagacagucaaag

SEQ ID NO: 45990 - RNA, 18 nt, Artificial Sequence
  Description of Artificial Sequence: Synthetic oligonucleotide
ucccauuuuccagacagu

SEQ ID NO: 45991 - RNA, 18 nt, Artificial Sequence
  Description of Artificial Sequence: Synthetic oligonucleotide
uugacucccauuuuccag

SEQ ID NO: 45992 - RNA, 18 nt, Artificial Sequence
  Description of Artificial Sequence: Synthetic oligonucleotide
cacacuugacucccauuu

SEQ ID NO: 45993 - RNA, 18 nt, Artificial Sequence
  Description of Artificial Sequence: Synthetic oligonucleotide
cuccccacacuugacucc

SEQ ID NO: 45994 - RNA, 18 nt, Artificial Sequence
  Description of Artificial Sequence: Synthetic oligonucleotide
aaugacuccccacacuug

SEQ ID NO: 45995 - RNA, 18 nt, Artificial Sequence
  Description of Artificial Sequence: Synthetic oligonucleotide
aagugaaugacuccccac

SEQ ID NO: 45996 - RNA, 18 nt, Artificial Sequence
  Description of Artificial Sequence: Synthetic oligonucleotide
aaaugaagugaaugacuc

SEQ ID NO: 45997 - RNA, 18 nt, Artificial Sequence
  Description of Artificial Sequence: Synthetic oligonucleotide
caugcaaaugaagugaau

SEQ ID NO: 45998 - RNA, 18 nt, Artificial Sequence
  Description of Artificial Sequence: Synthetic oligonucleotide
ugcagcaugcaaaugaag

SEQ ID NO: 45999 - RNA, 18 nt, Artificial Sequence
  Description of Artificial Sequence: Synthetic oligonucleotide
uguuuugcagcaugcaaa

SEQ ID NO: 46000 - RNA, 18 nt, Artificial Sequence
  Description of Artificial Sequence: Synthetic oligonucleotide
cccucuguuuugcagcau

SEQ ID NO: 46001 - RNA, 18 nt, Artificial Sequence
  Description of Artificial Sequence: Synthetic oligonucleotide
cuccgcccucuguuuugc

SEQ ID NO: 46002 - RNA, 18 nt, Artificial Sequence
  Description of Artificial Sequence: Synthetic oligonucleotide
ggugccuccgcccucugu

SEQ ID NO: 46003 - RNA, 18 nt, Artificial Sequence
  Description of Artificial Sequence: Synthetic oligonucleotide
ucccuggugccuccgccc

SEQ ID NO: 46004 - RNA, 18 nt, Artificial Sequence
  Description of Artificial Sequence: Synthetic oligonucleotide
gccuuucccuggugccuc

SEQ ID NO: 46005 - RNA, 18 nt, Artificial Sequence
  Description of Artificial Sequence: Synthetic oligonucleotide
caagugccuuucccuggu

SEQ ID NO: 46006 - RNA, 18 nt, Artificial Sequence
  Description of Artificial Sequence: Synthetic oligonucleotide
ucauucaagugccuuucc

SEQ ID NO: 46007 - RNA, 18 nt, Artificial Sequence
  Description of Artificial Sequence: Synthetic oligonucleotide
cuucuucauucaagugcc

SEQ ID NO: 46008 - RNA, 18 nt, Artificial Sequence
  Description of Artificial Sequence: Synthetic oligonucleotide
uuuuccuucuucauucaa

SEQ ID NO: 46009 - RNA, 18 nt, Artificial Sequence
  Description of Artificial Sequence: Synthetic oligonucleotide
ucucauuuuccuucuuca

SEQ ID NO: 46010 - RNA, 18 nt, Artificial Sequence
  Description of Artificial Sequence: Synthetic oligonucleotide
cugguucucauuuuccuu

SEQ ID NO: 46011 - RNA, 18 nt, Artificial Sequence
  Description of Artificial Sequence: Synthetic oligonucleotide
acaaucugguucucauuu

SEQ ID NO: 46012 - RNA, 18 nt, Artificial Sequence
  Description of Artificial Sequence: Synthetic oligonucleotide
aaguuacaaucugguucu

SEQ ID NO: 46013 - RNA, 18 nt, Artificial Sequence
  Description of Artificial Sequence: Synthetic oligonucleotide
ggacgaaguuacaaucug

SEQ ID NO: 46014 - RNA, 18 nt, Artificial Sequence
  Description of Artificial Sequence: Synthetic oligonucleotide
gauuaggacgaaguuaca

SEQ ID NO: 46015 - RNA, 18 nt, Artificial Sequence
  Description of Artificial Sequence: Synthetic oligonucleotide
agguggauuaggacgaag

SEQ ID NO: 46016 - RNA, 18 nt, Artificial Sequence
  Description of Artificial Sequence: Synthetic oligonucleotide
cuggcagguggauuagga

SEQ ID NO: 46017 - RNA, 18 nt, Artificial Sequence
  Description of Artificial Sequence: Synthetic oligonucleotide
aaguucuggcagguggau

SEQ ID NO: 46018 - RNA, 18 nt, Artificial Sequence
  Description of Artificial Sequence: Synthetic oligonucleotide
aaggaaaguucuggcagg

SEQ ID NO: 46019 - RNA, 18 nt, Artificial Sequence
  Description of Artificial Sequence: Synthetic oligonucleotide
accugaaggaaaguucug

SEQ ID NO: 46020 - RNA, 18 nt, Artificial Sequence
  Description of Artificial Sequence: Synthetic oligonucleotide
gugacaccugaaggaaag

SEQ ID NO: 46021 - RNA, 18 nt, Artificial Sequence
  Description of Artificial Sequence: Synthetic oligonucleotide
gaugugugacaccugaag

SEQ ID NO: 46022 - RNA, 18 nt, Artificial Sequence
  Description of Artificial Sequence: Synthetic oligonucleotide
aaauggaugugugacacc

SEQ ID NO: 46023 - RNA, 18 nt, Artificial Sequence
  Description of Artificial Sequence: Synthetic oligonucleotide
gauggaaauggaugugug

SEQ ID NO: 46024 - RNA, 18 nt, Artificial Sequence
  Description of Artificial Sequence: Synthetic oligonucleotide
auuaggauggaaauggau

SEQ ID NO: 46025 - RNA, 18 nt, Artificial Sequence
  Description of Artificial Sequence: Synthetic oligonucleotide
uuaauauuaggauggaaa

SEQ ID NO: 46026 - RNA, 18 nt, Artificial Sequence
  Description of Artificial Sequence: Synthetic oligonucleotide
auuguuuaauauuaggau

SEQ ID NO: 46027 - RNA, 18 nt, Artificial Sequence
  Description of Artificial Sequence: Synthetic oligonucleotide
auuauauuguuuaauauu

SEQ ID NO: 46028 - RNA, 18 nt, Artificial Sequence
  Description of Artificial Sequence: Synthetic oligonucleotide
cuuucauuauauuguuua

SEQ ID NO: 46029 - RNA, 18 nt, Artificial Sequence
  Description of Artificial Sequence: Synthetic oligonucleotide
gcuuucuuucauuauauu

SEQ ID NO: 46030 - RNA, 18 nt, Artificial Sequence
  Description of Artificial Sequence: Synthetic oligonucleotide
gaugugugacaccugaag

SEQ ID NO: 46031 - RNA, 18 nt, Artificial Sequence
  Description of Artificial Sequence: Synthetic oligonucleotide
aaauggaugugugacacc

SEQ ID NO: 46032 - RNA, 18 nt, Artificial Sequence
  Description of Artificial Sequence: Synthetic oligonucleotide
gauggaaauggaugugug

SEQ ID NO: 46033 - RNA, 18 nt, Artificial Sequence
  Description of Artificial Sequence: Synthetic oligonucleotide
auuaggauggaaauggau

SEQ ID NO: 46034 - RNA, 18 nt, Artificial Sequence
  Description of Artificial Sequence: Synthetic oligonucleotide
uuaauauuaggauggaaa

SEQ ID NO: 46035 - RNA, 18 nt, Artificial Sequence
  Description of Artificial Sequence: Synthetic oligonucleotide
auuguuuaauauuaggau

SEQ ID NO: 46036 - RNA, 18 nt, Artificial Sequence
  Description of Artificial Sequence: Synthetic oligonucleotide
auuauauuguuuaauauu

SEQ ID NO: 46037 - RNA, 18 nt, Artificial Sequence
  Description of Artificial Sequence: Synthetic oligonucleotide
cuuucauuauauuguuua

SEQ ID NO: 46038 - RNA, 18 nt, Artificial Sequence
  Description of Artificial Sequence: Synthetic oligonucleotide
gcuuucuuucauuauauu

SEQ ID NO: 46039 - RNA, 18 nt, Artificial Sequence
  Description of Artificial Sequence: Synthetic oligonucleotide
guaaagcuuucuuucauu

SEQ ID NO: 46040 - RNA, 18 nt, Artificial Sequence
  Description of Artificial Sequence: Synthetic oligonucleotide
uuguuguaaagcuuucuu

SEQ ID NO: 46041 - RNA, 18 nt, Artificial Sequence
  Description of Artificial Sequence: Synthetic oligonucleotide
uagacuuguuguaaagcu

SEQ ID NO: 46042 - RNA, 18 nt, Artificial Sequence
  Description of Artificial Sequence: Synthetic oligonucleotide
cuauuuagacuuguugua

SEQ ID NO: 46043 - RNA, 18 nt, Artificial Sequence
  Description of Artificial Sequence: Synthetic oligonucleotide
aaaaacuauuuagacuug

SEQ ID NO: 46044 - RNA, 18 nt, Artificial Sequence
  Description of Artificial Sequence: Synthetic oligonucleotide
aaaauaaaaacuauuuag

SEQ ID NO: 46045 - RNA, 18 nt, Artificial Sequence
  Description of Artificial Sequence: Synthetic oligonucleotide
gcccgaaaauaaaaacua

SEQ ID NO: 46046 - RNA, 18 nt, Artificial Sequence
  Description of Artificial Sequence: Synthetic oligonucleotide
agacugcccgaaaauaaa

SEQ ID NO: 46047 - RNA, 18 nt, Artificial Sequence
  Description of Artificial Sequence: Synthetic oligonucleotide
uuaaaagacugcccgaaa

SEQ ID NO: 46048 - RNA, 18 nt, Artificial Sequence
  Description of Artificial Sequence: Synthetic oligonucleotide
cuuuguuaaaagacugcc

SEQ ID NO: 46049 - RNA, 18 nt, Artificial Sequence
  Description of Artificial Sequence: Synthetic oligonucleotide
cuuugcuuuguuaaaaga

SEQ ID NO: 46050 - RNA, 18 nt, Artificial Sequence
  Description of Artificial Sequence: Synthetic oligonucleotide
gguugcuuugcuuuguua

SEQ ID NO: 46051 - RNA, 18 nt, Artificial Sequence
  Description of Artificial Sequence: Synthetic oligonucleotide
cacacgguugcuuugcuu

SEQ ID NO: 46052 - RNA, 18 nt, Artificial Sequence
  Description of Artificial Sequence: Synthetic oligonucleotide
uaacucacacgguugcuu

SEQ ID NO: 46053 - RNA, 18 nt, Artificial Sequence
  Description of Artificial Sequence: Synthetic oligonucleotide
ugaccuaacucacacggu

SEQ ID NO: 46054 - RNA, 18 nt, Artificial Sequence
  Description of Artificial Sequence: Synthetic oligonucleotide
ucuggugaccuaacucac

SEQ ID NO: 46055 - RNA, 18 nt, Artificial Sequence
  Description of Artificial Sequence: Synthetic oligonucleotide
gugucucuggugaccuaa

SEQ ID NO: 46056 - RNA, 18 nt, Artificial Sequence
  Description of Artificial Sequence: Synthetic oligonucleotide
gcuuggugucucugguga

SEQ ID NO: 46057 - RNA, 18 nt, Artificial Sequence
  Description of Artificial Sequence: Synthetic oligonucleotide
ccauugcuuggugucucu

SEQ ID NO: 46058 - RNA, 18 nt, Artificial Sequence
  Description of Artificial Sequence: Synthetic oligonucleotide
cuucaccauugcuuggug

SEQ ID NO: 46059 - RNA, 18 nt, Artificial Sequence
  Description of Artificial Sequence: Synthetic oligonucleotide
ggguccuucaccauugcu

SEQ ID NO: 46060 - RNA, 18 nt, Artificial Sequence
  Description of Artificial Sequence: Synthetic oligonucleotide
agagaauugggcggaggg

SEQ ID NO: 46061 - RNA, 18 nt, Artificial Sequence
  Description of Artificial Sequence: Synthetic oligonucleotide
ggauagagaauugggcgg

SEQ ID NO: 46062 - RNA, 18 nt, Artificial Sequence
  Description of Artificial Sequence: Synthetic oligonucleotide
uaguuggauagagaauug

SEQ ID NO: 46063 - RNA, 18 nt, Artificial Sequence
  Description of Artificial Sequence: Synthetic oligonucleotide
aaauuuaguuggauagag

SEQ ID NO: 46064 - RNA, 18 nt, Artificial Sequence
  Description of Artificial Sequence: Synthetic oligonucleotide
cauggaaauuuaguugga

SEQ ID NO: 46065 - RNA, 18 nt, Artificial Sequence
  Description of Artificial Sequence: Synthetic oligonucleotide
uugggcauggaaauuuag

SEQ ID NO: 46066 - RNA, 18 nt, Artificial Sequence
  Description of Artificial Sequence: Synthetic oligonucleotide
ucacuuugggcauggaaa

SEQ ID NO: 46067 - RNA, 18 nt, Artificial Sequence
  Description of Artificial Sequence: Synthetic oligonucleotide
agcuaucacuuugggcau

SEQ ID NO: 46068 - RNA, 18 nt, Artificial Sequence
  Description of Artificial Sequence: Synthetic oligonucleotide
augauagcuaucacuuug

SEQ ID NO: 46069 - RNA, 18 nt, Artificial Sequence
  Description of Artificial Sequence: Synthetic oligonucleotide
aaaaaaugauagcuauca

SEQ ID NO: 46070 - RNA, 18 nt, Artificial Sequence
  Description of Artificial Sequence: Synthetic oligonucleotide
cguggaaaaaaugauagc

SEQ ID NO: 46071 - RNA, 18 nt, Artificial Sequence
  Description of Artificial Sequence: Synthetic oligonucleotide
uacaccguggaaaaaaug

SEQ ID NO: 46072 - RNA, 18 nt, Artificial Sequence
  Description of Artificial Sequence: Synthetic oligonucleotide
gcagauacaccguggaaa

SEQ ID NO: 46073 - RNA, 18 nt, Artificial Sequence
  Description of Artificial Sequence: Synthetic oligonucleotide
gauuugcagauacaccgu

SEQ ID NO: 46074 - RNA, 18 nt, Artificial Sequence
  Description of Artificial Sequence: Synthetic oligonucleotide
ggguggauuugcagauac

SEQ ID NO: 46075 - RNA, 18 nt, Artificial Sequence
  Description of Artificial Sequence: Synthetic oligonucleotide
acaguggguggauuugca

SEQ ID NO: 46076 - RNA, 18 nt, Artificial Sequence
  Description of Artificial Sequence: Synthetic oligonucleotide
ccgggacaguggguggau

SEQ ID NO: 46077 - RNA, 18 nt, Artificial Sequence
  Description of Artificial Sequence: Synthetic oligonucleotide
ccaccccgggacaguggg

SEQ ID NO: 46078 - RNA, 18 nt, Artificial Sequence
  Description of Artificial Sequence: Synthetic oligonucleotide
cccagccaccccgggaca

SEQ ID NO: 46079 - RNA, 18 nt, Artificial Sequence
  Description of Artificial Sequence: Synthetic oligonucleotide
aagcucccagccaccccg

SEQ ID NO: 46080 - RNA, 18 nt, Artificial Sequence
  Description of Artificial Sequence: Synthetic oligonucleotide
uuaaaaagcucccagcca

SEQ ID NO: 46081 - RNA, 18 nt, Artificial Sequence
  Description of Artificial Sequence: Synthetic oligonucleotide
acccguuaaaaagcuccc

SEQ ID NO: 46082 - RNA, 18 nt, Artificial Sequence
  Description of Artificial Sequence: Synthetic oligonucleotide
ucucaacccguuaaaaag

SEQ ID NO: 46083 - RNA, 18 nt, Artificial Sequence
  Description of Artificial Sequence: Synthetic oligonucleotide
gcaacucucaacccguua

SEQ ID NO: 46084 - RNA, 18 nt, Artificial Sequence
  Description of Artificial Sequence: Synthetic oligonucleotide
aaaaagcaacucucaacc

SEQ ID NO: 46085 - RNA, 18 nt, Artificial Sequence
  Description of Artificial Sequence: Synthetic oligonucleotide
accuuaaaaagcaacucu

SEQ ID NO: 46086 - RNA, 18 nt, Artificial Sequence
  Description of Artificial Sequence: Synthetic oligonucleotide
ccacaaccuuaaaaagca

SEQ ID NO: 46087 - RNA, 18 nt, Artificial Sequence
  Description of Artificial Sequence: Synthetic oligonucleotide
cucacccacaaccuuaaa

SEQ ID NO: 46088 - RNA, 18 nt, Artificial Sequence
  Description of Artificial Sequence: Synthetic oligonucleotide
cucagcucacccacaacc

SEQ ID NO: 46089 - RNA, 18 nt, Artificial Sequence
  Description of Artificial Sequence: Synthetic oligonucleotide
cccaucucagcucaccca

SEQ ID NO: 46090 - RNA, 18 nt, Artificial Sequence
  Description of Artificial Sequence: Synthetic oligonucleotide
agucacccaucucagcuc

SEQ ID NO: 46091 - RNA, 18 nt, Artificial Sequence
  Description of Artificial Sequence: Synthetic oligonucleotide
gacacagucacccaucuc

SEQ ID NO: 46092 - RNA, 18 nt, Artificial Sequence
  Description of Artificial Sequence: Synthetic oligonucleotide
cugaagacacagucaccc

SEQ ID NO: 46093 - RNA, 18 nt, Artificial Sequence
  Description of Artificial Sequence: Synthetic oligonucleotide
gucuccugaagacacagu

SEQ ID NO: 46094 - RNA, 18 nt, Artificial Sequence
  Description of Artificial Sequence: Synthetic oligonucleotide
guagugucuccugaagac

SEQ ID NO: 46095 - RNA, 18 nt, Artificial Sequence
  Description of Artificial Sequence: Synthetic oligonucleotide
aaaugguagugucuccug

SEQ ID NO: 46096 - RNA, 18 nt, Artificial Sequence
  Description of Artificial Sequence: Synthetic oligonucleotide
aaaccaaaugguaguguc

SEQ ID NO: 46097 - RNA, 18 nt, Artificial Sequence
  Description of Artificial Sequence: Synthetic oligonucleotide
aaaucaaaccaaauggua

SEQ ID NO: 46098 - RNA, 18 nt, Artificial Sequence
  Description of Artificial Sequence: Synthetic oligonucleotide
cucuguuuauugaugaca

SEQ ID NO: 46099 - RNA, 18 nt, Artificial Sequence
  Description of Artificial Sequence: Synthetic oligonucleotide
aagaacucuguuuauuga

SEQ ID NO: 46100 - RNA, 18 nt, Artificial Sequence
  Description of Artificial Sequence: Synthetic oligonucleotide
uugcgaagaacucuguuu

SEQ ID NO: 46101 - RNA, 18 nt, Artificial Sequence
  Description of Artificial Sequence: Synthetic oligonucleotide
ccagguugcgaagaacuc

SEQ ID NO: 46102 - RNA, 18 nt, Artificial Sequence
  Description of Artificial Sequence: Synthetic oligonucleotide
gcuagccagguugcgaag

SEQ ID NO: 46103 - RNA, 18 nt, Artificial Sequence
  Description of Artificial Sequence: Synthetic oligonucleotide
uuuucgcuagccagguug

SEQ ID NO: 46104 - RNA, 18 nt, Artificial Sequence
  Description of Artificial Sequence: Synthetic oligonucleotide
guugcuuuucgcuagcca

SEQ ID NO: 46105 - RNA, 18 nt, Artificial Sequence
  Description of Artificial Sequence: Synthetic oligonucleotide
caucuguugcuuuucgcu

SEQ ID NO: 46106 - RNA, 18 nt, Artificial Sequence
  Description of Artificial Sequence: Synthetic oligonucleotide
gcgcccaucuguugcuuu

SEQ ID NO: 46107 - RNA, 18 nt, Artificial Sequence
  Description of Artificial Sequence: Synthetic oligonucleotide
cgucugcgcccaucuguu

SEQ ID NO: 46108 - RNA, 18 nt, Artificial Sequence
  Description of Artificial Sequence: Synthetic oligonucleotide
caugccgucugcgcccau

SEQ ID NO: 46109 - RNA, 18 nt, Artificial Sequence
  Description of Artificial Sequence: Synthetic oligonucleotide
ucauacaugccgucugcg

SEQ ID NO: 46110 - RNA, 18 nt, Artificial Sequence
  Description of Artificial Sequence: Synthetic oligonucleotide
guuuaucauacaugccgu

SEQ ID NO: 46111 - RNA, 18 nt, Artificial Sequence
  Description of Artificial Sequence: Synthetic oligonucleotide
ccuuaguuuaucauacau

SEQ ID NO: 46112 - RNA, 18 nt, Artificial Sequence
  Description of Artificial Sequence: Synthetic oligonucleotide
aacauccuuaguuuauca

SEQ ID NO: 46113 - RNA, 18 nt, Artificial Sequence
  Description of Artificial Sequence: Synthetic oligonucleotide
cguucaacauccuuaguu

SEQ ID NO: 46114 - RNA, 18 nt, Artificial Sequence
  Description of Artificial Sequence: Synthetic oligonucleotide
cugcccguucaacauccu

SEQ ID NO: 46115 - RNA, 18 nt, Artificial Sequence
  Description of Artificial Sequence: Synthetic oligonucleotide
ccggucugcccguucaac

SEQ ID NO: 46116 - RNA, 18 nt, Artificial Sequence
  Description of Artificial Sequence: Synthetic oligonucleotide
agcuuccggucugcccgu

SEQ ID NO: 46117 - RNA, 18 nt, Artificial Sequence
  Description of Artificial Sequence: Synthetic oligonucleotide
gccccagcuuccggucug

SEQ ID NO: 46118 - RNA, 18 nt, Artificial Sequence
  Description of Artificial Sequence: Synthetic oligonucleotide
cgggugccccagcuuccg

SEQ ID NO: 46119 - RNA, 18 nt, Artificial Sequence
  Description of Artificial Sequence: Synthetic oligonucleotide
cagggcgggugccccagc

SEQ ID NO: 46120 - RNA, 18 nt, Artificial Sequence
  Description of Artificial Sequence: Synthetic oligonucleotide
ccaaccagggcgggugcc

SEQ ID NO: 46121 - RNA, 18 nt, Artificial Sequence
  Description of Artificial Sequence: Synthetic oligonucleotide
ggauaccaaccagggcgg

SEQ ID NO: 46122 - RNA, 18 nt, Artificial Sequence
  Description of Artificial Sequence: Synthetic oligonucleotide
uccccggauaccaaccag

SEQ ID NO: 46123 - RNA, 18 nt, Artificial Sequence
  Description of Artificial Sequence: Synthetic oligonucleotide
cgaaguccccggauacca

SEQ ID NO: 46124 - RNA, 18 nt, Artificial Sequence
  Description of Artificial Sequence: Synthetic oligonucleotide
ggcaccgaaguccccgga

SEQ ID NO: 46125 - RNA, 18 nt, Artificial Sequence
  Description of Artificial Sequence: Synthetic oligonucleotide
gcccuggcaccgaagucc

SEQ ID NO: 46126 - RNA, 18 nt, Artificial Sequence
  Description of Artificial Sequence: Synthetic oligonucleotide
agguugcccuggcaccga

SEQ ID NO: 46127 - RNA, 18 nt, Artificial Sequence
  Description of Artificial Sequence: Synthetic oligonucleotide
ugcguagguugcccuggc

SEQ ID NO: 46128 - RNA, 18 nt, Artificial Sequence
  Description of Artificial Sequence: Synthetic oligonucleotide
gccgcgggauuccacggg

SEQ ID NO: 46129 - RNA, 18 nt, Artificial Sequence
  Description of Artificial Sequence: Synthetic oligonucleotide
augcuggcucuggcuggg

SEQ ID NO: 46130 - RNA, 18 nt, Artificial Sequence
  Description of Artificial Sequence: Synthetic oligonucleotide
ucugcaugcuggcucugg

SEQ ID NO: 46131 - RNA, 18 nt, Artificial Sequence
  Description of Artificial Sequence: Synthetic oligonucleotide
ccagaaagaccagaggca

SEQ ID NO: 46132 - RNA, 18 nt, Artificial Sequence
  Description of Artificial Sequence: Synthetic oligonucleotide
aagucccagaaagaccag

SEQ ID NO: 46133 - RNA, 18 nt, Artificial Sequence
  Description of Artificial Sequence: Synthetic oligonucleotide
gcccgaagucccagaaag

SEQ ID NO: 46134 - RNA, 18 nt, Artificial Sequence
  Description of Artificial Sequence: Synthetic oligonucleotide
cccgagcccgaaguccca

SEQ ID NO: 46135 - RNA, 18 nt, Artificial Sequence
  Description of Artificial Sequence: Synthetic oligonucleotide
cgcaccccgagcccgaag

SEQ ID NO: 46136 - RNA, 18 nt, Artificial Sequence
  Description of Artificial Sequence: Synthetic oligonucleotide
guccgcgcaccccgagcc

SEQ ID NO: 46137 - RNA, 18 nt, Artificial Sequence
  Description of Artificial Sequence: Synthetic oligonucleotide
cucggguccgcgcacccc

SEQ ID NO: 46138 - RNA, 18 nt, Artificial Sequence
  Description of Artificial Sequence: Synthetic oligonucleotide
ugacccucggguccgcgc

SEQ ID NO: 46139 - RNA, 18 nt, Artificial Sequence
  Description of Artificial Sequence: Synthetic oligonucleotide
uccccugacccucggguc

SEQ ID NO: 46140 - RNA, 18 nt, Artificial Sequence
  Description of Artificial Sequence: Synthetic oligonucleotide
uguccuccccugacccuc

SEQ ID NO: 46141 - RNA, 18 nt, Artificial Sequence
  Description of Artificial Sequence: Synthetic oligonucleotide
cccuguguccuccccuga

SEQ ID NO: 46142 - RNA, 18 nt, Artificial Sequence
  Description of Artificial Sequence: Synthetic oligonucleotide
cgagucccuguguccucc

SEQ ID NO: 46143 - RNA, 18 nt, Artificial Sequence
  Description of Artificial Sequence: Synthetic oligonucleotide
cgucgcgagucccugugu

SEQ ID NO: 46144 - RNA, 18 nt, Artificial Sequence
  Description of Artificial Sequence: Synthetic oligonucleotide
gcgggcgucgcgaguccc

SEQ ID NO: 46145 - RNA, 18 nt, Artificial Sequence
  Description of Artificial Sequence: Synthetic oligonucleotide
ccagcgcgggcgucgcga

SEQ ID NO: 46146 - RNA, 18 nt, Artificial Sequence
  Description of Artificial Sequence: Synthetic oligonucleotide
ccgggccagcgcgggcgu

SEQ ID NO: 46147 - RNA, 18 nt, Artificial Sequence
  Description of Artificial Sequence: Synthetic oligonucleotide
ggcggccgggccagcgcg

SEQ ID NO: 46148 - RNA, 18 nt, Artificial Sequence
  Description of Artificial Sequence: Synthetic oligonucleotide
cggucggcggccgggcca

SEQ ID NO: 46149 - RNA, 18 nt, Artificial Sequence
  Description of Artificial Sequence: Synthetic oligonucleotide
ucagucggucggcggccg

SEQ ID NO: 46150 - RNA, 18 nt, Artificial Sequence
  Description of Artificial Sequence: Synthetic oligonucleotide
gggccucagucggucggc

SEQ ID NO: 46151 - RNA, 18 nt, Artificial Sequence
  Description of Artificial Sequence: Synthetic oligonucleotide
uccccgggccucagucgg

SEQ ID NO: 46152 - RNA, 18 nt, Artificial Sequence
  Description of Artificial Sequence: Synthetic oligonucleotide
gcagguccccgggccuca

SEQ ID NO: 46153 - RNA, 18 nt, Artificial Sequence
  Description of Artificial Sequence: Synthetic oligonucleotide
ccgccgcagguccccggg

SEQ ID NO: 46154 - RNA, 18 nt, Artificial Sequence
  Description of Artificial Sequence: Synthetic oligonucleotide
agcagccgccgcaggucc

SEQ ID NO: 46155 - RNA, 18 nt, Artificial Sequence
  Description of Artificial Sequence: Synthetic oligonucleotide
gggagcagccgccgcagg

SEQ ID NO: 46156 - RNA, 18 nt, Artificial Sequence
  Description of Artificial Sequence: Synthetic oligonucleotide
ugccgggcgcggagcggg

SEQ ID NO: 46157 - RNA, 18 nt, Artificial Sequence
  Description of Artificial Sequence: Synthetic oligonucleotide
cgggcugccgggcgcgga

SEQ ID NO: 46158 - RNA, 18 nt, Artificial Sequence
  Description of Artificial Sequence: Synthetic oligonucleotide
ccucccgggcugccgggc

SEQ ID NO: 46159 - RNA, 18 nt, Artificial Sequence
  Description of Artificial Sequence: Synthetic oligonucleotide
ccuccccucccgggcugc

SEQ ID NO: 46160 - RNA, 18 nt, Artificial Sequence
  Description of Artificial Sequence: Synthetic oligonucleotide
aacgcccuccccucccgg

SEQ ID NO: 46161 - RNA, 18 nt, Artificial Sequence
  Description of Artificial Sequence: Synthetic oligonucleotide
aagcaaacgcccuccccu

SEQ ID NO: 46162 - RNA, 18 nt, Artificial Sequence
  Description of Artificial Sequence: Synthetic oligonucleotide
gagccaagcaaacgcccu

SEQ ID NO: 46163 - RNA, 18 nt, Artificial Sequence
  Description of Artificial Sequence: Synthetic oligonucleotide
gagaagagccaagcaaac

SEQ ID NO: 46164 - RNA, 18 nt, Artificial Sequence
  Description of Artificial Sequence: Synthetic oligonucleotide
guaucgagaagagccaag

SEQ ID NO: 46165 - RNA, 18 nt, Artificial Sequence
  Description of Artificial Sequence: Synthetic oligonucleotide
cuccaguaucgagaagag

SEQ ID NO: 46166 - RNA, 18 nt, Artificial Sequence
  Description of Artificial Sequence: Synthetic oligonucleotide
ugcuucuccaguaucgag

SEQ ID NO: 46167 - RNA, 18 nt, Artificial Sequence
  Description of Artificial Sequence: Synthetic oligonucleotide
gccccugcuucuccagua

SEQ ID NO: 46168 - RNA, 18 nt, Artificial Sequence
  Description of Artificial Sequence: Synthetic oligonucleotide
gcccagccccugcuucuc

SEQ ID NO: 46169 - RNA, 18 nt, Artificial Sequence
  Description of Artificial Sequence: Synthetic oligonucleotide
uaagggcccagccccugc

SEQ ID NO: 46170 - RNA, 18 nt, Artificial Sequence
  Description of Artificial Sequence: Synthetic oligonucleotide
guucuuaagggcccagcc

SEQ ID NO: 46171 - RNA, 18 nt, Artificial Sequence
  Description of Artificial Sequence: Synthetic oligonucleotide
gggcuguucuuaagggcc

SEQ ID NO: 46172 - RNA, 18 nt, Artificial Sequence
  Description of Artificial Sequence: Synthetic oligonucleotide
cgggcgggcuguucuuaa

SEQ ID NO: 46173 - RNA, 18 nt, Artificial Sequence
  Description of Artificial Sequence: Synthetic oligonucleotide
aaacucgggcgggcuguu

SEQ ID NO: 46174 - RNA, 18 nt, Artificial Sequence
  Description of Artificial Sequence: Synthetic oligonucleotide
uucgaaaacucgggcggg

SEQ ID NO: 46175 - RNA, 18 nt, Artificial Sequence
  Description of Artificial Sequence: Synthetic oligonucleotide
gcagcuucgaaaacucgg

SEQ ID NO: 46176 - RNA, 18 nt, Artificial Sequence
  Description of Artificial Sequence: Synthetic oligonucleotide
cuaccgcagcuucgaaaa

SEQ ID NO: 46177 - RNA, 18 nt, Artificial Sequence
  Description of Artificial Sequence: Synthetic oligonucleotide
uuucucuaccgcagcuuc

SEQ ID NO: 46178 - RNA, 18 nt, Artificial Sequence
  Description of Artificial Sequence: Synthetic oligonucleotide
ggguuucucuaccgcagc

SEQ ID NO: 46179 - RNA, 18 nt, Artificial Sequence
  Description of Artificial Sequence: Synthetic oligonucleotide
ugaguuacaggauuuggg

SEQ ID NO: 46180 - RNA, 18 nt, Artificial Sequence
  Description of Artificial Sequence: Synthetic oligonucleotide
gggugugaguuacaggau

SEQ ID NO: 46181 - RNA, 18 nt, Artificial Sequence
  Description of Artificial Sequence: Synthetic oligonucleotide
gggucagagcccgggcag

SEQ ID NO: 46182 - RNA, 18 nt, Artificial Sequence
  Description of Artificial Sequence: Synthetic oligonucleotide
ccagccccucucuccggg

SEQ ID NO: 46183 - RNA, 18 nt, Artificial Sequence
  Description of Artificial Sequence: Synthetic oligonucleotide
ucagcccagccccucucu

SEQ ID NO: 46184 - RNA, 18 nt, Artificial Sequence
  Description of Artificial Sequence: Synthetic oligonucleotide
ccugaucagcccagcccc

SEQ ID NO: 46185 - RNA, 18 nt, Artificial Sequence
  Description of Artificial Sequence: Synthetic oligonucleotide
cccgcccugaucagccca

SEQ ID NO: 46186 - RNA, 18 nt, Artificial Sequence
  Description of Artificial Sequence: Synthetic oligonucleotide
uucgccccgcccugauca

SEQ ID NO: 46187 - RNA, 18 nt, Artificial Sequence
  Description of Artificial Sequence: Synthetic oligonucleotide
aagacuucgccccgcccu

SEQ ID NO: 46188 - RNA, 18 nt, Artificial Sequence
  Description of Artificial Sequence: Synthetic oligonucleotide
aggagaagacuucgcccc

SEQ ID NO: 46189 - RNA, 18 nt, Artificial Sequence
  Description of Artificial Sequence: Synthetic oligonucleotide
caacuaggagaagacuuc

SEQ ID NO: 46190 - RNA, 18 nt, Artificial Sequence
  Description of Artificial Sequence: Synthetic oligonucleotide
ucgcucaacuaggagaag

SEQ ID NO: 46191 - RNA, 18 nt, Artificial Sequence
  Description of Artificial Sequence: Synthetic oligonucleotide
ccuucucgcucaacuagg

SEQ ID NO: 46192 - RNA, 18 nt, Artificial Sequence
  Description of Artificial Sequence: Synthetic oligonucleotide
ggccuccuucucgcucaa

SEQ ID NO: 46193 - RNA, 18 nt, Artificial Sequence
  Description of Artificial Sequence: Synthetic oligonucleotide
gggccuccuucucgcuca

SEQ ID NO: 46194 - RNA, 18 nt, Artificial Sequence
  Description of Artificial Sequence: Synthetic oligonucleotide
uuggcuaagcccaaaggg

SEQ ID NO: 46195 - RNA, 18 nt, Artificial Sequence
  Description of Artificial Sequence: Synthetic oligonucleotide
cagucuuggcuaagccca

SEQ ID NO: 46196 - RNA, 18 nt, Artificial Sequence
  Description of Artificial Sequence: Synthetic oligonucleotide
acuuucagucuuggcuaa

SEQ ID NO: 46197 - RNA, 18 nt, Artificial Sequence
  Description of Artificial Sequence: Synthetic oligonucleotide
uggagacuuucagucuug

SEQ ID NO: 46198 - RNA, 18 nt, Artificial Sequence
  Description of Artificial Sequence: Synthetic oligonucleotide
guugguggagacuuucag

SEQ ID NO: 46199 - RNA, 18 nt, Artificial Sequence
  Description of Artificial Sequence: Synthetic oligonucleotide
gccggguugguggagacu

SEQ ID NO: 46200 - RNA, 18 nt, Artificial Sequence
  Description of Artificial Sequence: Synthetic oligonucleotide
accccgccggguuggugg

SEQ ID NO: 46201 - RNA, 18 nt, Artificial Sequence
  Description of Artificial Sequence: Synthetic oligonucleotide
ccccaaccccgccggguu

SEQ ID NO: 46202 - RNA, 18 nt, Artificial Sequence
  Description of Artificial Sequence: Synthetic oligonucleotide
gaagcccccaaccccgcc

SEQ ID NO: 46203 - RNA, 18 nt, Artificial Sequence
  Description of Artificial Sequence: Synthetic oligonucleotide
ggagagaagcccccaacc

SEQ ID NO: 46204 - RNA, 18 nt, Artificial Sequence
  Description of Artificial Sequence: Synthetic oligonucleotide
gggagagaagcccccaac

SEQ ID NO: 46205 - RNA, 18 nt, Artificial Sequence
  Description of Artificial Sequence: Synthetic oligonucleotide
cccugagagugacuuggg

SEQ ID NO: 46206 - RNA, 18 nt, Artificial Sequence
  Description of Artificial Sequence: Synthetic oligonucleotide
agcugcccugagagugac

SEQ ID NO: 46207 - RNA, 18 nt, Artificial Sequence
  Description of Artificial Sequence: Synthetic oligonucleotide
ggaggagcugcccugaga

SEQ ID NO: 46208 - RNA, 18 nt, Artificial Sequence
  Description of Artificial Sequence: Synthetic oligonucleotide
gggaggagcugcccugag

SEQ ID NO: 46209 - RNA, 18 nt, Artificial Sequence
  Description of Artificial Sequence: Synthetic oligonucleotide
uucuaggcccguaguggg

SEQ ID NO: 46210 - RNA, 18 nt, Artificial Sequence
  Description of Artificial Sequence: Synthetic oligonucleotide
aucccuucuaggcccgua

SEQ ID NO: 46211 - RNA, 18 nt, Artificial Sequence
  Description of Artificial Sequence: Synthetic oligonucleotide
uccccaucccuucuaggc

SEQ ID NO: 46212 - RNA, 18 nt, Artificial Sequence
  Description of Artificial Sequence: Synthetic oligonucleotide
uggguucuacagauccca

SEQ ID NO: 46213 - RNA, 18 nt, Artificial Sequence
  Description of Artificial Sequence: Synthetic oligonucleotide
aaccauggguucuacaga

SEQ ID NO: 46214 - RNA, 18 nt, Artificial Sequence
  Description of Artificial Sequence: Synthetic oligonucleotide
ccgcaaaccauggguucu

SEQ ID NO: 46215 - RNA, 18 nt, Artificial Sequence
  Description of Artificial Sequence: Synthetic oligonucleotide
ugucaccgcaaaccaugg

SEQ ID NO: 46216 - RNA, 18 nt, Artificial Sequence
  Description of Artificial Sequence: Synthetic oligonucleotide
cugagugucaccgcaaac

SEQ ID NO: 46217 - RNA, 18 nt, Artificial Sequence
  Description of Artificial Sequence: Synthetic oligonucleotide
ccccucugagugucaccg

SEQ ID NO: 46218 - RNA, 18 nt, Artificial Sequence
  Description of Artificial Sequence: Synthetic oligonucleotide
aagauccccucugagugu

SEQ ID NO: 46219 - RNA, 18 nt, Artificial Sequence
  Description of Artificial Sequence: Synthetic oligonucleotide
ucccaaagauccccucug

SEQ ID NO: 46220 - RNA, 18 nt, Artificial Sequence
  Description of Artificial Sequence: Synthetic oligonucleotide
aaaucucccaaagauccc

SEQ ID NO: 46221 - RNA, 18 nt, Artificial Sequence
  Description of Artificial Sequence: Synthetic oligonucleotide
ucuauaaaucucccaaag

SEQ ID NO: 46222 - RNA, 18 nt, Artificial Sequence
  Description of Artificial Sequence: Synthetic oligonucleotide
ccggcucuauaaaucucc

SEQ ID NO: 46223 - RNA, 18 nt, Artificial Sequence
  Description of Artificial Sequence: Synthetic oligonucleotide
aagaaccggcucuauaaa

SEQ ID NO: 46224 - RNA, 18 nt, Artificial Sequence
  Description of Artificial Sequence: Synthetic oligonucleotide
gcgcuaagaaccggcucu

SEQ ID NO: 46225 - RNA, 18 nt, Artificial Sequence
  Description of Artificial Sequence: Synthetic oligonucleotide
acaaagcgcuaagaaccg

SEQ ID NO: 46226 - RNA, 18 nt, Artificial Sequence
  Description of Artificial Sequence: Synthetic oligonucleotide
aacccacaaagcgcuaag

SEQ ID NO: 46227 - RNA, 18 nt, Artificial Sequence
  Description of Artificial Sequence: Synthetic oligonucleotide
cucugaacccacaaagcg

SEQ ID NO: 46228 - RNA, 18 nt, Artificial Sequence
  Description of Artificial Sequence: Synthetic oligonucleotide
ccagccucugaacccaca

SEQ ID NO: 46229 - RNA, 18 nt, Artificial Sequence
  Description of Artificial Sequence: Synthetic oligonucleotide
ugcagccagccucugaac

SEQ ID NO: 46230 - RNA, 18 nt, Artificial Sequence
  Description of Artificial Sequence: Synthetic oligonucleotide
aacacugcagccagccuc

SEQ ID NO: 46231 - RNA, 18 nt, Artificial Sequence
  Description of Artificial Sequence: Synthetic oligonucleotide
ucauaaacacugcagcca

SEQ ID NO: 46232 - RNA, 18 nt, Artificial Sequence
  Description of Artificial Sequence: Synthetic oligonucleotide
ccucuucauaaacacugc

SEQ ID NO: 46233 - RNA, 18 nt, Artificial Sequence
  Description of Artificial Sequence: Synthetic oligonucleotide
cugccccucuucauaaac

SEQ ID NO: 46234 - RNA, 18 nt, Artificial Sequence
  Description of Artificial Sequence: Synthetic oligonucleotide
gcccacugccccucuuca

SEQ ID NO: 46235 - RNA, 18 nt, Artificial Sequence
  Description of Artificial Sequence: Synthetic oligonucleotide
ccccagcccacugccccu

SEQ ID NO: 46236 - RNA, 18 nt, Artificial Sequence
  Description of Artificial Sequence: Synthetic oligonucleotide
aguguccccagcccacug

SEQ ID NO: 46237 - RNA, 18 nt, Artificial Sequence
  Description of Artificial Sequence: Synthetic oligonucleotide
ccagcaguguccccagcc

SEQ ID NO: 46238 - RNA, 18 nt, Artificial Sequence
  Description of Artificial Sequence: Synthetic oligonucleotide
uaaccccagcaguguccc

SEQ ID NO: 46239 - RNA, 18 nt, Artificial Sequence
  Description of Artificial Sequence: Synthetic oligonucleotide
agccauaaccccagcagu

SEQ ID NO: 46240 - RNA, 18 nt, Artificial Sequence
  Description of Artificial Sequence: Synthetic oligonucleotide
acuacagccauaacccca

SEQ ID NO: 46241 - RNA, 18 nt, Artificial Sequence
  Description of Artificial Sequence: Synthetic oligonucleotide
accucacuacagccauaa

SEQ ID NO: 46242 - RNA, 18 nt, Artificial Sequence
  Description of Artificial Sequence: Synthetic oligonucleotide
cauggaccucacuacagc

SEQ ID NO: 46243 - RNA, 18 nt, Artificial Sequence
  Description of Artificial Sequence: Synthetic oligonucleotide
guacacauggaccucacu

SEQ ID NO: 46244 - RNA, 18 nt, Artificial Sequence
  Description of Artificial Sequence: Synthetic oligonucleotide
aacaaguacacauggacc

SEQ ID NO: 46245 - RNA, 18 nt, Artificial Sequence
  Description of Artificial Sequence: Synthetic oligonucleotide
caaggaacaaguacacau

SEQ ID NO: 46246 - RNA, 18 nt, Artificial Sequence
  Description of Artificial Sequence: Synthetic oligonucleotide
caugccaaggaacaagua

SEQ ID NO: 46247 - RNA, 18 nt, Artificial Sequence
  Description of Artificial Sequence: Synthetic oligonucleotide
agacacaugccaaggaac

SEQ ID NO: 46248 - RNA, 18 nt, Artificial Sequence
  Description of Artificial Sequence: Synthetic oligonucleotide
gagucagacacaugccaa

SEQ ID NO: 46249 - RNA, 18 nt, Artificial Sequence
  Description of Artificial Sequence: Synthetic oligonucleotide
acacagagucagacacau

SEQ ID NO: 46250 - RNA, 18 nt, Artificial Sequence
  Description of Artificial Sequence: Synthetic oligonucleotide
cagcaacacagagucaga

SEQ ID NO: 46251 - RNA, 18 nt, Artificial Sequence
  Description of Artificial Sequence: Synthetic oligonucleotide
ugcagcagcaacacagag

SEQ ID NO: 46252 - RNA, 18 nt, Artificial Sequence
  Description of Artificial Sequence: Synthetic oligonucleotide
uguacugcagcagcaaca

SEQ ID NO: 46253 - RNA, 18 nt, Artificial Sequence
  Description of Artificial Sequence: Synthetic oligonucleotide
cccacuguacugcagcag

SEQ ID NO: 46254 - RNA, 18 nt, Artificial Sequence
  Description of Artificial Sequence: Synthetic oligonucleotide
cccugcccacuguacugc

SEQ ID NO: 46255 - RNA, 18 nt, Artificial Sequence
  Description of Artificial Sequence: Synthetic oligonucleotide
cgugccccugcccacugu

SEQ ID NO: 46256 - RNA, 18 nt, Artificial Sequence
  Description of Artificial Sequence: Synthetic oligonucleotide
gcaaccgugccccugccc

SEQ ID NO: 46257 - RNA, 18 nt, Artificial Sequence
  Description of Artificial Sequence: Synthetic oligonucleotide
uccaagcaaccgugcccc

SEQ ID NO: 46258 - RNA, 18 nt, Artificial Sequence
  Description of Artificial Sequence: Synthetic oligonucleotide
cccaguccaagcaaccgu

SEQ ID NO: 46259 - RNA, 18 nt, Artificial Sequence
  Description of Artificial Sequence: Synthetic oligonucleotide
ggcagcccaguccaagca

SEQ ID NO: 46260 - RNA, 18 nt, Artificial Sequence
  Description of Artificial Sequence: Synthetic oligonucleotide
caucgggcagcccagucc

SEQ ID NO: 46261 - RNA, 18 nt, Artificial Sequence
  Description of Artificial Sequence: Synthetic oligonucleotide
ccagacaucgggcagccc

SEQ ID NO: 46262 - RNA, 18 nt, Artificial Sequence
  Description of Artificial Sequence: Synthetic oligonucleotide
ccaugccagacaucgggc

SEQ ID NO: 46263 - RNA, 18 nt, Artificial Sequence
  Description of Artificial Sequence: Synthetic oligonucleotide
accagccaugccagacau

SEQ ID NO: 46264 - RNA, 18 nt, Artificial Sequence
  Description of Artificial Sequence: Synthetic oligonucleotide
ggaccaccagccaugcca

SEQ ID NO: 46265 - RNA, 18 nt, Artificial Sequence
  Description of Artificial Sequence: Synthetic oligonucleotide
caacaggaccaccagcca

SEQ ID NO: 46266 - RNA, 18 nt, Artificial Sequence
  Description of Artificial Sequence: Synthetic oligonucleotide
aaggacaacaggaccacc

SEQ ID NO: 46267 - RNA, 18 nt, Artificial Sequence
  Description of Artificial Sequence: Synthetic oligonucleotide
aaauaaaggacaacagga

SEQ ID NO: 46268 - RNA, 18 nt, Artificial Sequence
  Description of Artificial Sequence: Synthetic oligonucleotide
cgaucaaauaaaggacaa

SEQ ID NO: 46269 - RNA, 18 nt, Artificial Sequence
  Description of Artificial Sequence: Synthetic oligonucleotide
gcuaucgaucaaauaaag

SEQ ID NO: 46270 - RNA, 18 nt, Artificial Sequence
  Description of Artificial Sequence: Synthetic oligonucleotide
ucccugcuaucgaucaaa

SEQ ID NO: 46271 - RNA, 18 nt, Artificial Sequence
  Description of Artificial Sequence: Synthetic oligonucleotide
ucaguucccugcuaucga

SEQ ID NO: 46272 - RNA, 18 nt, Artificial Sequence
  Description of Artificial Sequence: Synthetic oligonucleotide
ggcggucaguucccugcu

SEQ ID NO: 46273 - RNA, 18 nt, Artificial Sequence
  Description of Artificial Sequence: Synthetic oligonucleotide
accucggcggucaguucc

SEQ ID NO: 46274 - RNA, 18 nt, Artificial Sequence
  Description of Artificial Sequence: Synthetic oligonucleotide
ugccaaccucggcgguca

SEQ ID NO: 46275 - RNA, 18 nt, Artificial Sequence
  Description of Artificial Sequence: Synthetic oligonucleotide
accugugccaaccucggc

SEQ ID NO: 46276 - RNA, 18 nt, Artificial Sequence
  Description of Artificial Sequence: Synthetic oligonucleotide
ugccaaccugugccaacc

SEQ ID NO: 46277 - RNA, 18 nt, Artificial Sequence
  Description of Artificial Sequence: Synthetic oligonucleotide
cccccugccaaccugugc

SEQ ID NO: 46278 - RNA, 18 nt, Artificial Sequence
  Description of Artificial Sequence: Synthetic oligonucleotide
cucaucccccugccaacc

SEQ ID NO: 46279 - RNA, 18 nt, Artificial Sequence
  Description of Artificial Sequence: Synthetic oligonucleotide
gcauccucaucccccugc

SEQ ID NO: 46280 - RNA, 18 nt, Artificial Sequence
  Description of Artificial Sequence: Synthetic oligonucleotide
acaaugcauccucauccc

SEQ ID NO: 46281 - RNA, 18 nt, Artificial Sequence
  Description of Artificial Sequence: Synthetic oligonucleotide
caaccacaaugcauccuc

SEQ ID NO: 46282 - RNA, 18 nt, Artificial Sequence
  Description of Artificial Sequence: Synthetic oligonucleotide
ggagacaaccacaaugca

SEQ ID NO: 46283 - RNA, 18 nt, Artificial Sequence
  Description of Artificial Sequence: Synthetic oligonucleotide
gaggaggagacaaccaca

SEQ ID NO: 46284 - RNA, 18 nt, Artificial Sequence
  Description of Artificial Sequence: Synthetic oligonucleotide
gagaggaggaggagacaa

SEQ ID NO: 46285 - RNA, 18 nt, Artificial Sequence
  Description of Artificial Sequence: Synthetic oligonucleotide
agaaggagaggaggagga

SEQ ID NO: 46286 - RNA, 18 nt, Artificial Sequence
  Description of Artificial Sequence: Synthetic oligonucleotide
gaggaagaaggagaggag

SEQ ID NO: 46287 - RNA, 18 nt, Artificial Sequence
  Description of Artificial Sequence: Synthetic oligonucleotide
gggaagaggaagaaggag

SEQ ID NO: 46288 - RNA, 18 nt, Artificial Sequence
  Description of Artificial Sequence: Synthetic oligonucleotide
aaaggagaggaggaaggg

SEQ ID NO: 46289 - RNA, 18 nt, Artificial Sequence
  Description of Artificial Sequence: Synthetic oligonucleotide
agaaaggagaggaggaag

SEQ ID NO: 46290 - RNA, 18 nt, Artificial Sequence
  Description of Artificial Sequence: Synthetic oligonucleotide
agaacagaaaggagagga

SEQ ID NO: 46291 - RNA, 18 nt, Artificial Sequence
  Description of Artificial Sequence: Synthetic oligonucleotide
gaacaagaacagaaagga

SEQ ID NO: 46292 - RNA, 18 nt, Artificial Sequence
  Description of Artificial Sequence: Synthetic oligonucleotide
agggagaacaagaacaga

SEQ ID NO: 46293 - RNA, 18 nt, Artificial Sequence
  Description of Artificial Sequence: Synthetic oligonucleotide
agaugagggagaacaaga

SEQ ID NO: 46294 - RNA, 18 nt, Artificial Sequence
  Description of Artificial Sequence: Synthetic oligonucleotide
gaggaagaugagggagaa

SEQ ID NO: 46295 - RNA, 18 nt, Artificial Sequence
  Description of Artificial Sequence: Synthetic oligonucleotide
aggaagaggaagaugagg

SEQ ID NO: 46296 - RNA, 18 nt, Artificial Sequence
  Description of Artificial Sequence: Synthetic oligonucleotide
gaagaaggaagaggaaga

SEQ ID NO: 46297 - RNA, 18 nt, Artificial Sequence
  Description of Artificial Sequence: Synthetic oligonucleotide
agggagaagaaggaagag

SEQ ID NO: 46298 - RNA, 18 nt, Artificial Sequence
  Description of Artificial Sequence: Synthetic oligonucleotide
agaagagggagaagaagg

SEQ ID NO: 46299 - RNA, 18 nt, Artificial Sequence
  Description of Artificial Sequence: Synthetic oligonucleotide
gaggaagaagagggagaa

SEQ ID NO: 46300 - RNA, 18 nt, Artificial Sequence
  Description of Artificial Sequence: Synthetic oligonucleotide
gugaagaggaagaagagg

SEQ ID NO: 46301 - RNA, 18 nt, Artificial Sequence
  Description of Artificial Sequence: Synthetic oligonucleotide
gcagagugaagaggaaga

SEQ ID NO: 46302 - RNA, 18 nt, Artificial Sequence
  Description of Artificial Sequence: Synthetic oligonucleotide
agagagcagagugaagag

SEQ ID NO: 46303 - RNA, 18 nt, Artificial Sequence
  Description of Artificial Sequence: Synthetic oligonucleotide
agagaagagagcagagug

SEQ ID NO: 46304 - RNA, 18 nt, Artificial Sequence
  Description of Artificial Sequence: Synthetic oligonucleotide
aaagaagagaagagagca

SEQ ID NO: 46305 - RNA, 18 nt, Artificial Sequence
  Description of Artificial Sequence: Synthetic oligonucleotide
ugauucacuccgcuguga

SEQ ID NO: 46306 - RNA, 18 nt, Artificial Sequence
  Description of Artificial Sequence: Synthetic oligonucleotide
cgagcugauucacuccgc

SEQ ID NO: 46307 - RNA, 18 nt, Artificial Sequence
  Description of Artificial Sequence: Synthetic oligonucleotide
accaccgagcugauucac

SEQ ID NO: 46308 - RNA, 18 nt, Artificial Sequence
  Description of Artificial Sequence: Synthetic oligonucleotide
aagacaccaccgagcuga

SEQ ID NO: 46309 - RNA, 18 nt, Artificial Sequence
  Description of Artificial Sequence: Synthetic oligonucleotide
ugacaaagacaccaccga

SEQ ID NO: 46310 - RNA, 18 nt, Artificial Sequence
  Description of Artificial Sequence: Synthetic oligonucleotide
cccguugacaaagacacc

SEQ ID NO: 46311 - RNA, 18 nt, Artificial Sequence
  Description of Artificial Sequence: Synthetic oligonucleotide
ggccgcccguugacaaag

SEQ ID NO: 46312 - RNA, 18 nt, Artificial Sequence
  Description of Artificial Sequence: Synthetic oligonucleotide
gcaguggccgcccguuga

SEQ ID NO: 46313 - RNA, 18 nt, Artificial Sequence
  Description of Artificial Sequence: Synthetic oligonucleotide
guccggcaguggccgccc

SEQ ID NO: 46314 - RNA, 18 nt, Artificial Sequence
  Description of Artificial Sequence: Synthetic oligonucleotide
guggaguccggcaguggc

SEQ ID NO: 46315 - RNA, 18 nt, Artificial Sequence
  Description of Artificial Sequence: Synthetic oligonucleotide
gccggguggaguccggca

SEQ ID NO: 46316 - RNA, 18 nt, Artificial Sequence
  Description of Artificial Sequence: Synthetic oligonucleotide
cuucugccggguggaguc

SEQ ID NO: 46317 - RNA, 18 nt, Artificial Sequence
  Description of Artificial Sequence: Synthetic oligonucleotide
acaaucuucugccgggug

SEQ ID NO: 46318 - RNA, 18 nt, Artificial Sequence
  Description of Artificial Sequence: Synthetic oligonucleotide
gcucuacaaucuucugcc

SEQ ID NO: 46319 - RNA, 18 nt, Artificial Sequence
  Description of Artificial Sequence: Synthetic oligonucleotide
agcuagcucuacaaucuu

SEQ ID NO: 46320 - RNA, 18 nt, Artificial Sequence
  Description of Artificial Sequence: Synthetic oligonucleotide
cugugagcuagcucuaca

SEQ ID NO: 46321 - RNA, 18 nt, Artificial Sequence
  Description of Artificial Sequence: Synthetic oligonucleotide
ccccgcugugagcuagcu

SEQ ID NO: 46322 - RNA, 18 nt, Artificial Sequence
  Description of Artificial Sequence: Synthetic oligonucleotide
ccgggccccgcugugagc

SEQ ID NO: 46323 - RNA, 18 nt, Artificial Sequence
  Description of Artificial Sequence: Synthetic oligonucleotide
cacggccgggccccgcug

SEQ ID NO: 46324 - RNA, 18 nt, Artificial Sequence
  Description of Artificial Sequence: Synthetic oligonucleotide
ugucgcacggccgggccc

SEQ ID NO: 46325 - RNA, 18 nt, Artificial Sequence
  Description of Artificial Sequence: Synthetic oligonucleotide
ggaaaugucgcacggccg

SEQ ID NO: 46326 - RNA, 18 nt, Artificial Sequence
  Description of Artificial Sequence: Synthetic oligonucleotide
auucgggaaaugucgcac

SEQ ID NO: 46327 - RNA, 18 nt, Artificial Sequence
  Description of Artificial Sequence: Synthetic oligonucleotide
gcagaauucgggaaaugu

SEQ ID NO: 46328 - RNA, 18 nt, Artificial Sequence
  Description of Artificial Sequence: Synthetic oligonucleotide
gauucacuccgcugugac

SEQ ID NO: 46329 - RNA, 18 nt, Artificial Sequence
  Description of Artificial Sequence: Synthetic oligonucleotide
gagcugauucacuccgcu

SEQ ID NO: 46330 - RNA, 18 nt, Artificial Sequence
  Description of Artificial Sequence: Synthetic oligonucleotide
ccaccgagcugauucacu

SEQ ID NO: 46331 - RNA, 18 nt, Artificial Sequence
  Description of Artificial Sequence: Synthetic oligonucleotide
agacaccaccgagcugau

SEQ ID NO: 46332 - RNA, 18 nt, Artificial Sequence
  Description of Artificial Sequence: Synthetic oligonucleotide
gacaaagacaccaccgag

SEQ ID NO: 46333 - RNA, 18 nt, Artificial Sequence
  Description of Artificial Sequence: Synthetic oligonucleotide
ccguugacaaagacacca

SEQ ID NO: 46334 - RNA, 18 nt, Artificial Sequence
  Description of Artificial Sequence: Synthetic oligonucleotide
gccgcccguugacaaaga

SEQ ID NO: 46335 - RNA, 18 nt, Artificial Sequence
  Description of Artificial Sequence: Synthetic oligonucleotide
caguggccgcccguugac

SEQ ID NO: 46336 - RNA, 18 nt, Artificial Sequence
  Description of Artificial Sequence: Synthetic oligonucleotide
uccggcaguggccgcccg

SEQ ID NO: 46337 - RNA, 18 nt, Artificial Sequence
  Description of Artificial Sequence: Synthetic oligonucleotide
uggaguccggcaguggcc

SEQ ID NO: 46338 - RNA, 18 nt, Artificial Sequence
  Description of Artificial Sequence: Synthetic oligonucleotide
ccggguggaguccggcag

SEQ ID NO: 46339 - RNA, 18 nt, Artificial Sequence
  Description of Artificial Sequence: Synthetic oligonucleotide
uucugccggguggagucc

SEQ ID NO: 46340 - RNA, 18 nt, Artificial Sequence
  Description of Artificial Sequence: Synthetic oligonucleotide
caaucuucugccgggugg

SEQ ID NO: 46341 - RNA, 18 nt, Artificial Sequence
  Description of Artificial Sequence: Synthetic oligonucleotide
cucuacaaucuucugccg

SEQ ID NO: 46342 - RNA, 18 nt, Artificial Sequence
  Description of Artificial Sequence: Synthetic oligonucleotide
gcuagcucuacaaucuuc

SEQ ID NO: 46343 - RNA, 18 nt, Artificial Sequence
  Description of Artificial Sequence: Synthetic oligonucleotide
ugugagcuagcucuacaa

SEQ ID NO: 46344 - RNA, 18 nt, Artificial Sequence
  Description of Artificial Sequence: Synthetic oligonucleotide
cccgcugugagcuagcuc

SEQ ID NO: 46345 - RNA, 18 nt, Artificial Sequence
  Description of Artificial Sequence: Synthetic oligonucleotide
cgggccccgcugugagcu

SEQ ID NO: 46346 - RNA, 18 nt, Artificial Sequence
  Description of Artificial Sequence: Synthetic oligonucleotide
acggccgggccccgcugu

SEQ ID NO: 46347 - RNA, 18 nt, Artificial Sequence
  Description of Artificial Sequence: Synthetic oligonucleotide
gucgcacggccgggcccc

SEQ ID NO: 46348 - RNA, 18 nt, Artificial Sequence
  Description of Artificial Sequence: Synthetic oligonucleotide
gaaaugucgcacggccgg

SEQ ID NO: 46349 - RNA, 18 nt, Artificial Sequence
  Description of Artificial Sequence: Synthetic oligonucleotide
uucgggaaaugucgcacg

SEQ ID NO: 46350 - RNA, 18 nt, Artificial Sequence
  Description of Artificial Sequence: Synthetic oligonucleotide
cagaauucgggaaauguc

SEQ ID NO: 46351 - RNA, 18 nt, Artificial Sequence
  Description of Artificial Sequence: Synthetic oligonucleotide
gggcggcgccgggaggau

SEQ ID NO: 46352 - RNA, 18 nt, Artificial Sequence
  Description of Artificial Sequence: Synthetic oligonucleotide
agaguggagggccgcggg

SEQ ID NO: 46353 - RNA, 18 nt, Artificial Sequence
  Description of Artificial Sequence: Synthetic oligonucleotide
cguugagaguggagggcc

SEQ ID NO: 46354 - RNA, 18 nt, Artificial Sequence
  Description of Artificial Sequence: Synthetic oligonucleotide
gagggcguugagagugga

SEQ ID NO: 46355 - RNA, 18 nt, Artificial Sequence
  Description of Artificial Sequence: Synthetic oligonucleotide
gaagagagggcguugaga

SEQ ID NO: 46356 - RNA, 18 nt, Artificial Sequence
  Description of Artificial Sequence: Synthetic oligonucleotide
gaaaugaagagagggcgu

SEQ ID NO: 46357 - RNA, 18 nt, Artificial Sequence
  Description of Artificial Sequence: Synthetic oligonucleotide
aguaagaaaugaagagag

SEQ ID NO: 46358 - RNA, 18 nt, Artificial Sequence
  Description of Artificial Sequence: Synthetic oligonucleotide
uuuacaguaagaaaugaa

SEQ ID NO: 46359 - RNA, 18 nt, Artificial Sequence
  Description of Artificial Sequence: Synthetic oligonucleotide
caucguuuacaguaagaa

SEQ ID NO: 46360 - RNA, 18 nt, Artificial Sequence
  Description of Artificial Sequence: Synthetic oligonucleotide
auuagcaucguuuacagu

SEQ ID NO: 46361 - RNA, 18 nt, Artificial Sequence
  Description of Artificial Sequence: Synthetic oligonucleotide
ccauaauuagcaucguuu

SEQ ID NO: 46362 - RNA, 18 nt, Artificial Sequence
  Description of Artificial Sequence: Synthetic oligonucleotide
ggguccauaauuagcauc

SEQ ID NO: 46363 - RNA, 18 nt, Artificial Sequence
  Description of Artificial Sequence: Synthetic oligonucleotide
gaaagugggaaggcaggg

SEQ ID NO: 46364 - RNA, 18 nt, Artificial Sequence
  Description of Artificial Sequence: Synthetic oligonucleotide
gggaaagugggaaggcag

SEQ ID NO: 46365 - RNA, 18 nt, Artificial Sequence
  Description of Artificial Sequence: Synthetic oligonucleotide
gaugguggaaggagaggg

SEQ ID NO: 46366 - RNA, 18 nt, Artificial Sequence
  Description of Artificial Sequence: Synthetic oligonucleotide
ggaaggaugguggaagga

SEQ ID NO: 46367 - RNA, 18 nt, Artificial Sequence
  Description of Artificial Sequence: Synthetic oligonucleotide
gauagggaaggauggugg

SEQ ID NO: 46368 - RNA, 18 nt, Artificial Sequence
  Description of Artificial Sequence: Synthetic oligonucleotide
aaagagauagggaaggau

SEQ ID NO: 46369 - RNA, 18 nt, Artificial Sequence
  Description of Artificial Sequence: Synthetic oligonucleotide
gguugaaagagauaggga

SEQ ID NO: 46370 - RNA, 18 nt, Artificial Sequence
  Description of Artificial Sequence: Synthetic oligonucleotide
acccagguugaaagagau

SEQ ID NO: 46371 - RNA, 18 nt, Artificial Sequence
  Description of Artificial Sequence: Synthetic oligonucleotide
aacugacccagguugaaa

SEQ ID NO: 46372 - RNA, 18 nt, Artificial Sequence
  Description of Artificial Sequence: Synthetic oligonucleotide
uauguaacugacccaggu

SEQ ID NO: 46373 - RNA, 18 nt, Artificial Sequence
  Description of Artificial Sequence: Synthetic oligonucleotide
uaucuuauguaacugacc

SEQ ID NO: 46374 - RNA, 18 nt, Artificial Sequence
  Description of Artificial Sequence: Synthetic oligonucleotide
ugaguuaucuuauguaac

SEQ ID NO: 46375 - RNA, 18 nt, Artificial Sequence
  Description of Artificial Sequence: Synthetic oligonucleotide
gcagaugaguuaucuuau

SEQ ID NO: 46376 - RNA, 18 nt, Artificial Sequence
  Description of Artificial Sequence: Synthetic oligonucleotide
cugaagcagaugaguuau

SEQ ID NO: 46377 - RNA, 18 nt, Artificial Sequence
  Description of Artificial Sequence: Synthetic oligonucleotide
uuuuucugaagcagauga

SEQ ID NO: 46378 - RNA, 18 nt, Artificial Sequence
  Description of Artificial Sequence: Synthetic oligonucleotide
caauauuuuucugaagca

SEQ ID NO: 46379 - RNA, 18 nt, Artificial Sequence
  Description of Artificial Sequence: Synthetic oligonucleotide
gcacacaauauuuuucug

SEQ ID NO: 46380 - RNA, 18 nt, Artificial Sequence
  Description of Artificial Sequence: Synthetic oligonucleotide
aauccgcacacaauauuu

SEQ ID NO: 46381 - RNA, 18 nt, Artificial Sequence
  Description of Artificial Sequence: Synthetic oligonucleotide
aaaaaaauccgcacacaa

SEQ ID NO: 46382 - RNA, 18 nt, Artificial Sequence
  Description of Artificial Sequence: Synthetic oligonucleotide
uuuuuaaaaaaauccgca

SEQ ID NO: 46383 - RNA, 18 nt, Artificial Sequence
  Description of Artificial Sequence: Synthetic oligonucleotide
agauuuuuuuaaaaaaau

SEQ ID NO: 46384 - RNA, 18 nt, Artificial Sequence
  Description of Artificial Sequence: Synthetic oligonucleotide
gagaaagauuuuuuuaaa

SEQ ID NO: 46385 - RNA, 18 nt, Artificial Sequence
  Description of Artificial Sequence: Synthetic oligonucleotide
aaaaagagaaagauuuuu

SEQ ID NO: 46386 - RNA, 18 nt, Artificial Sequence
  Description of Artificial Sequence: Synthetic oligonucleotide
caaauaaaaagagaaaga

SEQ ID NO: 46387 - RNA, 18 nt, Artificial Sequence
  Description of Artificial Sequence: Synthetic oligonucleotide
uuuaccaaauaaaaagag

SEQ ID NO: 46388 - RNA, 18 nt, Artificial Sequence
  Description of Artificial Sequence: Synthetic oligonucleotide
augucuuuaccaaauaaa

SEQ ID NO: 46389 - RNA, 18 nt, Artificial Sequence
  Description of Artificial Sequence: Synthetic oligonucleotide
aaugaaugucuuuaccaa

SEQ ID NO: 46390 - RNA, 18 nt, Artificial Sequence
  Description of Artificial Sequence: Synthetic oligonucleotide
cccacaaugaaugucuuu

SEQ ID NO: 46391 - RNA, 18 nt, Artificial Sequence
  Description of Artificial Sequence: Synthetic oligonucleotide
cuguucccacaaugaaug

SEQ ID NO: 46392 - RNA, 18 nt, Artificial Sequence
  Description of Artificial Sequence: Synthetic oligonucleotide
auaaacuguucccacaau

SEQ ID NO: 46393 - RNA, 18 nt, Artificial Sequence
  Description of Artificial Sequence: Synthetic oligonucleotide
gguucauaaacuguuccc

SEQ ID NO: 46394 - RNA, 18 nt, Artificial Sequence
  Description of Artificial Sequence: Synthetic oligonucleotide
auuacgguucauaaacug

SEQ ID NO: 46395 - RNA, 18 nt, Artificial Sequence
  Description of Artificial Sequence: Synthetic oligonucleotide
agcuuauuacgguucaua

SEQ ID NO: 46396 - RNA, 18 nt, Artificial Sequence
  Description of Artificial Sequence: Synthetic oligonucleotide
aacucagcuuauuacggu

SEQ ID NO: 46397 - RNA, 18 nt, Artificial Sequence
  Description of Artificial Sequence: Synthetic oligonucleotide
uauauaacucagcuuauu

SEQ ID NO: 46398 - RNA, 18 nt, Artificial Sequence
  Description of Artificial Sequence: Synthetic oligonucleotide
cgguuuauauaacucagc

SEQ ID NO: 46399 - RNA, 18 nt, Artificial Sequence
  Description of Artificial Sequence: Synthetic oligonucleotide
uaugccgguuuauauaac

SEQ ID NO: 46400 - RNA, 18 nt, Artificial Sequence
  Description of Artificial Sequence: Synthetic oligonucleotide
gaaauuaugccgguuuau

SEQ ID NO: 46401 - RNA, 18 nt, Artificial Sequence
  Description of Artificial Sequence: Synthetic oligonucleotide
agaaugaaauuaugccgg

SEQ ID NO: 46402 - RNA, 18 nt, Artificial Sequence
  Description of Artificial Sequence: Synthetic oligonucleotide
agagcagaaugaaauuau

SEQ ID NO: 46403 - RNA, 18 nt, Artificial Sequence
  Description of Artificial Sequence: Synthetic oligonucleotide
gggagagcagaaugaaau

SEQ ID NO: 46404 - RNA, 18 nt, Artificial Sequence
  Description of Artificial Sequence: Synthetic oligonucleotide
agguaagcaugggcuggg

SEQ ID NO: 46405 - RNA, 18 nt, Artificial Sequence
  Description of Artificial Sequence: Synthetic oligonucleotide
agcugagguaagcauggg

SEQ ID NO: 46406 - RNA, 18 nt, Artificial Sequence
  Description of Artificial Sequence: Synthetic oligonucleotide
ucaaaagcugagguaagc

SEQ ID NO: 46407 - RNA, 18 nt, Artificial Sequence
  Description of Artificial Sequence: Synthetic oligonucleotide
auaccucaaaagcugagg

SEQ ID NO: 46408 - RNA, 18 nt, Artificial Sequence
  Description of Artificial Sequence: Synthetic oligonucleotide
aacaaauaccucaaaagc

SEQ ID NO: 46409 - RNA, 18 nt, Artificial Sequence
  Description of Artificial Sequence: Synthetic oligonucleotide
gaauaaacaaauaccuca

SEQ ID NO: 46410 - RNA, 18 nt, Artificial Sequence
  Description of Artificial Sequence: Synthetic oligonucleotide
augaagaauaaacaaaua

SEQ ID NO: 46411 - RNA, 18 nt, Artificial Sequence
  Description of Artificial Sequence: Synthetic oligonucleotide
uaaacaugaagaauaaac

SEQ ID NO: 46412 - RNA, 18 nt, Artificial Sequence
  Description of Artificial Sequence: Synthetic oligonucleotide
auucauaaacaugaagaa

SEQ ID NO: 46413 - RNA, 18 nt, Artificial Sequence
  Description of Artificial Sequence: Synthetic oligonucleotide
auauuauucauaaacaug

SEQ ID NO: 46414 - RNA, 18 nt, Artificial Sequence
  Description of Artificial Sequence: Synthetic oligonucleotide
aauauauauuauucauaa

SEQ ID NO: 46415 - RNA, 18 nt, Artificial Sequence
  Description of Artificial Sequence: Synthetic oligonucleotide
aaaucaauauauauuauu

SEQ ID NO: 46416 - RNA, 18 nt, Artificial Sequence
  Description of Artificial Sequence: Synthetic oligonucleotide
uuuuaaaaucaauauaua

SEQ ID NO: 46417 - RNA, 18 nt, Artificial Sequence
  Description of Artificial Sequence: Synthetic oligonucleotide
uugccuuuuaaaaucaau

SEQ ID NO: 46418 - RNA, 18 nt, Artificial Sequence
  Description of Artificial Sequence: Synthetic oligonucleotide
agcauuugccuuuuaaaa

SEQ ID NO: 46419 - RNA, 18 nt, Artificial Sequence
  Description of Artificial Sequence: Synthetic oligonucleotide
uaaauagcauuugccuuu

SEQ ID NO: 46420 - RNA, 18 nt, Artificial Sequence
  Description of Artificial Sequence: Synthetic oligonucleotide
aggaguaaauagcauuug

SEQ ID NO: 46421 - RNA, 18 nt, Artificial Sequence
  Description of Artificial Sequence: Synthetic oligonucleotide
uagggaggaguaaauagc

SEQ ID NO: 46422 - RNA, 18 nt, Artificial Sequence
  Description of Artificial Sequence: Synthetic oligonucleotide
ugaguuagggaggaguaa

SEQ ID NO: 46423 - RNA, 18 nt, Artificial Sequence
  Description of Artificial Sequence: Synthetic oligonucleotide
aaaugugaguuagggagg

SEQ ID NO: 46424 - RNA, 18 nt, Artificial Sequence
  Description of Artificial Sequence: Synthetic oligonucleotide
ugaguaaaugugaguuag

SEQ ID NO: 46425 - RNA, 18 nt, Artificial Sequence
  Description of Artificial Sequence: Synthetic oligonucleotide
ucaauugaguaaauguga

SEQ ID NO: 46426 - RNA, 18 nt, Artificial Sequence
  Description of Artificial Sequence: Synthetic oligonucleotide
aauacucaauugaguaaa

SEQ ID NO: 46427 - RNA, 18 nt, Artificial Sequence
  Description of Artificial Sequence: Synthetic oligonucleotide
agcauuugccuuuuaaaa

SEQ ID NO: 46428 - RNA, 18 nt, Artificial Sequence
  Description of Artificial Sequence: Synthetic oligonucleotide
uaaauagcauuugccuuu

SEQ ID NO: 46429 - RNA, 18 nt, Artificial Sequence
  Description of Artificial Sequence: Synthetic oligonucleotide
aggaguaaauagcauuug

SEQ ID NO: 46430 - RNA, 18 nt, Artificial Sequence
  Description of Artificial Sequence: Synthetic oligonucleotide
uagggaggaguaaauagc

SEQ ID NO: 46431 - RNA, 18 nt, Artificial Sequence
  Description of Artificial Sequence: Synthetic oligonucleotide
ugaguuagggaggaguaa

SEQ ID NO: 46432 - RNA, 18 nt, Artificial Sequence
  Description of Artificial Sequence: Synthetic oligonucleotide
aaaugugaguuagggagg

SEQ ID NO: 46433 - RNA, 18 nt, Artificial Sequence
  Description of Artificial Sequence: Synthetic oligonucleotide
ugaguaaaugugaguuag

SEQ ID NO: 46434 - RNA, 18 nt, Artificial Sequence
  Description of Artificial Sequence: Synthetic oligonucleotide
ucaauugaguaaauguga

SEQ ID NO: 46435 - RNA, 18 nt, Artificial Sequence
  Description of Artificial Sequence: Synthetic oligonucleotide
aauacucaauugaguaaa

SEQ ID NO: 46436 - RNA, 18 nt, Artificial Sequence
  Description of Artificial Sequence: Synthetic oligonucleotide
uaaaaaauacucaauuga

SEQ ID NO: 46437 - RNA, 18 nt, Artificial Sequence
  Description of Artificial Sequence: Synthetic oligonucleotide
uucuuuaaaaaauacuca

SEQ ID NO: 46438 - RNA, 18 nt, Artificial Sequence
  Description of Artificial Sequence: Synthetic oligonucleotide
ucuucuucuuuaaaaaau

SEQ ID NO: 46439 - RNA, 18 nt, Artificial Sequence
  Description of Artificial Sequence: Synthetic oligonucleotide
uuacuucuucuucuuuaa

SEQ ID NO: 46440 - RNA, 18 nt, Artificial Sequence
  Description of Artificial Sequence: Synthetic oligonucleotide
uuuuuuuacuucuucuuc

SEQ ID NO: 46441 - RNA, 18 nt, Artificial Sequence
  Description of Artificial Sequence: Synthetic oligonucleotide
acugauuuuuuuacuucu

SEQ ID NO: 46442 - RNA, 18 nt, Artificial Sequence
  Description of Artificial Sequence: Synthetic oligonucleotide
aauaaacugauuuuuuua

SEQ ID NO: 46443 - RNA, 18 nt, Artificial Sequence
  Description of Artificial Sequence: Synthetic oligonucleotide
uaaaaaauaaacugauuu

SEQ ID NO: 46444 - RNA, 18 nt, Artificial Sequence
  Description of Artificial Sequence: Synthetic oligonucleotide
aaagguaaaaaauaaacu

SEQ ID NO: 46445 - RNA, 18 nt, Artificial Sequence
  Description of Artificial Sequence: Synthetic oligonucleotide
agaacaaagguaaaaaau

SEQ ID NO: 46446 - RNA, 18 nt, Artificial Sequence
  Description of Artificial Sequence: Synthetic oligonucleotide
uuuaaagaacaaagguaa

SEQ ID NO: 46447 - RNA, 18 nt, Artificial Sequence
  Description of Artificial Sequence: Synthetic oligonucleotide
uauguuuuaaagaacaaa

SEQ ID NO: 46448 - RNA, 18 nt, Artificial Sequence
  Description of Artificial Sequence: Synthetic oligonucleotide
ggcguuauguuuuaaaga

SEQ ID NO: 46449 - RNA, 18 nt, Artificial Sequence
  Description of Artificial Sequence: Synthetic oligonucleotide
aaaguggcguuauguuuu

SEQ ID NO: 46450 - RNA, 18 nt, Artificial Sequence
  Description of Artificial Sequence: Synthetic oligonucleotide
ugcuuaaaguggcguuau

SEQ ID NO: 46451 - RNA, 18 nt, Artificial Sequence
  Description of Artificial Sequence: Synthetic oligonucleotide
gaccuugcuuaaaguggc

SEQ ID NO: 46452 - RNA, 18 nt, Artificial Sequence
  Description of Artificial Sequence: Synthetic oligonucleotide
gugcugaccuugcuuaaa

SEQ ID NO: 46453 - RNA, 18 nt, Artificial Sequence
  Description of Artificial Sequence: Synthetic oligonucleotide
uuuuugugcugaccuugc

SEQ ID NO: 46454 - RNA, 18 nt, Artificial Sequence
  Description of Artificial Sequence: Synthetic oligonucleotide
auuuauuuuugugcugac

SEQ ID NO: 46455 - RNA, 18 nt, Artificial Sequence
  Description of Artificial Sequence: Synthetic oligonucleotide
gauaaauuuauuuuugug

SEQ ID NO: 46456 - RNA, 18 nt, Artificial Sequence
  Description of Artificial Sequence: Synthetic oligonucleotide
aaguagauaaauuuauuu

SEQ ID NO: 46457 - RNA, 18 nt, Artificial Sequence
  Description of Artificial Sequence: Synthetic oligonucleotide
aaacgaaguagauaaauu

SEQ ID NO: 46458 - RNA, 18 nt, Artificial Sequence
  Description of Artificial Sequence: Synthetic oligonucleotide
caucaaaacgaaguagau

SEQ ID NO: 46459 - RNA, 18 nt, Artificial Sequence
  Description of Artificial Sequence: Synthetic oligonucleotide
agaugcaucaaaacgaag

SEQ ID NO: 46460 - RNA, 18 nt, Artificial Sequence
  Description of Artificial Sequence: Synthetic oligonucleotide
ccugaagaugcaucaaaa

SEQ ID NO: 46461 - RNA, 18 nt, Artificial Sequence
  Description of Artificial Sequence: Synthetic oligonucleotide
cacugccugaagaugcau

SEQ ID NO: 46462 - RNA, 18 nt, Artificial Sequence
  Description of Artificial Sequence: Synthetic oligonucleotide
uuaaacacugccugaaga

SEQ ID NO: 46463 - RNA, 18 nt, Artificial Sequence
  Description of Artificial Sequence: Synthetic oligonucleotide
uuuucuuaaacacugccu

SEQ ID NO: 46464 - RNA, 18 nt, Artificial Sequence
  Description of Artificial Sequence: Synthetic oligonucleotide
aaaacuuuucuuaaacac

SEQ ID NO: 46465 - RNA, 18 nt, Artificial Sequence
  Description of Artificial Sequence: Synthetic oligonucleotide
aaaaaaaaacuuuucuua

SEQ ID NO: 46466 - RNA, 18 nt, Artificial Sequence
  Description of Artificial Sequence: Synthetic oligonucleotide
uuuuaaaaaaaaaacuuu

SEQ ID NO: 46467 - RNA, 18 nt, Artificial Sequence
  Description of Artificial Sequence: Synthetic oligonucleotide
gcuuuuuuuaaaaaaaaa

SEQ ID NO: 46468 - RNA, 18 nt, Artificial Sequence
  Description of Artificial Sequence: Synthetic oligonucleotide
uaaaagcuuuuuuuaaaa

SEQ ID NO: 46469 - RNA, 18 nt, Artificial Sequence
  Description of Artificial Sequence: Synthetic oligonucleotide
gaauuuaaaagcuuuuuu

SEQ ID NO: 46470 - RNA, 18 nt, Artificial Sequence
  Description of Artificial Sequence: Synthetic oligonucleotide
aaaacgaauuuaaaagcu

SEQ ID NO: 46471 - RNA, 18 nt, Artificial Sequence
  Description of Artificial Sequence: Synthetic oligonucleotide
acuaaaaaacgaauuuaa

SEQ ID NO: 46472 - RNA, 18 nt, Artificial Sequence
  Description of Artificial Sequence: Synthetic oligonucleotide
uuugaacuaaaaaacgaa

SEQ ID NO: 46473 - RNA, 18 nt, Artificial Sequence
  Description of Artificial Sequence: Synthetic oligonucleotide
aacaauuugaacuaaaaa

SEQ ID NO: 46474 - RNA, 18 nt, Artificial Sequence
  Description of Artificial Sequence: Synthetic oligonucleotide
uuucaaacaauuugaacu

SEQ ID NO: 46475 - RNA, 18 nt, Artificial Sequence
  Description of Artificial Sequence: Synthetic oligonucleotide
gauacuuucaaacaauuu

SEQ ID NO: 46476 - RNA, 18 nt, Artificial Sequence
  Description of Artificial Sequence: Synthetic oligonucleotide
augaugauacuuucaaac

SEQ ID NO: 46477 - RNA, 18 nt, Artificial Sequence
  Description of Artificial Sequence: Synthetic oligonucleotide
caaauaugaugauacuuu

SEQ ID NO: 46478 - RNA, 18 nt, Artificial Sequence
  Description of Artificial Sequence: Synthetic oligonucleotide
aacuacaaauaugaugau

SEQ ID NO: 46479 - RNA, 18 nt, Artificial Sequence
  Description of Artificial Sequence: Synthetic oligonucleotide
cuaaaaacuacaaauaug

SEQ ID NO: 46480 - RNA, 18 nt, Artificial Sequence
  Description of Artificial Sequence: Synthetic oligonucleotide
uagcccuaaaaacuacaa

SEQ ID NO: 46481 - RNA, 18 nt, Artificial Sequence
  Description of Artificial Sequence: Synthetic oligonucleotide
auuuguagcccuaaaaac

SEQ ID NO: 46482 - RNA, 18 nt, Artificial Sequence
  Description of Artificial Sequence: Synthetic oligonucleotide
auuacauuuguagcccua

SEQ ID NO: 46483 - RNA, 18 nt, Artificial Sequence
  Description of Artificial Sequence: Synthetic oligonucleotide
uuaaaauuacauuuguag

SEQ ID NO: 46484 - RNA, 18 nt, Artificial Sequence
  Description of Artificial Sequence: Synthetic oligonucleotide
uuuucuuaaaauuacauu

SEQ ID NO: 46485 - RNA, 18 nt, Artificial Sequence
  Description of Artificial Sequence: Synthetic oligonucleotide
gcuuuuuuucuuaaaauu

SEQ ID NO: 46486 - RNA, 18 nt, Artificial Sequence
  Description of Artificial Sequence: Synthetic oligonucleotide
agagagcuuuuuuucuua

SEQ ID NO: 46487 - RNA, 18 nt, Artificial Sequence
  Description of Artificial Sequence: Synthetic oligonucleotide
acuguagagagcuuuuuu

SEQ ID NO: 46488 - RNA, 18 nt, Artificial Sequence
  Description of Artificial Sequence: Synthetic oligonucleotide
aacuuacuguagagagcu

SEQ ID NO: 46489 - RNA, 18 nt, Artificial Sequence
  Description of Artificial Sequence: Synthetic oligonucleotide
augagaacuuacuguaga

SEQ ID NO: 46490 - RNA, 18 nt, Artificial Sequence
  Description of Artificial Sequence: Synthetic oligonucleotide
augguaugagaacuuacu

SEQ ID NO: 46491 - RNA, 18 nt, Artificial Sequence
  Description of Artificial Sequence: Synthetic oligonucleotide
cuucaaugguaugagaac

SEQ ID NO: 46492 - RNA, 18 nt, Artificial Sequence
  Description of Artificial Sequence: Synthetic oligonucleotide
uauaccuucaaugguaug

SEQ ID NO: 46493 - RNA, 18 nt, Artificial Sequence
  Description of Artificial Sequence: Synthetic oligonucleotide
aaaaauauaccuucaaug

SEQ ID NO: 46494 - RNA, 18 nt, Artificial Sequence
  Description of Artificial Sequence: Synthetic oligonucleotide
aacacaaaaauauaccuu

SEQ ID NO: 46495 - RNA, 18 nt, Artificial Sequence
  Description of Artificial Sequence: Synthetic oligonucleotide
ucuauaacacaaaaauau

SEQ ID NO: 46496 - RNA, 18 nt, Artificial Sequence
  Description of Artificial Sequence: Synthetic oligonucleotide
augggucuauaacacaaa

SEQ ID NO: 46497 - RNA, 18 nt, Artificial Sequence
  Description of Artificial Sequence: Synthetic oligonucleotide
ucugcaugggucuauaac

SEQ ID NO: 46498 - RNA, 18 nt, Artificial Sequence
  Description of Artificial Sequence: Synthetic oligonucleotide
uugcaucugcaugggucu

SEQ ID NO: 46499 - RNA, 18 nt, Artificial Sequence
  Description of Artificial Sequence: Synthetic oligonucleotide
gacuuuugcaucugcaug

SEQ ID NO: 46500 - RNA, 18 nt, Artificial Sequence
  Description of Artificial Sequence: Synthetic oligonucleotide
acuuggacuuuugcaucu

SEQ ID NO: 46501 - RNA, 18 nt, Artificial Sequence
  Description of Artificial Sequence: Synthetic oligonucleotide
ccagcacuuggacuuuug

SEQ ID NO: 46502 - RNA, 18 nt, Artificial Sequence
  Description of Artificial Sequence: Synthetic oligonucleotide
auuguccagcacuuggac

SEQ ID NO: 46503 - RNA, 18 nt, Artificial Sequence
  Description of Artificial Sequence: Synthetic oligonucleotide
uuuugauuguccagcacu

SEQ ID NO: 46504 - RNA, 18 nt, Artificial Sequence
  Description of Artificial Sequence: Synthetic oligonucleotide
uuacguuuugauugucca

SEQ ID NO: 46505 - RNA, 18 nt, Artificial Sequence
  Description of Artificial Sequence: Synthetic oligonucleotide
caagcuuacguuuugauu

SEQ ID NO: 46506 - RNA, 18 nt, Artificial Sequence
  Description of Artificial Sequence: Synthetic oligonucleotide
aaugacaagcuuacguuu

SEQ ID NO: 46507 - RNA, 18 nt, Artificial Sequence
  Description of Artificial Sequence: Synthetic oligonucleotide
uaaacaaugacaagcuua

SEQ ID NO: 46508 - RNA, 18 nt, Artificial Sequence
  Description of Artificial Sequence: Synthetic oligonucleotide
ugcauuaaacaaugacaa

SEQ ID NO: 46509 - RNA, 18 nt, Artificial Sequence
  Description of Artificial Sequence: Synthetic oligonucleotide
aaguaugcauuaaacaau

SEQ ID NO: 46510 - RNA, 18 nt, Artificial Sequence
  Description of Artificial Sequence: Synthetic oligonucleotide
uguuuaaguaugcauuaa

SEQ ID NO: 46511 - RNA, 18 nt, Artificial Sequence
  Description of Artificial Sequence: Synthetic oligonucleotide
aaaauuguuuaaguaugc

SEQ ID NO: 46512 - RNA, 18 nt, Artificial Sequence
  Description of Artificial Sequence: Synthetic oligonucleotide
aaaauaaaauuguuuaag

SEQ ID NO: 46513 - RNA, 18 nt, Artificial Sequence
  Description of Artificial Sequence: Synthetic oligonucleotide
agacaaaaauaaaauugu

SEQ ID NO: 46514 - RNA, 18 nt, Artificial Sequence
  Description of Artificial Sequence: Synthetic oligonucleotide
uuucaagacaaaaauaaa

SEQ ID NO: 46515 - RNA, 18 nt, Artificial Sequence
  Description of Artificial Sequence: Synthetic oligonucleotide
aauaauuucaagacaaaa

SEQ ID NO: 46516 - RNA, 18 nt, Artificial Sequence
  Description of Artificial Sequence: Synthetic oligonucleotide
uuauuaauaauuucaaga

SEQ ID NO: 46517 - RNA, 18 nt, Artificial Sequence
  Description of Artificial Sequence: Synthetic oligonucleotide
ccacauuauuaauaauuu

SEQ ID NO: 46518 - RNA, 18 nt, Artificial Sequence
  Description of Artificial Sequence: Synthetic oligonucleotide
gaaaaccacauuauuaau

SEQ ID NO: 46519 - RNA, 18 nt, Artificial Sequence
  Description of Artificial Sequence: Synthetic oligonucleotide
ggacagaaaaccacauua

SEQ ID NO: 46520 - RNA, 18 nt, Artificial Sequence
  Description of Artificial Sequence: Synthetic oligonucleotide
ucacacauccguuggaca

SEQ ID NO: 46521 - RNA, 18 nt, Artificial Sequence
  Description of Artificial Sequence: Synthetic oligonucleotide
uuuacucacacauccguu

SEQ ID NO: 46522 - RNA, 18 nt, Artificial Sequence
  Description of Artificial Sequence: Synthetic oligonucleotide
agaauuuuacucacacau

SEQ ID NO: 46523 - RNA, 18 nt, Artificial Sequence
  Description of Artificial Sequence: Synthetic oligonucleotide
ugcccagaauuuuacuca

SEQ ID NO: 46524 - RNA, 18 nt, Artificial Sequence
  Description of Artificial Sequence: Synthetic oligonucleotide
auaccugcccagaauuuu

SEQ ID NO: 46525 - RNA, 18 nt, Artificial Sequence
  Description of Artificial Sequence: Synthetic oligonucleotide
ucguaauaccugcccaga

SEQ ID NO: 46526 - RNA, 18 nt, Artificial Sequence
  Description of Artificial Sequence: Synthetic oligonucleotide
cagucucguaauaccugc

SEQ ID NO: 46527 - RNA, 18 nt, Artificial Sequence
  Description of Artificial Sequence: Synthetic oligonucleotide
ggagccagucucguaaua

SEQ ID NO: 46528 - RNA, 18 nt, Artificial Sequence
  Description of Artificial Sequence: Synthetic oligonucleotide
cugauggagccagucucg

SEQ ID NO: 46529 - RNA, 18 nt, Artificial Sequence
  Description of Artificial Sequence: Synthetic oligonucleotide
ugggucugauggagccag

SEQ ID NO: 46530 - RNA, 18 nt, Artificial Sequence
  Description of Artificial Sequence: Synthetic oligonucleotide
ugcccugggucugaugga

SEQ ID NO: 46531 - RNA, 18 nt, Artificial Sequence
  Description of Artificial Sequence: Synthetic oligonucleotide
ccgauugcccugggucug

SEQ ID NO: 46532 - RNA, 18 nt, Artificial Sequence
  Description of Artificial Sequence: Synthetic oligonucleotide
uaccaccgauugcccugg

SEQ ID NO: 46533 - RNA, 18 nt, Artificial Sequence
  Description of Artificial Sequence: Synthetic oligonucleotide
uuuacuaccaccgauugc

SEQ ID NO: 46534 - RNA, 18 nt, Artificial Sequence
  Description of Artificial Sequence: Synthetic oligonucleotide
cucgguuuacuaccaccg

SEQ ID NO: 46535 - RNA, 18 nt, Artificial Sequence
  Description of Artificial Sequence: Synthetic oligonucleotide
cuacucucgguuuacuac

SEQ ID NO: 46536 - RNA, 18 nt, Artificial Sequence
  Description of Artificial Sequence: Synthetic oligonucleotide
agucgcuacucucgguuu

SEQ ID NO: 46537 - RNA, 18 nt, Artificial Sequence
  Description of Artificial Sequence: Synthetic oligonucleotide
ucuggagucgcuacucuc

SEQ ID NO: 46538 - RNA, 18 nt, Artificial Sequence
  Description of Artificial Sequence: Synthetic oligonucleotide
caacuucuggagucgcua

SEQ ID NO: 46539 - RNA, 18 nt, Artificial Sequence
  Description of Artificial Sequence: Synthetic oligonucleotide
gcuuacaacuucuggagu

SEQ ID NO: 46540 - RNA, 18 nt, Artificial Sequence
  Description of Artificial Sequence: Synthetic oligonucleotide
auuuugcuuacaacuucu

SEQ ID NO: 46541 - RNA, 18 nt, Artificial Sequence
  Description of Artificial Sequence: Synthetic oligonucleotide
gggcuauuuugcuuacaa

SEQ ID NO: 46542 - RNA, 18 nt, Artificial Sequence
  Description of Artificial Sequence: Synthetic oligonucleotide
auacugggcuauuuugcu

SEQ ID NO: 46543 - RNA, 18 nt, Artificial Sequence
  Description of Artificial Sequence: Synthetic oligonucleotide
cgcuuauacugggcuauu

SEQ ID NO: 46544 - RNA, 18 nt, Artificial Sequence
  Description of Artificial Sequence: Synthetic oligonucleotide
acucccgcuuauacuggg

SEQ ID NO: 46545 - RNA, 18 nt, Artificial Sequence
  Description of Artificial Sequence: Synthetic oligonucleotide
cgggcacucccgcuuaua

SEQ ID NO: 46546 - RNA, 18 nt, Artificial Sequence
  Description of Artificial Sequence: Synthetic oligonucleotide
auggacgggcacucccgc

SEQ ID NO: 46547 - RNA, 18 nt, Artificial Sequence
  Description of Artificial Sequence: Synthetic oligonucleotide
caaagauggacgggcacu

SEQ ID NO: 46548 - RNA, 18 nt, Artificial Sequence
  Description of Artificial Sequence: Synthetic oligonucleotide
ccaagcaaagauggacgg

SEQ ID NO: 46549 - RNA, 18 nt, Artificial Sequence
  Description of Artificial Sequence: Synthetic oligonucleotide
auuucccaagcaaagaug

SEQ ID NO: 46550 - RNA, 18 nt, Artificial Sequence
  Description of Artificial Sequence: Synthetic oligonucleotide
cucggauuucccaagcaa

SEQ ID NO: 46551 - RNA, 18 nt, Artificial Sequence
  Description of Artificial Sequence: Synthetic oligonucleotide
ucugucucggauuuccca

SEQ ID NO: 46552 - RNA, 18 nt, Artificial Sequence
  Description of Artificial Sequence: Synthetic oligonucleotide
aguaaucugucucggauu

SEQ ID NO: 46553 - RNA, 18 nt, Artificial Sequence
  Description of Artificial Sequence: Synthetic oligonucleotide
cggacaguaaucugucuc

SEQ ID NO: 46554 - RNA, 18 nt, Artificial Sequence
  Description of Artificial Sequence: Synthetic oligonucleotide
ccccucggacaguaaucu

SEQ ID NO: 46555 - RNA, 18 nt, Artificial Sequence
  Description of Artificial Sequence: Synthetic oligonucleotide
cagacccccucggacagu

SEQ ID NO: 46556 - RNA, 18 nt, Artificial Sequence
  Description of Artificial Sequence: Synthetic oligonucleotide
ugguacagacccccucgg

SEQ ID NO: 46557 - RNA, 18 nt, Artificial Sequence
  Description of Artificial Sequence: Synthetic oligonucleotide
aucguugguacagacccc

SEQ ID NO: 46558 - RNA, 18 nt, Artificial Sequence
  Description of Artificial Sequence: Synthetic oligonucleotide
auguuaucguugguacag

SEQ ID NO: 46559 - RNA, 18 nt, Artificial Sequence
  Description of Artificial Sequence: Synthetic oligonucleotide
uugguauguuaucguugg

SEQ ID NO: 46560 - RNA, 18 nt, Artificial Sequence
  Description of Artificial Sequence: Synthetic oligonucleotide
cacacauccguuggacac

SEQ ID NO: 46561 - RNA, 18 nt, Artificial Sequence
  Description of Artificial Sequence: Synthetic oligonucleotide
uuacucacacauccguug

SEQ ID NO: 46562 - RNA, 18 nt, Artificial Sequence
  Description of Artificial Sequence: Synthetic oligonucleotide
gaauuuuacucacacauc

SEQ ID NO: 46563 - RNA, 18 nt, Artificial Sequence
  Description of Artificial Sequence: Synthetic oligonucleotide
gcccagaauuuuacucac

SEQ ID NO: 46564 - RNA, 18 nt, Artificial Sequence
  Description of Artificial Sequence: Synthetic oligonucleotide
uaccugcccagaauuuua

SEQ ID NO: 46565 - RNA, 18 nt, Artificial Sequence
  Description of Artificial Sequence: Synthetic oligonucleotide
cguaauaccugcccagaa

SEQ ID NO: 46566 - RNA, 18 nt, Artificial Sequence
  Description of Artificial Sequence: Synthetic oligonucleotide
agucucguaauaccugcc

SEQ ID NO: 46567 - RNA, 18 nt, Artificial Sequence
  Description of Artificial Sequence: Synthetic oligonucleotide
gagccagucucguaauac

SEQ ID NO: 46568 - RNA, 18 nt, Artificial Sequence
  Description of Artificial Sequence: Synthetic oligonucleotide
ugauggagccagucucgu

SEQ ID NO: 46569 - RNA, 18 nt, Artificial Sequence
  Description of Artificial Sequence: Synthetic oligonucleotide
gggucugauggagccagu

SEQ ID NO: 46570 - RNA, 18 nt, Artificial Sequence
  Description of Artificial Sequence: Synthetic oligonucleotide
gcccugggucugauggag

SEQ ID NO: 46571 - RNA, 18 nt, Artificial Sequence
  Description of Artificial Sequence: Synthetic oligonucleotide
cgauugcccugggucuga

SEQ ID NO: 46572 - RNA, 18 nt, Artificial Sequence
  Description of Artificial Sequence: Synthetic oligonucleotide
accaccgauugcccuggg

SEQ ID NO: 46573 - RNA, 18 nt, Artificial Sequence
  Description of Artificial Sequence: Synthetic oligonucleotide
uuacuaccaccgauugcc

SEQ ID NO: 46574 - RNA, 18 nt, Artificial Sequence
  Description of Artificial Sequence: Synthetic oligonucleotide
ucgguuuacuaccaccga

SEQ ID NO: 46575 - RNA, 18 nt, Artificial Sequence
  Description of Artificial Sequence: Synthetic oligonucleotide
uacucucgguuuacuacc

SEQ ID NO: 46576 - RNA, 18 nt, Artificial Sequence
  Description of Artificial Sequence: Synthetic oligonucleotide
gucgcuacucucgguuua

SEQ ID NO: 46577 - RNA, 18 nt, Artificial Sequence
  Description of Artificial Sequence: Synthetic oligonucleotide
cuggagucgcuacucucg

SEQ ID NO: 46578 - RNA, 18 nt, Artificial Sequence
  Description of Artificial Sequence: Synthetic oligonucleotide
aacuucuggagucgcuac

SEQ ID NO: 46579 - RNA, 18 nt, Artificial Sequence
  Description of Artificial Sequence: Synthetic oligonucleotide
cuuacaacuucuggaguc

SEQ ID NO: 46580 - RNA, 18 nt, Artificial Sequence
  Description of Artificial Sequence: Synthetic oligonucleotide
uuuugcuuacaacuucug

SEQ ID NO: 46581 - RNA, 18 nt, Artificial Sequence
  Description of Artificial Sequence: Synthetic oligonucleotide
ggcuauuuugcuuacaac

SEQ ID NO: 46582 - RNA, 18 nt, Artificial Sequence
  Description of Artificial Sequence: Synthetic oligonucleotide
uacugggcuauuuugcuu

SEQ ID NO: 46583 - RNA, 18 nt, Artificial Sequence
  Description of Artificial Sequence: Synthetic oligonucleotide
gcuuauacugggcuauuu

SEQ ID NO: 46584 - RNA, 18 nt, Artificial Sequence
  Description of Artificial Sequence: Synthetic oligonucleotide
cucccgcuuauacugggc

SEQ ID NO: 46585 - RNA, 18 nt, Artificial Sequence
  Description of Artificial Sequence: Synthetic oligonucleotide
gggcacucccgcuuauac

SEQ ID NO: 46586 - RNA, 18 nt, Artificial Sequence
  Description of Artificial Sequence: Synthetic oligonucleotide
uggacgggcacucccgcu

SEQ ID NO: 46587 - RNA, 18 nt, Artificial Sequence
  Description of Artificial Sequence: Synthetic oligonucleotide
aaagauggacgggcacuc

SEQ ID NO: 46588 - RNA, 18 nt, Artificial Sequence
  Description of Artificial Sequence: Synthetic oligonucleotide
caagcaaagauggacggg

SEQ ID NO: 46589 - RNA, 18 nt, Artificial Sequence
  Description of Artificial Sequence: Synthetic oligonucleotide
uuucccaagcaaagaugg

SEQ ID NO: 46590 - RNA, 18 nt, Artificial Sequence
  Description of Artificial Sequence: Synthetic oligonucleotide
ucggauuucccaagcaaa

SEQ ID NO: 46591 - RNA, 18 nt, Artificial Sequence
  Description of Artificial Sequence: Synthetic oligonucleotide
cugucucggauuucccaa

SEQ ID NO: 46592 - RNA, 18 nt, Artificial Sequence
  Description of Artificial Sequence: Synthetic oligonucleotide
guaaucugucucggauuu

SEQ ID NO: 46593 - RNA, 18 nt, Artificial Sequence
  Description of Artificial Sequence: Synthetic oligonucleotide
ggacaguaaucugucucg

SEQ ID NO: 46594 - RNA, 18 nt, Artificial Sequence
  Description of Artificial Sequence: Synthetic oligonucleotide
cccucggacaguaaucug

SEQ ID NO: 46595 - RNA, 18 nt, Artificial Sequence
  Description of Artificial Sequence: Synthetic oligonucleotide
agacccccucggacagua

SEQ ID NO: 46596 - RNA, 18 nt, Artificial Sequence
  Description of Artificial Sequence: Synthetic oligonucleotide
gguacagacccccucgga

SEQ ID NO: 46597 - RNA, 18 nt, Artificial Sequence
  Description of Artificial Sequence: Synthetic oligonucleotide
ucguugguacagaccccc

SEQ ID NO: 46598 - RNA, 18 nt, Artificial Sequence
  Description of Artificial Sequence: Synthetic oligonucleotide
uguuaucguugguacaga

SEQ ID NO: 46599 - RNA, 18 nt, Artificial Sequence
  Description of Artificial Sequence: Synthetic oligonucleotide
ugguauguuaucguuggu

SEQ ID NO: 46600 - RNA, 18 nt, Artificial Sequence
  Description of Artificial Sequence: Synthetic oligonucleotide
gcagauguucucaaugaa

SEQ ID NO: 46601 - RNA, 18 nt, Artificial Sequence
  Description of Artificial Sequence: Synthetic oligonucleotide
ggagggcagauguucuca

SEQ ID NO: 46602 - RNA, 18 nt, Artificial Sequence
  Description of Artificial Sequence: Synthetic oligonucleotide
ggcagggagggcagaugu

SEQ ID NO: 46603 - RNA, 18 nt, Artificial Sequence
  Description of Artificial Sequence: Synthetic oligonucleotide
cuuagggcagggagggca

SEQ ID NO: 46604 - RNA, 18 nt, Artificial Sequence
  Description of Artificial Sequence: Synthetic oligonucleotide
uugggcuuagggcaggga

SEQ ID NO: 46605 - RNA, 18 nt, Artificial Sequence
  Description of Artificial Sequence: Synthetic oligonucleotide
gagcauugggcuuagggc

SEQ ID NO: 46606 - RNA, 18 nt, Artificial Sequence
  Description of Artificial Sequence: Synthetic oligonucleotide
ggagagagcauugggcuu

SEQ ID NO: 46607 - RNA, 18 nt, Artificial Sequence
  Description of Artificial Sequence: Synthetic oligonucleotide
aaagaggagagagcauug

SEQ ID NO: 46608 - RNA, 18 nt, Artificial Sequence
  Description of Artificial Sequence: Synthetic oligonucleotide
gagguaaagaggagagag

SEQ ID NO: 46609 - RNA, 18 nt, Artificial Sequence
  Description of Artificial Sequence: Synthetic oligonucleotide
gggaggagguaaagagga

SEQ ID NO: 46610 - RNA, 18 nt, Artificial Sequence
  Description of Artificial Sequence: Synthetic oligonucleotide
agggugggaggagguaaa

SEQ ID NO: 46611 - RNA, 18 nt, Artificial Sequence
  Description of Artificial Sequence: Synthetic oligonucleotide
gagagagggugggaggag

SEQ ID NO: 46612 - RNA, 18 nt, Artificial Sequence
  Description of Artificial Sequence: Synthetic oligonucleotide
guggagagagaggguggg

SEQ ID NO: 46613 - RNA, 18 nt, Artificial Sequence
  Description of Artificial Sequence: Synthetic oligonucleotide
agacaguggagagagagg

SEQ ID NO: 46614 - RNA, 18 nt, Artificial Sequence
  Description of Artificial Sequence: Synthetic oligonucleotide
cuaagagacaguggagag

SEQ ID NO: 46615 - RNA, 18 nt, Artificial Sequence
  Description of Artificial Sequence: Synthetic oligonucleotide
acagacuaagagacagug

SEQ ID NO: 46616 - RNA, 18 nt, Artificial Sequence
  Description of Artificial Sequence: Synthetic oligonucleotide
aggacacagacuaagaga

SEQ ID NO: 46617 - RNA, 18 nt, Artificial Sequence
  Description of Artificial Sequence: Synthetic oligonucleotide
gggagaggacacagacua

SEQ ID NO: 46618 - RNA, 18 nt, Artificial Sequence
  Description of Artificial Sequence: Synthetic oligonucleotide
gagcagggagaggacaca

SEQ ID NO: 46619 - RNA, 18 nt, Artificial Sequence
  Description of Artificial Sequence: Synthetic oligonucleotide
auguggagcagggagagg

SEQ ID NO: 46620 - RNA, 18 nt, Artificial Sequence
  Description of Artificial Sequence: Synthetic oligonucleotide
gacaaauguggagcaggg

SEQ ID NO: 46621 - RNA, 18 nt, Artificial Sequence
  Description of Artificial Sequence: Synthetic oligonucleotide
aaggagacaaauguggag

SEQ ID NO: 46622 - RNA, 18 nt, Artificial Sequence
  Description of Artificial Sequence: Synthetic oligonucleotide
guacaaaggagacaaaug

SEQ ID NO: 46623 - RNA, 18 nt, Artificial Sequence
  Description of Artificial Sequence: Synthetic oligonucleotide
cccagguacaaaggagac

SEQ ID NO: 46624 - RNA, 18 nt, Artificial Sequence
  Description of Artificial Sequence: Synthetic oligonucleotide
guucccccagguacaaag

SEQ ID NO: 46625 - RNA, 18 nt, Artificial Sequence
  Description of Artificial Sequence: Synthetic oligonucleotide
ucucuguucccccaggua

SEQ ID NO: 46626 - RNA, 18 nt, Artificial Sequence
  Description of Artificial Sequence: Synthetic oligonucleotide
auuccucucuguuccccc

SEQ ID NO: 46627 - RNA, 18 nt, Artificial Sequence
  Description of Artificial Sequence: Synthetic oligonucleotide
agggcauuccucucuguu

SEQ ID NO: 46628 - RNA, 18 nt, Artificial Sequence
  Description of Artificial Sequence: Synthetic oligonucleotide
aagucagggcauuccucu

SEQ ID NO: 46629 - RNA, 18 nt, Artificial Sequence
  Description of Artificial Sequence: Synthetic oligonucleotide
aagaaaagucagggcauu

SEQ ID NO: 46630 - RNA, 18 nt, Artificial Sequence
  Description of Artificial Sequence: Synthetic oligonucleotide
agucaaagaaaagucagg

SEQ ID NO: 46631 - RNA, 18 nt, Artificial Sequence
  Description of Artificial Sequence: Synthetic oligonucleotide
cagacagucaaagaaaag

SEQ ID NO: 46632 - RNA, 18 nt, Artificial Sequence
  Description of Artificial Sequence: Synthetic oligonucleotide
uuuuccagacagucaaag

SEQ ID NO: 46633 - RNA, 18 nt, Artificial Sequence
  Description of Artificial Sequence: Synthetic oligonucleotide
ucccauuuuccagacagu

SEQ ID NO: 46634 - RNA, 18 nt, Artificial Sequence
  Description of Artificial Sequence: Synthetic oligonucleotide
uugacucccauuuuccag

SEQ ID NO: 46635 - RNA, 18 nt, Artificial Sequence
  Description of Artificial Sequence: Synthetic oligonucleotide
cacacuugacucccauuu

SEQ ID NO: 46636 - RNA, 18 nt, Artificial Sequence
  Description of Artificial Sequence: Synthetic oligonucleotide
cuccccacacuugacucc

SEQ ID NO: 46637 - RNA, 18 nt, Artificial Sequence
  Description of Artificial Sequence: Synthetic oligonucleotide
aaugacuccccacacuug

SEQ ID NO: 46638 - RNA, 18 nt, Artificial Sequence
  Description of Artificial Sequence: Synthetic oligonucleotide
aagugaaugacuccccac

SEQ ID NO: 46639 - RNA, 18 nt, Artificial Sequence
  Description of Artificial Sequence: Synthetic oligonucleotide
aaaugaagugaaugacuc

SEQ ID NO: 46640 - RNA, 18 nt, Artificial Sequence
  Description of Artificial Sequence: Synthetic oligonucleotide
caugcaaaugaagugaau

SEQ ID NO: 46641 - RNA, 18 nt, Artificial Sequence
  Description of Artificial Sequence: Synthetic oligonucleotide
ugcagcaugcaaaugaag

SEQ ID NO: 46642 - RNA, 18 nt, Artificial Sequence
  Description of Artificial Sequence: Synthetic oligonucleotide
uguuuugcagcaugcaaa

SEQ ID NO: 46643 - RNA, 18 nt, Artificial Sequence
  Description of Artificial Sequence: Synthetic oligonucleotide
cccucuguuuugcagcau

SEQ ID NO: 46644 - RNA, 18 nt, Artificial Sequence
  Description of Artificial Sequence: Synthetic oligonucleotide
cuccgcccucuguuuugc

SEQ ID NO: 46645 - RNA, 18 nt, Artificial Sequence
  Description of Artificial Sequence: Synthetic oligonucleotide
ggugccuccgcccucugu

SEQ ID NO: 46646 - RNA, 18 nt, Artificial Sequence
  Description of Artificial Sequence: Synthetic oligonucleotide
ucccuggugccuccgccc

SEQ ID NO: 46647 - RNA, 18 nt, Artificial Sequence
  Description of Artificial Sequence: Synthetic oligonucleotide
gccuuucccuggugccuc

SEQ ID NO: 46648 - RNA, 18 nt, Artificial Sequence
  Description of Artificial Sequence: Synthetic oligonucleotide
caagugccuuucccuggu

SEQ ID NO: 46649 - RNA, 18 nt, Artificial Sequence
  Description of Artificial Sequence: Synthetic oligonucleotide
ucauucaagugccuuucc

SEQ ID NO: 46650 - RNA, 18 nt, Artificial Sequence
  Description of Artificial Sequence: Synthetic oligonucleotide
cuucuucauucaagugcc

SEQ ID NO: 46651 - RNA, 18 nt, Artificial Sequence
  Description of Artificial Sequence: Synthetic oligonucleotide
uuuuccuucuucauucaa

SEQ ID NO: 46652 - RNA, 18 nt, Artificial Sequence
  Description of Artificial Sequence: Synthetic oligonucleotide
ucucauuuuccuucuuca

SEQ ID NO: 46653 - RNA, 18 nt, Artificial Sequence
  Description of Artificial Sequence: Synthetic oligonucleotide
cugguucucauuuuccuu

SEQ ID NO: 46654 - RNA, 18 nt, Artificial Sequence
  Description of Artificial Sequence: Synthetic oligonucleotide
acaaucugguucucauuu

SEQ ID NO: 46655 - RNA, 18 nt, Artificial Sequence
  Description of Artificial Sequence: Synthetic oligonucleotide
aaguuacaaucugguucu

SEQ ID NO: 46656 - RNA, 18 nt, Artificial Sequence
  Description of Artificial Sequence: Synthetic oligonucleotide
ggacgaaguuacaaucug

SEQ ID NO: 46657 - RNA, 18 nt, Artificial Sequence
  Description of Artificial Sequence: Synthetic oligonucleotide
gauuaggacgaaguuaca

SEQ ID NO: 46658 - RNA, 18 nt, Artificial Sequence
  Description of Artificial Sequence: Synthetic oligonucleotide
agguggauuaggacgaag

SEQ ID NO: 46659 - RNA, 18 nt, Artificial Sequence
  Description of Artificial Sequence: Synthetic oligonucleotide
cuggcagguggauuagga

SEQ ID NO: 46660 - RNA, 18 nt, Artificial Sequence
  Description of Artificial Sequence: Synthetic oligonucleotide
aaguucuggcagguggau

SEQ ID NO: 46661 - RNA, 18 nt, Artificial Sequence
  Description of Artificial Sequence: Synthetic oligonucleotide
aaggaaaguucuggcagg

SEQ ID NO: 46662 - RNA, 18 nt, Artificial Sequence
  Description of Artificial Sequence: Synthetic oligonucleotide
accugaaggaaaguucug

SEQ ID NO: 46663 - RNA, 18 nt, Artificial Sequence
  Description of Artificial Sequence: Synthetic oligonucleotide
gugacaccugaaggaaag

SEQ ID NO: 46664 - RNA, 18 nt, Artificial Sequence
  Description of Artificial Sequence: Synthetic oligonucleotide
gaugugugacaccugaag

SEQ ID NO: 46665 - RNA, 18 nt, Artificial Sequence
  Description of Artificial Sequence: Synthetic oligonucleotide
aaauggaugugugacacc

SEQ ID NO: 46666 - RNA, 18 nt, Artificial Sequence
  Description of Artificial Sequence: Synthetic oligonucleotide
gauggaaauggaugugug

SEQ ID NO: 46667 - RNA, 18 nt, Artificial Sequence
  Description of Artificial Sequence: Synthetic oligonucleotide
auuaggauggaaauggau

SEQ ID NO: 46668 - RNA, 18 nt, Artificial Sequence
  Description of Artificial Sequence: Synthetic oligonucleotide
uuaauauuaggauggaaa

SEQ ID NO: 46669 - RNA, 18 nt, Artificial Sequence
  Description of Artificial Sequence: Synthetic oligonucleotide
auuguuuaauauuaggau

SEQ ID NO: 46670 - RNA, 18 nt, Artificial Sequence
  Description of Artificial Sequence: Synthetic oligonucleotide
auuauauuguuuaauauu

SEQ ID NO: 46671 - RNA, 18 nt, Artificial Sequence
  Description of Artificial Sequence: Synthetic oligonucleotide
cuuucauuauauuguuua

SEQ ID NO: 46672 - RNA, 18 nt, Artificial Sequence
  Description of Artificial Sequence: Synthetic oligonucleotide
gcuuucuuucauuauauu

SEQ ID NO: 46673 - RNA, 18 nt, Artificial Sequence
  Description of Artificial Sequence: Synthetic oligonucleotide
gaugugugacaccugaag

SEQ ID NO: 46674 - RNA, 18 nt, Artificial Sequence
  Description of Artificial Sequence: Synthetic oligonucleotide
aaauggaugugugacacc

SEQ ID NO: 46675 - RNA, 18 nt, Artificial Sequence
  Description of Artificial Sequence: Synthetic oligonucleotide
gauggaaauggaugugug

SEQ ID NO: 46676 - RNA, 18 nt, Artificial Sequence
  Description of Artificial Sequence: Synthetic oligonucleotide
auuaggauggaaauggau

SEQ ID NO: 46677 - RNA, 18 nt, Artificial Sequence
  Description of Artificial Sequence: Synthetic oligonucleotide
uuaauauuaggauggaaa

SEQ ID NO: 46678 - RNA, 18 nt, Artificial Sequence
  Description of Artificial Sequence: Synthetic oligonucleotide
auuguuuaauauuaggau

SEQ ID NO: 46679 - RNA, 18 nt, Artificial Sequence
  Description of Artificial Sequence: Synthetic oligonucleotide
auuauauuguuuaauauu

SEQ ID NO: 46680 - RNA, 18 nt, Artificial Sequence
  Description of Artificial Sequence: Synthetic oligonucleotide
cuuucauuauauuguuua

SEQ ID NO: 46681 - RNA, 18 nt, Artificial Sequence
  Description of Artificial Sequence: Synthetic oligonucleotide
gcuuucuuucauuauauu

SEQ ID NO: 46682 - RNA, 18 nt, Artificial Sequence
  Description of Artificial Sequence: Synthetic oligonucleotide
guaaagcuuucuuucauu

SEQ ID NO: 46683 - RNA, 18 nt, Artificial Sequence
  Description of Artificial Sequence: Synthetic oligonucleotide
uuguuguaaagcuuucuu

SEQ ID NO: 46684 - RNA, 18 nt, Artificial Sequence
  Description of Artificial Sequence: Synthetic oligonucleotide
uagacuuguuguaaagcu

SEQ ID NO: 46685 - RNA, 18 nt, Artificial Sequence
  Description of Artificial Sequence: Synthetic oligonucleotide
cuauuuagacuuguugua

SEQ ID NO: 46686 - RNA, 18 nt, Artificial Sequence
  Description of Artificial Sequence: Synthetic oligonucleotide
aaaaacuauuuagacuug

SEQ ID NO: 46687 - RNA, 18 nt, Artificial Sequence
  Description of Artificial Sequence: Synthetic oligonucleotide
aaaauaaaaacuauuuag

SEQ ID NO: 46688 - RNA, 18 nt, Artificial Sequence
  Description of Artificial Sequence: Synthetic oligonucleotide
gcccgaaaauaaaaacua

SEQ ID NO: 46689 - RNA, 18 nt, Artificial Sequence
  Description of Artificial Sequence: Synthetic oligonucleotide
agacugcccgaaaauaaa

SEQ ID NO: 46690 - RNA, 18 nt, Artificial Sequence
  Description of Artificial Sequence: Synthetic oligonucleotide
uuaaaagacugcccgaaa

SEQ ID NO: 46691 - RNA, 18 nt, Artificial Sequence
  Description of Artificial Sequence: Synthetic oligonucleotide
cuuuguuaaaagacugcc

SEQ ID NO: 46692 - RNA, 18 nt, Artificial Sequence
  Description of Artificial Sequence: Synthetic oligonucleotide
cuuugcuuuguuaaaaga

SEQ ID NO: 46693 - RNA, 18 nt, Artificial Sequence
  Description of Artificial Sequence: Synthetic oligonucleotide
gguugcuuugcuuuguua

SEQ ID NO: 46694 - RNA, 18 nt, Artificial Sequence
  Description of Artificial Sequence: Synthetic oligonucleotide
cacacgguugcuuugcuu

SEQ ID NO: 46695 - RNA, 18 nt, Artificial Sequence
  Description of Artificial Sequence: Synthetic oligonucleotide
uaacucacacgguugcuu

SEQ ID NO: 46696 - RNA, 18 nt, Artificial Sequence
  Description of Artificial Sequence: Synthetic oligonucleotide
ugaccuaacucacacggu

SEQ ID NO: 46697 - RNA, 18 nt, Artificial Sequence
  Description of Artificial Sequence: Synthetic oligonucleotide
ucuggugaccuaacucac

SEQ ID NO: 46698 - RNA, 18 nt, Artificial Sequence
  Description of Artificial Sequence: Synthetic oligonucleotide
gugucucuggugaccuaa

SEQ ID NO: 46699 - RNA, 18 nt, Artificial Sequence
  Description of Artificial Sequence: Synthetic oligonucleotide
gcuuggugucucugguga

SEQ ID NO: 46700 - RNA, 18 nt, Artificial Sequence
  Description of Artificial Sequence: Synthetic oligonucleotide
ccauugcuuggugucucu

SEQ ID NO: 46701 - RNA, 18 nt, Artificial Sequence
  Description of Artificial Sequence: Synthetic oligonucleotide
cuucaccauugcuuggug

SEQ ID NO: 46702 - RNA, 18 nt, Artificial Sequence
  Description of Artificial Sequence: Synthetic oligonucleotide
ggguccuucaccauugcu

SEQ ID NO: 46703 - RNA, 18 nt, Artificial Sequence
  Description of Artificial Sequence: Synthetic oligonucleotide
agagaauugggcggaggg

SEQ ID NO: 46704 - RNA, 18 nt, Artificial Sequence
  Description of Artificial Sequence: Synthetic oligonucleotide
ggauagagaauugggcgg

SEQ ID NO: 46705 - RNA, 18 nt, Artificial Sequence
  Description of Artificial Sequence: Synthetic oligonucleotide
uaguuggauagagaauug

SEQ ID NO: 46706 - RNA, 18 nt, Artificial Sequence
  Description of Artificial Sequence: Synthetic oligonucleotide
aaauuuaguuggauagag

SEQ ID NO: 46707 - RNA, 18 nt, Artificial Sequence
  Description of Artificial Sequence: Synthetic oligonucleotide
cauggaaauuuaguugga

SEQ ID NO: 46708 - RNA, 18 nt, Artificial Sequence
  Description of Artificial Sequence: Synthetic oligonucleotide
uugggcauggaaauuuag

SEQ ID NO: 46709 - RNA, 18 nt, Artificial Sequence
  Description of Artificial Sequence: Synthetic oligonucleotide
ucacuuugggcauggaaa

SEQ ID NO: 46710 - RNA, 18 nt, Artificial Sequence
  Description of Artificial Sequence: Synthetic oligonucleotide
agcuaucacuuugggcau

SEQ ID NO: 46711 - RNA, 18 nt, Artificial Sequence
  Description of Artificial Sequence: Synthetic oligonucleotide
augauagcuaucacuuug

SEQ ID NO: 46712 - RNA, 18 nt, Artificial Sequence
  Description of Artificial Sequence: Synthetic oligonucleotide
aaaaaaugauagcuauca

SEQ ID NO: 46713 - RNA, 18 nt, Artificial Sequence
  Description of Artificial Sequence: Synthetic oligonucleotide
cguggaaaaaaugauagc

SEQ ID NO: 46714 - RNA, 18 nt, Artificial Sequence
  Description of Artificial Sequence: Synthetic oligonucleotide
uacaccguggaaaaaaug

SEQ ID NO: 46715 - RNA, 18 nt, Artificial Sequence
  Description of Artificial Sequence: Synthetic oligonucleotide
gcagauacaccguggaaa

SEQ ID NO: 46716 - RNA, 18 nt, Artificial Sequence
  Description of Artificial Sequence: Synthetic oligonucleotide
gauuugcagauacaccgu

SEQ ID NO: 46717 - RNA, 18 nt, Artificial Sequence
  Description of Artificial Sequence: Synthetic oligonucleotide
ggguggauuugcagauac

SEQ ID NO: 46718 - RNA, 18 nt, Artificial Sequence
  Description of Artificial Sequence: Synthetic oligonucleotide
acaguggguggauuugca

SEQ ID NO: 46719 - RNA, 18 nt, Artificial Sequence
  Description of Artificial Sequence: Synthetic oligonucleotide
ccgggacaguggguggau

SEQ ID NO: 46720 - RNA, 18 nt, Artificial Sequence
  Description of Artificial Sequence: Synthetic oligonucleotide
ccaccccgggacaguggg

SEQ ID NO: 46721 - RNA, 18 nt, Artificial Sequence
  Description of Artificial Sequence: Synthetic oligonucleotide
cccagccaccccgggaca

SEQ ID NO: 46722 - RNA, 18 nt, Artificial Sequence
  Description of Artificial Sequence: Synthetic oligonucleotide
aagcucccagccaccccg

SEQ ID NO: 46723 - RNA, 18 nt, Artificial Sequence
  Description of Artificial Sequence: Synthetic oligonucleotide
uuaaaaagcucccagcca

SEQ ID NO: 46724 - RNA, 18 nt, Artificial Sequence
  Description of Artificial Sequence: Synthetic oligonucleotide
acccguuaaaaagcuccc

SEQ ID NO: 46725 - RNA, 18 nt, Artificial Sequence
  Description of Artificial Sequence: Synthetic oligonucleotide
ucucaacccguuaaaaag

SEQ ID NO: 46726 - RNA, 18 nt, Artificial Sequence
  Description of Artificial Sequence: Synthetic oligonucleotide
gcaacucucaacccguua

SEQ ID NO: 46727 - RNA, 18 nt, Artificial Sequence
  Description of Artificial Sequence: Synthetic oligonucleotide
aaaaagcaacucucaacc

SEQ ID NO: 46728 - RNA, 18 nt, Artificial Sequence
  Description of Artificial Sequence: Synthetic oligonucleotide
accuuaaaaagcaacucu

SEQ ID NO: 46729 - RNA, 18 nt, Artificial Sequence
  Description of Artificial Sequence: Synthetic oligonucleotide
ccacaaccuuaaaaagca

SEQ ID NO: 46730 - RNA, 18 nt, Artificial Sequence
  Description of Artificial Sequence: Synthetic oligonucleotide
cucacccacaaccuuaaa

SEQ ID NO: 46731 - RNA, 18 nt, Artificial Sequence
  Description of Artificial Sequence: Synthetic oligonucleotide
cucagcucacccacaacc

SEQ ID NO: 46732 - RNA, 18 nt, Artificial Sequence
  Description of Artificial Sequence: Synthetic oligonucleotide
cccaucucagcucaccca

SEQ ID NO: 46733 - RNA, 18 nt, Artificial Sequence
  Description of Artificial Sequence: Synthetic oligonucleotide
agucacccaucucagcuc

SEQ ID NO: 46734 - RNA, 18 nt, Artificial Sequence
  Description of Artificial Sequence: Synthetic oligonucleotide
gacacagucacccaucuc

SEQ ID NO: 46735 - RNA, 18 nt, Artificial Sequence
  Description of Artificial Sequence: Synthetic oligonucleotide
cugaagacacagucaccc

SEQ ID NO: 46736 - RNA, 18 nt, Artificial Sequence
  Description of Artificial Sequence: Synthetic oligonucleotide
gucuccugaagacacagu

SEQ ID NO: 46737 - RNA, 18 nt, Artificial Sequence
  Description of Artificial Sequence: Synthetic oligonucleotide
guagugucuccugaagac

SEQ ID NO: 46738 - RNA, 18 nt, Artificial Sequence
  Description of Artificial Sequence: Synthetic oligonucleotide
aaaugguagugucuccug

SEQ ID NO: 46739 - RNA, 18 nt, Artificial Sequence
  Description of Artificial Sequence: Synthetic oligonucleotide
aaaccaaaugguaguguc

SEQ ID NO: 46740 - RNA, 18 nt, Artificial Sequence
  Description of Artificial Sequence: Synthetic oligonucleotide
aaaucaaaccaaauggua

SEQ ID NO: 46741 - RNA, 18 nt, Artificial Sequence
  Description of Artificial Sequence: Synthetic oligonucleotide
cucuguuuauugaugaca

SEQ ID NO: 46742 - RNA, 18 nt, Artificial Sequence
  Description of Artificial Sequence: Synthetic oligonucleotide
aagaacucuguuuauuga

SEQ ID NO: 46743 - RNA, 18 nt, Artificial Sequence
  Description of Artificial Sequence: Synthetic oligonucleotide
uugcgaagaacucuguuu

SEQ ID NO: 46744 - RNA, 18 nt, Artificial Sequence
  Description of Artificial Sequence: Synthetic oligonucleotide
ccagguugcgaagaacuc

SEQ ID NO: 46745 - RNA, 18 nt, Artificial Sequence
  Description of Artificial Sequence: Synthetic oligonucleotide
gcuagccagguugcgaag

SEQ ID NO: 46746 - RNA, 18 nt, Artificial Sequence
  Description of Artificial Sequence: Synthetic oligonucleotide
uuuucgcuagccagguug

SEQ ID NO: 46747 - RNA, 18 nt, Artificial Sequence
  Description of Artificial Sequence: Synthetic oligonucleotide
guugcuuuucgcuagcca

SEQ ID NO: 46748 - RNA, 18 nt, Artificial Sequence
  Description of Artificial Sequence: Synthetic oligonucleotide
caucuguugcuuuucgcu

SEQ ID NO: 46749 - RNA, 18 nt, Artificial Sequence
  Description of Artificial Sequence: Synthetic oligonucleotide
gcgcccaucuguugcuuu

SEQ ID NO: 46750 - RNA, 18 nt, Artificial Sequence
  Description of Artificial Sequence: Synthetic oligonucleotide
cgucugcgcccaucuguu

SEQ ID NO: 46751 - RNA, 18 nt, Artificial Sequence
  Description of Artificial Sequence: Synthetic oligonucleotide
caugccgucugcgcccau

SEQ ID NO: 46752 - RNA, 18 nt, Artificial Sequence
  Description of Artificial Sequence: Synthetic oligonucleotide
ucauacaugccgucugcg

SEQ ID NO: 46753 - RNA, 18 nt, Artificial Sequence
  Description of Artificial Sequence: Synthetic oligonucleotide
guuuaucauacaugccgu

SEQ ID NO: 46754 - RNA, 18 nt, Artificial Sequence
  Description of Artificial Sequence: Synthetic oligonucleotide
ccuuaguuuaucauacau

SEQ ID NO: 46755 - RNA, 18 nt, Artificial Sequence
  Description of Artificial Sequence: Synthetic oligonucleotide
aacauccuuaguuuauca

SEQ ID NO: 46756 - RNA, 18 nt, Artificial Sequence
  Description of Artificial Sequence: Synthetic oligonucleotide
cguucaacauccuuaguu

SEQ ID NO: 46757 - RNA, 18 nt, Artificial Sequence
  Description of Artificial Sequence: Synthetic oligonucleotide
cugcccguucaacauccu

SEQ ID NO: 46758 - RNA, 18 nt, Artificial Sequence
  Description of Artificial Sequence: Synthetic oligonucleotide
ccggucugcccguucaac

SEQ ID NO: 46759 - RNA, 18 nt, Artificial Sequence
  Description of Artificial Sequence: Synthetic oligonucleotide
agcuuccggucugcccgu

SEQ ID NO: 46760 - RNA, 18 nt, Artificial Sequence
  Description of Artificial Sequence: Synthetic oligonucleotide
gccccagcuuccggucug

SEQ ID NO: 46761 - RNA, 18 nt, Artificial Sequence
  Description of Artificial Sequence: Synthetic oligonucleotide
cgggugccccagcuuccg

SEQ ID NO: 46762 - RNA, 18 nt, Artificial Sequence
  Description of Artificial Sequence: Synthetic oligonucleotide
cagggcgggugccccagc

SEQ ID NO: 46763 - RNA, 18 nt, Artificial Sequence
  Description of Artificial Sequence: Synthetic oligonucleotide
ccaaccagggcgggugcc

SEQ ID NO: 46764 - RNA, 18 nt, Artificial Sequence
  Description of Artificial Sequence: Synthetic oligonucleotide
ggauaccaaccagggcgg

SEQ ID NO: 46765 - RNA, 18 nt, Artificial Sequence
  Description of Artificial Sequence: Synthetic oligonucleotide
uccccggauaccaaccag

SEQ ID NO: 46766 - RNA, 18 nt, Artificial Sequence
  Description of Artificial Sequence: Synthetic oligonucleotide
cgaaguccccggauacca

SEQ ID NO: 46767 - RNA, 18 nt, Artificial Sequence
  Description of Artificial Sequence: Synthetic oligonucleotide
ggcaccgaaguccccgga

SEQ ID NO: 46768 - RNA, 18 nt, Artificial Sequence
  Description of Artificial Sequence: Synthetic oligonucleotide
gcccuggcaccgaagucc

SEQ ID NO: 46769 - RNA, 18 nt, Artificial Sequence
  Description of Artificial Sequence: Synthetic oligonucleotide
agguugcccuggcaccga

SEQ ID NO: 46770 - RNA, 18 nt, Artificial Sequence
  Description of Artificial Sequence: Synthetic oligonucleotide
ugcguagguugcccuggc

SEQ ID NO: 46771 - RNA, 18 nt, Artificial Sequence
  Description of Artificial Sequence: Synthetic oligonucleotide
gccgcgggauuccacggg

SEQ ID NO: 46772 - RNA, 18 nt, Artificial Sequence
  Description of Artificial Sequence: Synthetic oligonucleotide
augcuggcucuggcuggg

SEQ ID NO: 46773 - RNA, 18 nt, Artificial Sequence
  Description of Artificial Sequence: Synthetic oligonucleotide
ucugcaugcuggcucugg

SEQ ID NO: 46774 - RNA, 18 nt, Artificial Sequence
  Description of Artificial Sequence: Synthetic oligonucleotide
ccagaaagaccagaggca

SEQ ID NO: 46775 - RNA, 18 nt, Artificial Sequence
  Description of Artificial Sequence: Synthetic oligonucleotide
aagucccagaaagaccag

SEQ ID NO: 46776 - RNA, 18 nt, Artificial Sequence
  Description of Artificial Sequence: Synthetic oligonucleotide
gcccgaagucccagaaag

SEQ ID NO: 46777 - RNA, 18 nt, Artificial Sequence
  Description of Artificial Sequence: Synthetic oligonucleotide
cccgagcccgaaguccca

SEQ ID NO: 46778 - RNA, 18 nt, Artificial Sequence
  Description of Artificial Sequence: Synthetic oligonucleotide
cgcaccccgagcccgaag

SEQ ID NO: 46779 - RNA, 18 nt, Artificial Sequence
  Description of Artificial Sequence: Synthetic oligonucleotide
guccgcgcaccccgagcc

SEQ ID NO: 46780 - RNA, 18 nt, Artificial Sequence
  Description of Artificial Sequence: Synthetic oligonucleotide
cucggguccgcgcacccc

SEQ ID NO: 46781 - RNA, 18 nt, Artificial Sequence
  Description of Artificial Sequence: Synthetic oligonucleotide
ugacccucggguccgcgc

SEQ ID NO: 46782 - RNA, 18 nt, Artificial Sequence
  Description of Artificial Sequence: Synthetic oligonucleotide
uccccugacccucggguc

SEQ ID NO: 46783 - RNA, 18 nt, Artificial Sequence
  Description of Artificial Sequence: Synthetic oligonucleotide
uguccuccccugacccuc

SEQ ID NO: 46784 - RNA, 18 nt, Artificial Sequence
  Description of Artificial Sequence: Synthetic oligonucleotide
cccuguguccuccccuga

SEQ ID NO: 46785 - RNA, 18 nt, Artificial Sequence
  Description of Artificial Sequence: Synthetic oligonucleotide
cgagucccuguguccucc

SEQ ID NO: 46786 - RNA, 18 nt, Artificial Sequence
  Description of Artificial Sequence: Synthetic oligonucleotide
cgucgcgagucccugugu

SEQ ID NO: 46787 - RNA, 18 nt, Artificial Sequence
  Description of Artificial Sequence: Synthetic oligonucleotide
gcgggcgucgcgaguccc

SEQ ID NO: 46788 - RNA, 18 nt, Artificial Sequence
  Description of Artificial Sequence: Synthetic oligonucleotide
ccagcgcgggcgucgcga

SEQ ID NO: 46789 - RNA, 18 nt, Artificial Sequence
  Description of Artificial Sequence: Synthetic oligonucleotide
ccgggccagcgcgggcgu

SEQ ID NO: 46790 - RNA, 18 nt, Artificial Sequence
  Description of Artificial Sequence: Synthetic oligonucleotide
ggcggccgggccagcgcg

SEQ ID NO: 46791 - RNA, 18 nt, Artificial Sequence
  Description of Artificial Sequence: Synthetic oligonucleotide
cggucggcggccgggcca

SEQ ID NO: 46792 - RNA, 18 nt, Artificial Sequence
  Description of Artificial Sequence: Synthetic oligonucleotide
ucagucggucggcggccg

SEQ ID NO: 46793 - RNA, 18 nt, Artificial Sequence
  Description of Artificial Sequence: Synthetic oligonucleotide
gggccucagucggucggc

SEQ ID NO: 46794 - RNA, 18 nt, Artificial Sequence
  Description of Artificial Sequence: Synthetic oligonucleotide
uccccgggccucagucgg

SEQ ID NO: 46795 - RNA, 18 nt, Artificial Sequence
  Description of Artificial Sequence: Synthetic oligonucleotide
gcagguccccgggccuca

SEQ ID NO: 46796 - RNA, 18 nt, Artificial Sequence
  Description of Artificial Sequence: Synthetic oligonucleotide
ccgccgcagguccccggg

SEQ ID NO: 46797 - RNA, 18 nt, Artificial Sequence
  Description of Artificial Sequence: Synthetic oligonucleotide
agcagccgccgcaggucc

SEQ ID NO: 46798 - RNA, 18 nt, Artificial Sequence
  Description of Artificial Sequence: Synthetic oligonucleotide
gggagcagccgccgcagg

SEQ ID NO: 46799 - RNA, 18 nt, Artificial Sequence
  Description of Artificial Sequence: Synthetic oligonucleotide
ugccgggcgcggagcggg

SEQ ID NO: 46800 - RNA, 18 nt, Artificial Sequence
  Description of Artificial Sequence: Synthetic oligonucleotide
cgggcugccgggcgcgga

SEQ ID NO: 46801 - RNA, 18 nt, Artificial Sequence
  Description of Artificial Sequence: Synthetic oligonucleotide
ccucccgggcugccgggc

SEQ ID NO: 46802 - RNA, 18 nt, Artificial Sequence
  Description of Artificial Sequence: Synthetic oligonucleotide
ccuccccucccgggcugc

SEQ ID NO: 46803 - RNA, 18 nt, Artificial Sequence
  Description of Artificial Sequence: Synthetic oligonucleotide
aacgcccuccccucccgg

SEQ ID NO: 46804 - RNA, 18 nt, Artificial Sequence
  Description of Artificial Sequence: Synthetic oligonucleotide
aagcaaacgcccuccccu

SEQ ID NO: 46805 - RNA, 18 nt, Artificial Sequence
  Description of Artificial Sequence: Synthetic oligonucleotide
gagccaagcaaacgcccu

SEQ ID NO: 46806 - RNA, 18 nt, Artificial Sequence
  Description of Artificial Sequence: Synthetic oligonucleotide
gagaagagccaagcaaac

SEQ ID NO: 46807 - RNA, 18 nt, Artificial Sequence
  Description of Artificial Sequence: Synthetic oligonucleotide
guaucgagaagagccaag

SEQ ID NO: 46808 - RNA, 18 nt, Artificial Sequence
  Description of Artificial Sequence: Synthetic oligonucleotide
cuccaguaucgagaagag

SEQ ID NO: 46809 - RNA, 18 nt, Artificial Sequence
  Description of Artificial Sequence: Synthetic oligonucleotide
ugcuucuccaguaucgag

SEQ ID NO: 46810 - RNA, 18 nt, Artificial Sequence
  Description of Artificial Sequence: Synthetic oligonucleotide
gccccugcuucuccagua

SEQ ID NO: 46811 - RNA, 18 nt, Artificial Sequence
  Description of Artificial Sequence: Synthetic oligonucleotide
gcccagccccugcuucuc

SEQ ID NO: 46812 - RNA, 18 nt, Artificial Sequence
  Description of Artificial Sequence: Synthetic oligonucleotide
uaagggcccagccccugc

SEQ ID NO: 46813 - RNA, 18 nt, Artificial Sequence
  Description of Artificial Sequence: Synthetic oligonucleotide
guucuuaagggcccagcc

SEQ ID NO: 46814 - RNA, 18 nt, Artificial Sequence
  Description of Artificial Sequence: Synthetic oligonucleotide
gggcuguucuuaagggcc

SEQ ID NO: 46815 - RNA, 18 nt, Artificial Sequence
  Description of Artificial Sequence: Synthetic oligonucleotide
cgggcgggcuguucuuaa

SEQ ID NO: 46816 - RNA, 18 nt, Artificial Sequence
  Description of Artificial Sequence: Synthetic oligonucleotide
aaacucgggcgggcuguu

SEQ ID NO: 46817 - RNA, 18 nt, Artificial Sequence
  Description of Artificial Sequence: Synthetic oligonucleotide
uucgaaaacucgggcggg

SEQ ID NO: 46818 - RNA, 18 nt, Artificial Sequence
  Description of Artificial Sequence: Synthetic oligonucleotide
gcagcuucgaaaacucgg

SEQ ID NO: 46819 - RNA, 18 nt, Artificial Sequence
  Description of Artificial Sequence: Synthetic oligonucleotide
cuaccgcagcuucgaaaa

SEQ ID NO: 46820 - RNA, 18 nt, Artificial Sequence
  Description of Artificial Sequence: Synthetic oligonucleotide
uuucucuaccgcagcuuc

SEQ ID NO: 46821 - RNA, 18 nt, Artificial Sequence
  Description of Artificial Sequence: Synthetic oligonucleotide
ggguuucucuaccgcagc

SEQ ID NO: 46822 - RNA, 18 nt, Artificial Sequence
  Description of Artificial Sequence: Synthetic oligonucleotide
ugaguuacaggauuuggg

SEQ ID NO: 46823 - RNA, 18 nt, Artificial Sequence
  Description of Artificial Sequence: Synthetic oligonucleotide
gggugugaguuacaggau

SEQ ID NO: 46824 - RNA, 18 nt, Artificial Sequence
  Description of Artificial Sequence: Synthetic oligonucleotide
gggucagagcccgggcag

SEQ ID NO: 46825 - RNA, 18 nt, Artificial Sequence
  Description of Artificial Sequence: Synthetic oligonucleotide
ccagccccucucuccggg

SEQ ID NO: 46826 - RNA, 18 nt, Artificial Sequence
  Description of Artificial Sequence: Synthetic oligonucleotide
ucagcccagccccucucu

SEQ ID NO: 46827 - RNA, 18 nt, Artificial Sequence
  Description of Artificial Sequence: Synthetic oligonucleotide
ccugaucagcccagcccc

SEQ ID NO: 46828 - RNA, 18 nt, Artificial Sequence
  Description of Artificial Sequence: Synthetic oligonucleotide
cccgcccugaucagccca

SEQ ID NO: 46829 - RNA, 18 nt, Artificial Sequence
  Description of Artificial Sequence: Synthetic oligonucleotide
uucgccccgcccugauca

SEQ ID NO: 46830 - RNA, 18 nt, Artificial Sequence
  Description of Artificial Sequence: Synthetic oligonucleotide
aagacuucgccccgcccu

SEQ ID NO: 46831 - RNA, 18 nt, Artificial Sequence
  Description of Artificial Sequence: Synthetic oligonucleotide
aggagaagacuucgcccc

SEQ ID NO: 46832 - RNA, 18 nt, Artificial Sequence
  Description of Artificial Sequence: Synthetic oligonucleotide
caacuaggagaagacuuc

SEQ ID NO: 46833 - RNA, 18 nt, Artificial Sequence
  Description of Artificial Sequence: Synthetic oligonucleotide
ucgcucaacuaggagaag

SEQ ID NO: 46834 - RNA, 18 nt, Artificial Sequence
  Description of Artificial Sequence: Synthetic oligonucleotide
ccuucucgcucaacuagg

SEQ ID NO: 46835 - RNA, 18 nt, Artificial Sequence
  Description of Artificial Sequence: Synthetic oligonucleotide
ggccuccuucucgcucaa

SEQ ID NO: 46836 - RNA, 18 nt, Artificial Sequence
  Description of Artificial Sequence: Synthetic oligonucleotide
gggccuccuucucgcuca

SEQ ID NO: 46837 - RNA, 18 nt, Artificial Sequence
  Description of Artificial Sequence: Synthetic oligonucleotide
uuggcuaagcccaaaggg

SEQ ID NO: 46838 - RNA, 18 nt, Artificial Sequence
  Description of Artificial Sequence: Synthetic oligonucleotide
cagucuuggcuaagccca

SEQ ID NO: 46839 - RNA, 18 nt, Artificial Sequence
  Description of Artificial Sequence: Synthetic oligonucleotide
acuuucagucuuggcuaa

SEQ ID NO: 46840 - RNA, 18 nt, Artificial Sequence
  Description of Artificial Sequence: Synthetic oligonucleotide
uggagacuuucagucuug

SEQ ID NO: 46841 - RNA, 18 nt, Artificial Sequence
  Description of Artificial Sequence: Synthetic oligonucleotide
guugguggagacuuucag

SEQ ID NO: 46842 - RNA, 18 nt, Artificial Sequence
  Description of Artificial Sequence: Synthetic oligonucleotide
gccggguugguggagacu

SEQ ID NO: 46843 - RNA, 18 nt, Artificial Sequence
  Description of Artificial Sequence: Synthetic oligonucleotide
accccgccggguuggugg

SEQ ID NO: 46844 - RNA, 18 nt, Artificial Sequence
  Description of Artificial Sequence: Synthetic oligonucleotide
ccccaaccccgccggguu

SEQ ID NO: 46845 - RNA, 18 nt, Artificial Sequence
  Description of Artificial Sequence: Synthetic oligonucleotide
gaagcccccaaccccgcc

SEQ ID NO: 46846 - RNA, 18 nt, Artificial Sequence
  Description of Artificial Sequence: Synthetic oligonucleotide
ggagagaagcccccaacc

SEQ ID NO: 46847 - RNA, 18 nt, Artificial Sequence
  Description of Artificial Sequence: Synthetic oligonucleotide
gggagagaagcccccaac

SEQ ID NO: 46848 - RNA, 18 nt, Artificial Sequence
  Description of Artificial Sequence: Synthetic oligonucleotide
cccugagagugacuuggg

SEQ ID NO: 46849 - RNA, 18 nt, Artificial Sequence
  Description of Artificial Sequence: Synthetic oligonucleotide
agcugcccugagagugac

SEQ ID NO: 46850 - RNA, 18 nt, Artificial Sequence
  Description of Artificial Sequence: Synthetic oligonucleotide
ggaggagcugcccugaga

SEQ ID NO: 46851 - RNA, 18 nt, Artificial Sequence
  Description of Artificial Sequence: Synthetic oligonucleotide
gggaggagcugcccugag

SEQ ID NO: 46852 - RNA, 18 nt, Artificial Sequence
  Description of Artificial Sequence: Synthetic oligonucleotide
uucuaggcccguaguggg

SEQ ID NO: 46853 - RNA, 18 nt, Artificial Sequence
  Description of Artificial Sequence: Synthetic oligonucleotide
aucccuucuaggcccgua

SEQ ID NO: 46854 - RNA, 18 nt, Artificial Sequence
  Description of Artificial Sequence: Synthetic oligonucleotide
uccccaucccuucuaggc

SEQ ID NO: 46855 - RNA, 18 nt, Artificial Sequence
  Description of Artificial Sequence: Synthetic oligonucleotide
uggguucuacagauccca

SEQ ID NO: 46856 - RNA, 18 nt, Artificial Sequence
  Description of Artificial Sequence: Synthetic oligonucleotide
aaccauggguucuacaga

SEQ ID NO: 46857 - RNA, 18 nt, Artificial Sequence
  Description of Artificial Sequence: Synthetic oligonucleotide
ccgcaaaccauggguucu

SEQ ID NO: 46858 - RNA, 18 nt, Artificial Sequence
  Description of Artificial Sequence: Synthetic oligonucleotide
ugucaccgcaaaccaugg

SEQ ID NO: 46859 - RNA, 18 nt, Artificial Sequence
  Description of Artificial Sequence: Synthetic oligonucleotide
cugagugucaccgcaaac

SEQ ID NO: 46860 - RNA, 18 nt, Artificial Sequence
  Description of Artificial Sequence: Synthetic oligonucleotide
ccccucugagugucaccg

SEQ ID NO: 46861 - RNA, 18 nt, Artificial Sequence
  Description of Artificial Sequence: Synthetic oligonucleotide
aagauccccucugagugu

SEQ ID NO: 46862 - RNA, 18 nt, Artificial Sequence
  Description of Artificial Sequence: Synthetic oligonucleotide
ucccaaagauccccucug

SEQ ID NO: 46863 - RNA, 18 nt, Artificial Sequence
  Description of Artificial Sequence: Synthetic oligonucleotide
aaaucucccaaagauccc

SEQ ID NO: 46864 - RNA, 18 nt, Artificial Sequence
  Description of Artificial Sequence: Synthetic oligonucleotide
ucuauaaaucucccaaag

SEQ ID NO: 46865 - RNA, 18 nt, Artificial Sequence
  Description of Artificial Sequence: Synthetic oligonucleotide
ccggcucuauaaaucucc

SEQ ID NO: 46866 - RNA, 18 nt, Artificial Sequence
  Description of Artificial Sequence: Synthetic oligonucleotide
aagaaccggcucuauaaa

SEQ ID NO: 46867 - RNA, 18 nt, Artificial Sequence
  Description of Artificial Sequence: Synthetic oligonucleotide
gcgcuaagaaccggcucu

SEQ ID NO: 46868 - RNA, 18 nt, Artificial Sequence
  Description of Artificial Sequence: Synthetic oligonucleotide
acaaagcgcuaagaaccg

SEQ ID NO: 46869 - RNA, 18 nt, Artificial Sequence
  Description of Artificial Sequence: Synthetic oligonucleotide
aacccacaaagcgcuaag

SEQ ID NO: 46870 - RNA, 18 nt, Artificial Sequence
  Description of Artificial Sequence: Synthetic oligonucleotide
cucugaacccacaaagcg

SEQ ID NO: 46871 - RNA, 18 nt, Artificial Sequence
  Description of Artificial Sequence: Synthetic oligonucleotide
ccagccucugaacccaca

SEQ ID NO: 46872 - RNA, 18 nt, Artificial Sequence
  Description of Artificial Sequence: Synthetic oligonucleotide
ugcagccagccucugaac

SEQ ID NO: 46873 - RNA, 18 nt, Artificial Sequence
  Description of Artificial Sequence: Synthetic oligonucleotide
aacacugcagccagccuc

SEQ ID NO: 46874 - RNA, 18 nt, Artificial Sequence
  Description of Artificial Sequence: Synthetic oligonucleotide
ucauaaacacugcagcca

SEQ ID NO: 46875 - RNA, 18 nt, Artificial Sequence
  Description of Artificial Sequence: Synthetic oligonucleotide
ccucuucauaaacacugc

SEQ ID NO: 46876 - RNA, 18 nt, Artificial Sequence
  Description of Artificial Sequence: Synthetic oligonucleotide
cugccccucuucauaaac

SEQ ID NO: 46877 - RNA, 18 nt, Artificial Sequence
  Description of Artificial Sequence: Synthetic oligonucleotide
gcccacugccccucuuca

SEQ ID NO: 46878 - RNA, 18 nt, Artificial Sequence
  Description of Artificial Sequence: Synthetic oligonucleotide
ccccagcccacugccccu

SEQ ID NO: 46879 - RNA, 18 nt, Artificial Sequence
  Description of Artificial Sequence: Synthetic oligonucleotide
aguguccccagcccacug

SEQ ID NO: 46880 - RNA, 18 nt, Artificial Sequence
  Description of Artificial Sequence: Synthetic oligonucleotide
ccagcaguguccccagcc

SEQ ID NO: 46881 - RNA, 18 nt, Artificial Sequence
  Description of Artificial Sequence: Synthetic oligonucleotide
uaaccccagcaguguccc

SEQ ID NO: 46882 - RNA, 18 nt, Artificial Sequence
  Description of Artificial Sequence: Synthetic oligonucleotide
agccauaaccccagcagu

SEQ ID NO: 46883 - RNA, 18 nt, Artificial Sequence
  Description of Artificial Sequence: Synthetic oligonucleotide
acuacagccauaacccca

SEQ ID NO: 46884 - RNA, 18 nt, Artificial Sequence
  Description of Artificial Sequence: Synthetic oligonucleotide
accucacuacagccauaa

SEQ ID NO: 46885 - RNA, 18 nt, Artificial Sequence
  Description of Artificial Sequence: Synthetic oligonucleotide
cauggaccucacuacagc

SEQ ID NO: 46886 - RNA, 18 nt, Artificial Sequence
  Description of Artificial Sequence: Synthetic oligonucleotide
guacacauggaccucacu

SEQ ID NO: 46887 - RNA, 18 nt, Artificial Sequence
  Description of Artificial Sequence: Synthetic oligonucleotide
aacaaguacacauggacc

SEQ ID NO: 46888 - RNA, 18 nt, Artificial Sequence
  Description of Artificial Sequence: Synthetic oligonucleotide
caaggaacaaguacacau

SEQ ID NO: 46889 - RNA, 18 nt, Artificial Sequence
  Description of Artificial Sequence: Synthetic oligonucleotide
caugccaaggaacaagua

SEQ ID NO: 46890 - RNA, 18 nt, Artificial Sequence
  Description of Artificial Sequence: Synthetic oligonucleotide
agacacaugccaaggaac

SEQ ID NO: 46891 - RNA, 18 nt, Artificial Sequence
  Description of Artificial Sequence: Synthetic oligonucleotide
gagucagacacaugccaa

SEQ ID NO: 46892 - RNA, 18 nt, Artificial Sequence
  Description of Artificial Sequence: Synthetic oligonucleotide
acacagagucagacacau

SEQ ID NO: 46893 - RNA, 18 nt, Artificial Sequence
  Description of Artificial Sequence: Synthetic oligonucleotide
cagcaacacagagucaga

SEQ ID NO: 46894 - RNA, 18 nt, Artificial Sequence
  Description of Artificial Sequence: Synthetic oligonucleotide
ugcagcagcaacacagag

SEQ ID NO: 46895 - RNA, 18 nt, Artificial Sequence
  Description of Artificial Sequence: Synthetic oligonucleotide
uguacugcagcagcaaca

SEQ ID NO: 46896 - RNA, 18 nt, Artificial Sequence
  Description of Artificial Sequence: Synthetic oligonucleotide
cccacuguacugcagcag

SEQ ID NO: 46897 - RNA, 18 nt, Artificial Sequence
  Description of Artificial Sequence: Synthetic oligonucleotide
cccugcccacuguacugc

SEQ ID NO: 46898 - RNA, 18 nt, Artificial Sequence
  Description of Artificial Sequence: Synthetic oligonucleotide
cgugccccugcccacugu

SEQ ID NO: 46899 - RNA, 18 nt, Artificial Sequence
  Description of Artificial Sequence: Synthetic oligonucleotide
gcaaccgugccccugccc

SEQ ID NO: 46900 - RNA, 18 nt, Artificial Sequence
  Description of Artificial Sequence: Synthetic oligonucleotide
uccaagcaaccgugcccc

SEQ ID NO: 46901 - RNA, 18 nt, Artificial Sequence
  Description of Artificial Sequence: Synthetic oligonucleotide
cccaguccaagcaaccgu

SEQ ID NO: 46902 - RNA, 18 nt, Artificial Sequence
  Description of Artificial Sequence: Synthetic oligonucleotide
ggcagcccaguccaagca

SEQ ID NO: 46903 - RNA, 18 nt, Artificial Sequence
  Description of Artificial Sequence: Synthetic oligonucleotide
caucgggcagcccagucc

SEQ ID NO: 46904 - RNA, 18 nt, Artificial Sequence
  Description of Artificial Sequence: Synthetic oligonucleotide
ccagacaucgggcagccc

SEQ ID NO: 46905 - RNA, 18 nt, Artificial Sequence
  Description of Artificial Sequence: Synthetic oligonucleotide
ccaugccagacaucgggc

SEQ ID NO: 46906 - RNA, 18 nt, Artificial Sequence
  Description of Artificial Sequence: Synthetic oligonucleotide
accagccaugccagacau

SEQ ID NO: 46907 - RNA, 18 nt, Artificial Sequence
  Description of Artificial Sequence: Synthetic oligonucleotide
ggaccaccagccaugcca

SEQ ID NO: 46908 - RNA, 18 nt, Artificial Sequence
  Description of Artificial Sequence: Synthetic oligonucleotide
caacaggaccaccagcca

SEQ ID NO: 46909 - RNA, 18 nt, Artificial Sequence
  Description of Artificial Sequence: Synthetic oligonucleotide
aaggacaacaggaccacc

SEQ ID NO: 46910 - RNA, 18 nt, Artificial Sequence
  Description of Artificial Sequence: Synthetic oligonucleotide
aaauaaaggacaacagga

SEQ ID NO: 46911 - RNA, 18 nt, Artificial Sequence
  Description of Artificial Sequence: Synthetic oligonucleotide
cgaucaaauaaaggacaa

SEQ ID NO: 46912 - RNA, 18 nt, Artificial Sequence
  Description of Artificial Sequence: Synthetic oligonucleotide
gcuaucgaucaaauaaag

SEQ ID NO: 46913 - RNA, 18 nt, Artificial Sequence
  Description of Artificial Sequence: Synthetic oligonucleotide
ucccugcuaucgaucaaa

SEQ ID NO: 46914 - RNA, 18 nt, Artificial Sequence
  Description of Artificial Sequence: Synthetic oligonucleotide
ucaguucccugcuaucga

SEQ ID NO: 46915 - RNA, 18 nt, Artificial Sequence
  Description of Artificial Sequence: Synthetic oligonucleotide
ggcggucaguucccugcu

SEQ ID NO: 46916 - RNA, 18 nt, Artificial Sequence
  Description of Artificial Sequence: Synthetic oligonucleotide
accucggcggucaguucc

SEQ ID NO: 46917 - RNA, 18 nt, Artificial Sequence
  Description of Artificial Sequence: Synthetic oligonucleotide
ugccaaccucggcgguca

SEQ ID NO: 46918 - RNA, 18 nt, Artificial Sequence
  Description of Artificial Sequence: Synthetic oligonucleotide
accugugccaaccucggc

SEQ ID NO: 46919 - RNA, 18 nt, Artificial Sequence
  Description of Artificial Sequence: Synthetic oligonucleotide
ugccaaccugugccaacc

SEQ ID NO: 46920 - RNA, 18 nt, Artificial Sequence
  Description of Artificial Sequence: Synthetic oligonucleotide
cccccugccaaccugugc

SEQ ID NO: 46921 - RNA, 18 nt, Artificial Sequence
  Description of Artificial Sequence: Synthetic oligonucleotide
cucaucccccugccaacc

SEQ ID NO: 46922 - RNA, 18 nt, Artificial Sequence
  Description of Artificial Sequence: Synthetic oligonucleotide
gcauccucaucccccugc

SEQ ID NO: 46923 - RNA, 18 nt, Artificial Sequence
  Description of Artificial Sequence: Synthetic oligonucleotide
acaaugcauccucauccc

SEQ ID NO: 46924 - RNA, 18 nt, Artificial Sequence
  Description of Artificial Sequence: Synthetic oligonucleotide
caaccacaaugcauccuc

SEQ ID NO: 46925 - RNA, 18 nt, Artificial Sequence
  Description of Artificial Sequence: Synthetic oligonucleotide
ggagacaaccacaaugca

SEQ ID NO: 46926 - RNA, 18 nt, Artificial Sequence
  Description of Artificial Sequence: Synthetic oligonucleotide
gaggaggagacaaccaca

SEQ ID NO: 46927 - RNA, 18 nt, Artificial Sequence
  Description of Artificial Sequence: Synthetic oligonucleotide
gagaggaggaggagacaa

SEQ ID NO: 46928 - RNA, 18 nt, Artificial Sequence
  Description of Artificial Sequence: Synthetic oligonucleotide
agaaggagaggaggagga

SEQ ID NO: 46929 - RNA, 18 nt, Artificial Sequence
  Description of Artificial Sequence: Synthetic oligonucleotide
gaggaagaaggagaggag

SEQ ID NO: 46930 - RNA, 18 nt, Artificial Sequence
  Description of Artificial Sequence: Synthetic oligonucleotide
gggaagaggaagaaggag

SEQ ID NO: 46931 - RNA, 18 nt, Artificial Sequence
  Description of Artificial Sequence: Synthetic oligonucleotide
aaaggagaggaggaaggg

SEQ ID NO: 46932 - RNA, 18 nt, Artificial Sequence
  Description of Artificial Sequence: Synthetic oligonucleotide
agaaaggagaggaggaag

SEQ ID NO: 46933 - RNA, 18 nt, Artificial Sequence
  Description of Artificial Sequence: Synthetic oligonucleotide
agaacagaaaggagagga

SEQ ID NO: 46934 - RNA, 18 nt, Artificial Sequence
  Description of Artificial Sequence: Synthetic oligonucleotide
gaacaagaacagaaagga

SEQ ID NO: 46935 - RNA, 18 nt, Artificial Sequence
  Description of Artificial Sequence: Synthetic oligonucleotide
agggagaacaagaacaga

SEQ ID NO: 46936 - RNA, 18 nt, Artificial Sequence
  Description of Artificial Sequence: Synthetic oligonucleotide
agaugagggagaacaaga

SEQ ID NO: 46937 - RNA, 18 nt, Artificial Sequence
  Description of Artificial Sequence: Synthetic oligonucleotide
gaggaagaugagggagaa

SEQ ID NO: 46938 - RNA, 18 nt, Artificial Sequence
  Description of Artificial Sequence: Synthetic oligonucleotide
aggaagaggaagaugagg

SEQ ID NO: 46939 - RNA, 18 nt, Artificial Sequence
  Description of Artificial Sequence: Synthetic oligonucleotide
gaagaaggaagaggaaga

SEQ ID NO: 46940 - RNA, 18 nt, Artificial Sequence
  Description of Artificial Sequence: Synthetic oligonucleotide
agggagaagaaggaagag

SEQ ID NO: 46941 - RNA, 18 nt, Artificial Sequence
  Description of Artificial Sequence: Synthetic oligonucleotide
agaagagggagaagaagg

SEQ ID NO: 46942 - RNA, 18 nt, Artificial Sequence
  Description of Artificial Sequence: Synthetic oligonucleotide
gaggaagaagagggagaa

SEQ ID NO: 46943 - RNA, 18 nt, Artificial Sequence
  Description of Artificial Sequence: Synthetic oligonucleotide
gugaagaggaagaagagg

SEQ ID NO: 46944 - RNA, 18 nt, Artificial Sequence
  Description of Artificial Sequence: Synthetic oligonucleotide
gcagagugaagaggaaga

SEQ ID NO: 46945 - RNA, 18 nt, Artificial Sequence
  Description of Artificial Sequence: Synthetic oligonucleotide
agagagcagagugaagag

SEQ ID NO: 46946 - RNA, 18 nt, Artificial Sequence
  Description of Artificial Sequence: Synthetic oligonucleotide
agagaagagagcagagug

SEQ ID NO: 46947 - RNA, 18 nt, Artificial Sequence
  Description of Artificial Sequence: Synthetic oligonucleotide
aaagaagagaagagagca

SEQ ID NO: 46948 - RNA, 18 nt, Artificial Sequence
  Description of Artificial Sequence: Synthetic oligonucleotide
ugauucacuccgcuguga

SEQ ID NO: 46949 - RNA, 18 nt, Artificial Sequence
  Description of Artificial Sequence: Synthetic oligonucleotide
cgagcugauucacuccgc

SEQ ID NO: 46950 - RNA, 18 nt, Artificial Sequence
  Description of Artificial Sequence: Synthetic oligonucleotide
accaccgagcugauucac

SEQ ID NO: 46951 - RNA, 18 nt, Artificial Sequence
  Description of Artificial Sequence: Synthetic oligonucleotide
aagacaccaccgagcuga

SEQ ID NO: 46952 - RNA, 18 nt, Artificial Sequence
  Description of Artificial Sequence: Synthetic oligonucleotide
ugacaaagacaccaccga

SEQ ID NO: 46953 - RNA, 18 nt, Artificial Sequence
  Description of Artificial Sequence: Synthetic oligonucleotide
cccguugacaaagacacc

SEQ ID NO: 46954 - RNA, 18 nt, Artificial Sequence
  Description of Artificial Sequence: Synthetic oligonucleotide
ggccgcccguugacaaag

SEQ ID NO: 46955 - RNA, 18 nt, Artificial Sequence
  Description of Artificial Sequence: Synthetic oligonucleotide
gcaguggccgcccguuga

SEQ ID NO: 46956 - RNA, 18 nt, Artificial Sequence
  Description of Artificial Sequence: Synthetic oligonucleotide
guccggcaguggccgccc

SEQ ID NO: 46957 - RNA, 18 nt, Artificial Sequence
  Description of Artificial Sequence: Synthetic oligonucleotide
guggaguccggcaguggc

SEQ ID NO: 46958 - RNA, 18 nt, Artificial Sequence
  Description of Artificial Sequence: Synthetic oligonucleotide
gccggguggaguccggca

SEQ ID NO: 46959 - RNA, 18 nt, Artificial Sequence
  Description of Artificial Sequence: Synthetic oligonucleotide
cuucugccggguggaguc

SEQ ID NO: 46960 - RNA, 18 nt, Artificial Sequence
  Description of Artificial Sequence: Synthetic oligonucleotide
acaaucuucugccgggug

SEQ ID NO: 46961 - RNA, 18 nt, Artificial Sequence
  Description of Artificial Sequence: Synthetic oligonucleotide
gcucuacaaucuucugcc

SEQ ID NO: 46962 - RNA, 18 nt, Artificial Sequence
  Description of Artificial Sequence: Synthetic oligonucleotide
agcuagcucuacaaucuu

SEQ ID NO: 46963 - RNA, 18 nt, Artificial Sequence
  Description of Artificial Sequence: Synthetic oligonucleotide
cugugagcuagcucuaca

SEQ ID NO: 46964 - RNA, 18 nt, Artificial Sequence
  Description of Artificial Sequence: Synthetic oligonucleotide
ccccgcugugagcuagcu

SEQ ID NO: 46965 - RNA, 18 nt, Artificial Sequence
  Description of Artificial Sequence: Synthetic oligonucleotide
ccgggccccgcugugagc

SEQ ID NO: 46966 - RNA, 18 nt, Artificial Sequence
  Description of Artificial Sequence: Synthetic oligonucleotide
cacggccgggccccgcug

SEQ ID NO: 46967 - RNA, 18 nt, Artificial Sequence
  Description of Artificial Sequence: Synthetic oligonucleotide
ugucgcacggccgggccc

SEQ ID NO: 46968 - RNA, 18 nt, Artificial Sequence
  Description of Artificial Sequence: Synthetic oligonucleotide
ggaaaugucgcacggccg

SEQ ID NO: 46969 - RNA, 18 nt, Artificial Sequence
  Description of Artificial Sequence: Synthetic oligonucleotide
auucgggaaaugucgcac

SEQ ID NO: 46970 - RNA, 18 nt, Artificial Sequence
  Description of Artificial Sequence: Synthetic oligonucleotide
gcagaauucgggaaaugu

SEQ ID NO: 46971 - RNA, 18 nt, Artificial Sequence
  Description of Artificial Sequence: Synthetic oligonucleotide
cuuuugcaucugcauggg

SEQ ID NO: 46972 - RNA, 18 nt, Artificial Sequence
  Description of Artificial Sequence: Synthetic oligonucleotide
uuggacuuuugcaucugc

SEQ ID NO: 46973 - RNA, 18 nt, Artificial Sequence
  Description of Artificial Sequence: Synthetic oligonucleotide
agcacuuggacuuuugca

SEQ ID NO: 46974 - RNA, 18 nt, Artificial Sequence
  Description of Artificial Sequence: Synthetic oligonucleotide
uguccagcacuuggacuu

SEQ ID NO: 46975 - RNA, 18 nt, Artificial Sequence
  Description of Artificial Sequence: Synthetic oligonucleotide
uugauuguccagcacuug

SEQ ID NO: 46976 - RNA, 18 nt, Artificial Sequence
  Description of Artificial Sequence: Synthetic oligonucleotide
gcauuaaacaaugacaag

SEQ ID NO: 46977 - RNA, 18 nt, Artificial Sequence
  Description of Artificial Sequence: Synthetic oligonucleotide
aguaugcauuaaacaaug

SEQ ID NO: 46978 - RNA, 18 nt, Artificial Sequence
  Description of Artificial Sequence: Synthetic oligonucleotide
guuuaaguaugcauuaaa

SEQ ID NO: 46979 - RNA, 18 nt, Artificial Sequence
  Description of Artificial Sequence: Synthetic oligonucleotide
aaauuguuuaaguaugca

SEQ ID NO: 46980 - RNA, 18 nt, Artificial Sequence
  Description of Artificial Sequence: Synthetic oligonucleotide
aaauaaaauuguuuaagu

SEQ ID NO: 46981 - RNA, 18 nt, Artificial Sequence
  Description of Artificial Sequence: Synthetic oligonucleotide
gacaaaaauaaaauuguu

SEQ ID NO: 46982 - RNA, 18 nt, Artificial Sequence
  Description of Artificial Sequence: Synthetic oligonucleotide
uucaagacaaaaauaaaa

SEQ ID NO: 46983 - RNA, 18 nt, Artificial Sequence
  Description of Artificial Sequence: Synthetic oligonucleotide
auaauuucaagacaaaaa

SEQ ID NO: 46984 - RNA, 18 nt, Artificial Sequence
  Description of Artificial Sequence: Synthetic oligonucleotide
uauuaauaauuucaagac

SEQ ID NO: 46985 - RNA, 18 nt, Artificial Sequence
  Description of Artificial Sequence: Synthetic oligonucleotide
cacauuauuaauaauuuc

SEQ ID NO: 46986 - RNA, 18 nt, Artificial Sequence
  Description of Artificial Sequence: Synthetic oligonucleotide
aaaaccacauuauuaaua

SEQ ID NO: 46987 - RNA, 18 nt, Artificial Sequence
  Description of Artificial Sequence: Synthetic oligonucleotide
gacagaaaaccacauuau

SEQ ID NO: 46988 - RNA, 18 nt, Artificial Sequence
  Description of Artificial Sequence: Synthetic oligonucleotide
uguuuaaguaugcauuaa

SEQ ID NO: 46989 - RNA, 18 nt, Artificial Sequence
  Description of Artificial Sequence: Synthetic oligonucleotide
aaaauuguuuaaguaugc

SEQ ID NO: 46990 - RNA, 18 nt, Artificial Sequence
  Description of Artificial Sequence: Synthetic oligonucleotide
aaaauaaaauuguuuaag

SEQ ID NO: 46991 - RNA, 18 nt, Artificial Sequence
  Description of Artificial Sequence: Synthetic oligonucleotide
agacaaaaauaaaauugu

SEQ ID NO: 46992 - RNA, 18 nt, Artificial Sequence
  Description of Artificial Sequence: Synthetic oligonucleotide
uuucaagacaaaaauaaa

SEQ ID NO: 46993 - RNA, 18 nt, Artificial Sequence
  Description of Artificial Sequence: Synthetic oligonucleotide
aauaauuucaagacaaaa

SEQ ID NO: 46994 - RNA, 18 nt, Artificial Sequence
  Description of Artificial Sequence: Synthetic oligonucleotide
uuauuaauaauuucaaga

SEQ ID NO: 46995 - RNA, 18 nt, Artificial Sequence
  Description of Artificial Sequence: Synthetic oligonucleotide
ccacauuauuaauaauuu

SEQ ID NO: 46996 - RNA, 18 nt, Artificial Sequence
  Description of Artificial Sequence: Synthetic oligonucleotide
gaaaaccacauuauuaau

SEQ ID NO: 46997 - RNA, 18 nt, Artificial Sequence
  Description of Artificial Sequence: Synthetic oligonucleotide
ggacagaaaaccacauua

SEQ ID NO: 46998 - RNA, 18 nt, Artificial Sequence
  Description of Artificial Sequence: Synthetic oligonucleotide
ucacacauccguuggaca

SEQ ID NO: 46999 - RNA, 18 nt, Artificial Sequence
  Description of Artificial Sequence: Synthetic oligonucleotide
uuuacucacacauccguu

SEQ ID NO: 47000 - RNA, 18 nt, Artificial Sequence
  Description of Artificial Sequence: Synthetic oligonucleotide
agaauuuuacucacacau

SEQ ID NO: 47001 - RNA, 18 nt, Artificial Sequence
  Description of Artificial Sequence: Synthetic oligonucleotide
ugcccagaauuuuacuca

SEQ ID NO: 47002 - RNA, 18 nt, Artificial Sequence
  Description of Artificial Sequence: Synthetic oligonucleotide
auaccugcccagaauuuu

SEQ ID NO: 47003 - RNA, 18 nt, Artificial Sequence
  Description of Artificial Sequence: Synthetic oligonucleotide
ucguaauaccugcccaga

SEQ ID NO: 47004 - RNA, 18 nt, Artificial Sequence
  Description of Artificial Sequence: Synthetic oligonucleotide
cagucucguaauaccugc

SEQ ID NO: 47005 - RNA, 18 nt, Artificial Sequence
  Description of Artificial Sequence: Synthetic oligonucleotide
ggagccagucucguaaua

SEQ ID NO: 47006 - RNA, 18 nt, Artificial Sequence
  Description of Artificial Sequence: Synthetic oligonucleotide
cugauggagccagucucg

SEQ ID NO: 47007 - RNA, 18 nt, Artificial Sequence
  Description of Artificial Sequence: Synthetic oligonucleotide
ugggucugauggagccag

SEQ ID NO: 47008 - RNA, 18 nt, Artificial Sequence
  Description of Artificial Sequence: Synthetic oligonucleotide
ugcccugggucugaugga

SEQ ID NO: 47009 - RNA, 18 nt, Artificial Sequence
  Description of Artificial Sequence: Synthetic oligonucleotide
ccgauugcccugggucug

SEQ ID NO: 47010 - RNA, 18 nt, Artificial Sequence
  Description of Artificial Sequence: Synthetic oligonucleotide
uaccaccgauugcccugg

SEQ ID NO: 47011 - RNA, 18 nt, Artificial Sequence
  Description of Artificial Sequence: Synthetic oligonucleotide
uuuacuaccaccgauugc

SEQ ID NO: 47012 - RNA, 18 nt, Artificial Sequence
  Description of Artificial Sequence: Synthetic oligonucleotide
cucgguuuacuaccaccg

SEQ ID NO: 47013 - RNA, 18 nt, Artificial Sequence
  Description of Artificial Sequence: Synthetic oligonucleotide
cuacucucgguuuacuac

SEQ ID NO: 47014 - RNA, 18 nt, Artificial Sequence
  Description of Artificial Sequence: Synthetic oligonucleotide
agucgcuacucucgguuu

SEQ ID NO: 47015 - RNA, 18 nt, Artificial Sequence
  Description of Artificial Sequence: Synthetic oligonucleotide
ucuggagucgcuacucuc

SEQ ID NO: 47016 - RNA, 18 nt, Artificial Sequence
  Description of Artificial Sequence: Synthetic oligonucleotide
caacuucuggagucgcua

SEQ ID NO: 47017 - RNA, 18 nt, Artificial Sequence
  Description of Artificial Sequence: Synthetic oligonucleotide
gcuuacaacuucuggagu

SEQ ID NO: 47018 - RNA, 18 nt, Artificial Sequence
  Description of Artificial Sequence: Synthetic oligonucleotide
auuuugcuuacaacuucu

SEQ ID NO: 47019 - RNA, 18 nt, Artificial Sequence
  Description of Artificial Sequence: Synthetic oligonucleotide
gggcuauuuugcuuacaa

SEQ ID NO: 47020 - RNA, 18 nt, Artificial Sequence
  Description of Artificial Sequence: Synthetic oligonucleotide
auacugggcuauuuugcu

SEQ ID NO: 47021 - RNA, 18 nt, Artificial Sequence
  Description of Artificial Sequence: Synthetic oligonucleotide
cgcuuauacugggcuauu

SEQ ID NO: 47022 - RNA, 18 nt, Artificial Sequence
  Description of Artificial Sequence: Synthetic oligonucleotide
acucccgcuuauacuggg

SEQ ID NO: 47023 - RNA, 18 nt, Artificial Sequence
  Description of Artificial Sequence: Synthetic oligonucleotide
cgggcacucccgcuuaua

SEQ ID NO: 47024 - RNA, 18 nt, Artificial Sequence
  Description of Artificial Sequence: Synthetic oligonucleotide
auggacgggcacucccgc

SEQ ID NO: 47025 - RNA, 18 nt, Artificial Sequence
  Description of Artificial Sequence: Synthetic oligonucleotide
caaagauggacgggcacu

SEQ ID NO: 47026 - RNA, 18 nt, Artificial Sequence
  Description of Artificial Sequence: Synthetic oligonucleotide
ccaagcaaagauggacgg

SEQ ID NO: 47027 - RNA, 18 nt, Artificial Sequence
  Description of Artificial Sequence: Synthetic oligonucleotide
auuucccaagcaaagaug

SEQ ID NO: 47028 - RNA, 18 nt, Artificial Sequence
  Description of Artificial Sequence: Synthetic oligonucleotide
cucggauuucccaagcaa

SEQ ID NO: 47029 - RNA, 18 nt, Artificial Sequence
  Description of Artificial Sequence: Synthetic oligonucleotide
ucugucucggauuuccca

SEQ ID NO: 47030 - RNA, 18 nt, Artificial Sequence
  Description of Artificial Sequence: Synthetic oligonucleotide
aguaaucugucucggauu

SEQ ID NO: 47031 - RNA, 18 nt, Artificial Sequence
  Description of Artificial Sequence: Synthetic oligonucleotide
cggacaguaaucugucuc

SEQ ID NO: 47032 - RNA, 18 nt, Artificial Sequence
  Description of Artificial Sequence: Synthetic oligonucleotide
ccccucggacaguaaucu

SEQ ID NO: 47033 - RNA, 18 nt, Artificial Sequence
  Description of Artificial Sequence: Synthetic oligonucleotide
cagacccccucggacagu

SEQ ID NO: 47034 - RNA, 18 nt, Artificial Sequence
  Description of Artificial Sequence: Synthetic oligonucleotide
ugguacagacccccucgg

SEQ ID NO: 47035 - RNA, 18 nt, Artificial Sequence
  Description of Artificial Sequence: Synthetic oligonucleotide
aucguugguacagacccc

SEQ ID NO: 47036 - RNA, 18 nt, Artificial Sequence
  Description of Artificial Sequence: Synthetic oligonucleotide
auguuaucguugguacag

SEQ ID NO: 47037 - RNA, 18 nt, Artificial Sequence
  Description of Artificial Sequence: Synthetic oligonucleotide
uugguauguuaucguugg

SEQ ID NO: 47038 - RNA, 18 nt, Artificial Sequence
  Description of Artificial Sequence: Synthetic oligonucleotide
cacacauccguuggacac

SEQ ID NO: 47039 - RNA, 18 nt, Artificial Sequence
  Description of Artificial Sequence: Synthetic oligonucleotide
uuacucacacauccguug

SEQ ID NO: 47040 - RNA, 18 nt, Artificial Sequence
  Description of Artificial Sequence: Synthetic oligonucleotide
gaauuuuacucacacauc

SEQ ID NO: 47041 - RNA, 18 nt, Artificial Sequence
  Description of Artificial Sequence: Synthetic oligonucleotide
gcccagaauuuuacucac

SEQ ID NO: 47042 - RNA, 18 nt, Artificial Sequence
  Description of Artificial Sequence: Synthetic oligonucleotide
uaccugcccagaauuuua

SEQ ID NO: 47043 - RNA, 18 nt, Artificial Sequence
  Description of Artificial Sequence: Synthetic oligonucleotide
cguaauaccugcccagaa

SEQ ID NO: 47044 - RNA, 18 nt, Artificial Sequence
  Description of Artificial Sequence: Synthetic oligonucleotide
agucucguaauaccugcc

SEQ ID NO: 47045 - RNA, 18 nt, Artificial Sequence
  Description of Artificial Sequence: Synthetic oligonucleotide
gagccagucucguaauac

SEQ ID NO: 47046 - RNA, 18 nt, Artificial Sequence
  Description of Artificial Sequence: Synthetic oligonucleotide
ugauggagccagucucgu

SEQ ID NO: 47047 - RNA, 18 nt, Artificial Sequence
  Description of Artificial Sequence: Synthetic oligonucleotide
gggucugauggagccagu

SEQ ID NO: 47048 - RNA, 18 nt, Artificial Sequence
  Description of Artificial Sequence: Synthetic oligonucleotide
gcccugggucugauggag

SEQ ID NO: 47049 - RNA, 18 nt, Artificial Sequence
  Description of Artificial Sequence: Synthetic oligonucleotide
cgauugcccugggucuga

SEQ ID NO: 47050 - RNA, 18 nt, Artificial Sequence
  Description of Artificial Sequence: Synthetic oligonucleotide
accaccgauugcccuggg

SEQ ID NO: 47051 - RNA, 18 nt, Artificial Sequence
  Description of Artificial Sequence: Synthetic oligonucleotide
uuacuaccaccgauugcc

SEQ ID NO: 47052 - RNA, 18 nt, Artificial Sequence
  Description of Artificial Sequence: Synthetic oligonucleotide
ucgguuuacuaccaccga

SEQ ID NO: 47053 - RNA, 18 nt, Artificial Sequence
  Description of Artificial Sequence: Synthetic oligonucleotide
uacucucgguuuacuacc

SEQ ID NO: 47054 - RNA, 18 nt, Artificial Sequence
  Description of Artificial Sequence: Synthetic oligonucleotide
gucgcuacucucgguuua

SEQ ID NO: 47055 - RNA, 18 nt, Artificial Sequence
  Description of Artificial Sequence: Synthetic oligonucleotide
cuggagucgcuacucucg

SEQ ID NO: 47056 - RNA, 18 nt, Artificial Sequence
  Description of Artificial Sequence: Synthetic oligonucleotide
aacuucuggagucgcuac

SEQ ID NO: 47057 - RNA, 18 nt, Artificial Sequence
  Description of Artificial Sequence: Synthetic oligonucleotide
cuuacaacuucuggaguc

SEQ ID NO: 47058 - RNA, 18 nt, Artificial Sequence
  Description of Artificial Sequence: Synthetic oligonucleotide
uuuugcuuacaacuucug

SEQ ID NO: 47059 - RNA, 18 nt, Artificial Sequence
  Description of Artificial Sequence: Synthetic oligonucleotide
ggcuauuuugcuuacaac

SEQ ID NO: 47060 - RNA, 18 nt, Artificial Sequence
  Description of Artificial Sequence: Synthetic oligonucleotide
uacugggcuauuuugcuu

SEQ ID NO: 47061 - RNA, 18 nt, Artificial Sequence
  Description of Artificial Sequence: Synthetic oligonucleotide
gcuuauacugggcuauuu

SEQ ID NO: 47062 - RNA, 18 nt, Artificial Sequence
  Description of Artificial Sequence: Synthetic oligonucleotide
cucccgcuuauacugggc

SEQ ID NO: 47063 - RNA, 18 nt, Artificial Sequence
  Description of Artificial Sequence: Synthetic oligonucleotide
gggcacucccgcuuauac

SEQ ID NO: 47064 - RNA, 18 nt, Artificial Sequence
  Description of Artificial Sequence: Synthetic oligonucleotide
uggacgggcacucccgcu

SEQ ID NO: 47065 - RNA, 18 nt, Artificial Sequence
  Description of Artificial Sequence: Synthetic oligonucleotide
aaagauggacgggcacuc

SEQ ID NO: 47066 - RNA, 18 nt, Artificial Sequence
  Description of Artificial Sequence: Synthetic oligonucleotide
caagcaaagauggacggg

SEQ ID NO: 47067 - RNA, 18 nt, Artificial Sequence
  Description of Artificial Sequence: Synthetic oligonucleotide
uuucccaagcaaagaugg

SEQ ID NO: 47068 - RNA, 18 nt, Artificial Sequence
  Description of Artificial Sequence: Synthetic oligonucleotide
ucggauuucccaagcaaa

SEQ ID NO: 47069 - RNA, 18 nt, Artificial Sequence
  Description of Artificial Sequence: Synthetic oligonucleotide
cugucucggauuucccaa

SEQ ID NO: 47070 - RNA, 18 nt, Artificial Sequence
  Description of Artificial Sequence: Synthetic oligonucleotide
guaaucugucucggauuu

SEQ ID NO: 47071 - RNA, 18 nt, Artificial Sequence
  Description of Artificial Sequence: Synthetic oligonucleotide
ggacaguaaucugucucg

SEQ ID NO: 47072 - RNA, 18 nt, Artificial Sequence
  Description of Artificial Sequence: Synthetic oligonucleotide
cccucggacaguaaucug

SEQ ID NO: 47073 - RNA, 18 nt, Artificial Sequence
  Description of Artificial Sequence: Synthetic oligonucleotide
agacccccucggacagua

SEQ ID NO: 47074 - RNA, 18 nt, Artificial Sequence
  Description of Artificial Sequence: Synthetic oligonucleotide
gguacagacccccucgga

SEQ ID NO: 47075 - RNA, 18 nt, Artificial Sequence
  Description of Artificial Sequence: Synthetic oligonucleotide
ucguugguacagaccccc

SEQ ID NO: 47076 - RNA, 18 nt, Artificial Sequence
  Description of Artificial Sequence: Synthetic oligonucleotide
uguuaucguugguacaga

SEQ ID NO: 47077 - RNA, 18 nt, Artificial Sequence
  Description of Artificial Sequence: Synthetic oligonucleotide
ugguauguuaucguuggu

SEQ ID NO: 47078 - RNA, 18 nt, Artificial Sequence
  Description of Artificial Sequence: Synthetic oligonucleotide
gcagauguucucaaugaa

SEQ ID NO: 47079 - RNA, 18 nt, Artificial Sequence
  Description of Artificial Sequence: Synthetic oligonucleotide
ggagggcagauguucuca

SEQ ID NO: 47080 - RNA, 18 nt, Artificial Sequence
  Description of Artificial Sequence: Synthetic oligonucleotide
ggcagggagggcagaugu

SEQ ID NO: 47081 - RNA, 18 nt, Artificial Sequence
  Description of Artificial Sequence: Synthetic oligonucleotide
cuuagggcagggagggca

SEQ ID NO: 47082 - RNA, 18 nt, Artificial Sequence
  Description of Artificial Sequence: Synthetic oligonucleotide
uugggcuuagggcaggga

SEQ ID NO: 47083 - RNA, 18 nt, Artificial Sequence
  Description of Artificial Sequence: Synthetic oligonucleotide
gagcauugggcuuagggc

SEQ ID NO: 47084 - RNA, 18 nt, Artificial Sequence
  Description of Artificial Sequence: Synthetic oligonucleotide
ggagagagcauugggcuu

SEQ ID NO: 47085 - RNA, 18 nt, Artificial Sequence
  Description of Artificial Sequence: Synthetic oligonucleotide
aaagaggagagagcauug

SEQ ID NO: 47086 - RNA, 18 nt, Artificial Sequence
  Description of Artificial Sequence: Synthetic oligonucleotide
gagguaaagaggagagag

SEQ ID NO: 47087 - RNA, 18 nt, Artificial Sequence
  Description of Artificial Sequence: Synthetic oligonucleotide
gggaggagguaaagagga

SEQ ID NO: 47088 - RNA, 18 nt, Artificial Sequence
  Description of Artificial Sequence: Synthetic oligonucleotide
agggugggaggagguaaa

SEQ ID NO: 47089 - RNA, 18 nt, Artificial Sequence
  Description of Artificial Sequence: Synthetic oligonucleotide
gagagagggugggaggag

SEQ ID NO: 47090 - RNA, 18 nt, Artificial Sequence
  Description of Artificial Sequence: Synthetic oligonucleotide
guggagagagaggguggg

SEQ ID NO: 47091 - RNA, 18 nt, Artificial Sequence
  Description of Artificial Sequence: Synthetic oligonucleotide
agacaguggagagagagg

SEQ ID NO: 47092 - RNA, 18 nt, Artificial Sequence
  Description of Artificial Sequence: Synthetic oligonucleotide
cuaagagacaguggagag

SEQ ID NO: 47093 - RNA, 18 nt, Artificial Sequence
  Description of Artificial Sequence: Synthetic oligonucleotide
acagacuaagagacagug

SEQ ID NO: 47094 - RNA, 18 nt, Artificial Sequence
  Description of Artificial Sequence: Synthetic oligonucleotide
aggacacagacuaagaga

SEQ ID NO: 47095 - RNA, 18 nt, Artificial Sequence
  Description of Artificial Sequence: Synthetic oligonucleotide
gggagaggacacagacua

SEQ ID NO: 47096 - RNA, 18 nt, Artificial Sequence
  Description of Artificial Sequence: Synthetic oligonucleotide
gagcagggagaggacaca

SEQ ID NO: 47097 - RNA, 18 nt, Artificial Sequence
  Description of Artificial Sequence: Synthetic oligonucleotide
auguggagcagggagagg

SEQ ID NO: 47098 - RNA, 18 nt, Artificial Sequence
  Description of Artificial Sequence: Synthetic oligonucleotide
gacaaauguggagcaggg

SEQ ID NO: 47099 - RNA, 18 nt, Artificial Sequence
  Description of Artificial Sequence: Synthetic oligonucleotide
aaggagacaaauguggag

SEQ ID NO: 47100 - RNA, 18 nt, Artificial Sequence
  Description of Artificial Sequence: Synthetic oligonucleotide
guacaaaggagacaaaug

SEQ ID NO: 47101 - RNA, 18 nt, Artificial Sequence
  Description of Artificial Sequence: Synthetic oligonucleotide
cccagguacaaaggagac

SEQ ID NO: 47102 - RNA, 18 nt, Artificial Sequence
  Description of Artificial Sequence: Synthetic oligonucleotide
guucccccagguacaaag

SEQ ID NO: 47103 - RNA, 18 nt, Artificial Sequence
  Description of Artificial Sequence: Synthetic oligonucleotide
ucucuguucccccaggua

SEQ ID NO: 47104 - RNA, 18 nt, Artificial Sequence
  Description of Artificial Sequence: Synthetic oligonucleotide
auuccucucuguuccccc

SEQ ID NO: 47105 - RNA, 18 nt, Artificial Sequence
  Description of Artificial Sequence: Synthetic oligonucleotide
agggcauuccucucuguu

SEQ ID NO: 47106 - RNA, 18 nt, Artificial Sequence
  Description of Artificial Sequence: Synthetic oligonucleotide
aagucagggcauuccucu

SEQ ID NO: 47107 - RNA, 18 nt, Artificial Sequence
  Description of Artificial Sequence: Synthetic oligonucleotide
aagaaaagucagggcauu

SEQ ID NO: 47108 - RNA, 18 nt, Artificial Sequence
  Description of Artificial Sequence: Synthetic oligonucleotide
agucaaagaaaagucagg

SEQ ID NO: 47109 - RNA, 18 nt, Artificial Sequence
  Description of Artificial Sequence: Synthetic oligonucleotide
cagacagucaaagaaaag

SEQ ID NO: 47110 - RNA, 18 nt, Artificial Sequence
  Description of Artificial Sequence: Synthetic oligonucleotide
uuuuccagacagucaaag

SEQ ID NO: 47111 - RNA, 18 nt, Artificial Sequence
  Description of Artificial Sequence: Synthetic oligonucleotide
ucccauuuuccagacagu

SEQ ID NO: 47112 - RNA, 18 nt, Artificial Sequence
  Description of Artificial Sequence: Synthetic oligonucleotide
uugacucccauuuuccag

SEQ ID NO: 47113 - RNA, 18 nt, Artificial Sequence
  Description of Artificial Sequence: Synthetic oligonucleotide
cacacuugacucccauuu

SEQ ID NO: 47114 - RNA, 18 nt, Artificial Sequence
  Description of Artificial Sequence: Synthetic oligonucleotide
cuccccacacuugacucc

SEQ ID NO: 47115 - RNA, 18 nt, Artificial Sequence
  Description of Artificial Sequence: Synthetic oligonucleotide
aaugacuccccacacuug

SEQ ID NO: 47116 - RNA, 18 nt, Artificial Sequence
  Description of Artificial Sequence: Synthetic oligonucleotide
aagugaaugacuccccac

SEQ ID NO: 47117 - RNA, 18 nt, Artificial Sequence
  Description of Artificial Sequence: Synthetic oligonucleotide
aaaugaagugaaugacuc

SEQ ID NO: 47118 - RNA, 18 nt, Artificial Sequence
  Description of Artificial Sequence: Synthetic oligonucleotide
caugcaaaugaagugaau

SEQ ID NO: 47119 - RNA, 18 nt, Artificial Sequence
  Description of Artificial Sequence: Synthetic oligonucleotide
ugcagcaugcaaaugaag

SEQ ID NO: 47120 - RNA, 18 nt, Artificial Sequence
  Description of Artificial Sequence: Synthetic oligonucleotide
uguuuugcagcaugcaaa

SEQ ID NO: 47121 - RNA, 18 nt, Artificial Sequence
  Description of Artificial Sequence: Synthetic oligonucleotide
cccucuguuuugcagcau

SEQ ID NO: 47122 - RNA, 18 nt, Artificial Sequence
  Description of Artificial Sequence: Synthetic oligonucleotide
cuccgcccucuguuuugc

SEQ ID NO: 47123 - RNA, 18 nt, Artificial Sequence
  Description of Artificial Sequence: Synthetic oligonucleotide
ggugccuccgcccucugu

SEQ ID NO: 47124 - RNA, 18 nt, Artificial Sequence
  Description of Artificial Sequence: Synthetic oligonucleotide
ucccuggugccuccgccc

SEQ ID NO: 47125 - RNA, 18 nt, Artificial Sequence
  Description of Artificial Sequence: Synthetic oligonucleotide
gccuuucccuggugccuc

SEQ ID NO: 47126 - RNA, 18 nt, Artificial Sequence
  Description of Artificial Sequence: Synthetic oligonucleotide
caagugccuuucccuggu

SEQ ID NO: 47127 - RNA, 18 nt, Artificial Sequence
  Description of Artificial Sequence: Synthetic oligonucleotide
ucauucaagugccuuucc

SEQ ID NO: 47128 - RNA, 18 nt, Artificial Sequence
  Description of Artificial Sequence: Synthetic oligonucleotide
cuucuucauucaagugcc

SEQ ID NO: 47129 - RNA, 18 nt, Artificial Sequence
  Description of Artificial Sequence: Synthetic oligonucleotide
uuuuccuucuucauucaa

SEQ ID NO: 47130 - RNA, 18 nt, Artificial Sequence
  Description of Artificial Sequence: Synthetic oligonucleotide
ucucauuuuccuucuuca

SEQ ID NO: 47131 - RNA, 18 nt, Artificial Sequence
  Description of Artificial Sequence: Synthetic oligonucleotide
cugguucucauuuuccuu

SEQ ID NO: 47132 - RNA, 18 nt, Artificial Sequence
  Description of Artificial Sequence: Synthetic oligonucleotide
acaaucugguucucauuu

SEQ ID NO: 47133 - RNA, 18 nt, Artificial Sequence
  Description of Artificial Sequence: Synthetic oligonucleotide
aaguuacaaucugguucu

SEQ ID NO: 47134 - RNA, 18 nt, Artificial Sequence
  Description of Artificial Sequence: Synthetic oligonucleotide
ggacgaaguuacaaucug

SEQ ID NO: 47135 - RNA, 18 nt, Artificial Sequence
  Description of Artificial Sequence: Synthetic oligonucleotide
gauuaggacgaaguuaca

SEQ ID NO: 47136 - RNA, 18 nt, Artificial Sequence
  Description of Artificial Sequence: Synthetic oligonucleotide
agguggauuaggacgaag

SEQ ID NO: 47137 - RNA, 18 nt, Artificial Sequence
  Description of Artificial Sequence: Synthetic oligonucleotide
cuggcagguggauuagga

SEQ ID NO: 47138 - RNA, 18 nt, Artificial Sequence
  Description of Artificial Sequence: Synthetic oligonucleotide
aaguucuggcagguggau

SEQ ID NO: 47139 - RNA, 18 nt, Artificial Sequence
  Description of Artificial Sequence: Synthetic oligonucleotide
aaggaaaguucuggcagg

SEQ ID NO: 47140 - RNA, 18 nt, Artificial Sequence
  Description of Artificial Sequence: Synthetic oligonucleotide
accugaaggaaaguucug

SEQ ID NO: 47141 - RNA, 18 nt, Artificial Sequence
  Description of Artificial Sequence: Synthetic oligonucleotide
gugacaccugaaggaaag

SEQ ID NO: 47142 - RNA, 18 nt, Artificial Sequence
  Description of Artificial Sequence: Synthetic oligonucleotide
gaugugugacaccugaag

SEQ ID NO: 47143 - RNA, 18 nt, Artificial Sequence
  Description of Artificial Sequence: Synthetic oligonucleotide
aaauggaugugugacacc

SEQ ID NO: 47144 - RNA, 18 nt, Artificial Sequence
  Description of Artificial Sequence: Synthetic oligonucleotide
gauggaaauggaugugug

SEQ ID NO: 47145 - RNA, 18 nt, Artificial Sequence
  Description of Artificial Sequence: Synthetic oligonucleotide
auuaggauggaaauggau

SEQ ID NO: 47146 - RNA, 18 nt, Artificial Sequence
  Description of Artificial Sequence: Synthetic oligonucleotide
uuaauauuaggauggaaa

SEQ ID NO: 47147 - RNA, 18 nt, Artificial Sequence
  Description of Artificial Sequence: Synthetic oligonucleotide
auuguuuaauauuaggau

SEQ ID NO: 47148 - RNA, 18 nt, Artificial Sequence
  Description of Artificial Sequence: Synthetic oligonucleotide
auuauauuguuuaauauu

SEQ ID NO: 47149 - RNA, 18 nt, Artificial Sequence
  Description of Artificial Sequence: Synthetic oligonucleotide
cuuucauuauauuguuua

SEQ ID NO: 47150 - RNA, 18 nt, Artificial Sequence
  Description of Artificial Sequence: Synthetic oligonucleotide
gcuuucuuucauuauauu

SEQ ID NO: 47151 - RNA, 18 nt, Artificial Sequence
  Description of Artificial Sequence: Synthetic oligonucleotide
gaugugugacaccugaag

SEQ ID NO: 47152 - RNA, 18 nt, Artificial Sequence
  Description of Artificial Sequence: Synthetic oligonucleotide
aaauggaugugugacacc

SEQ ID NO: 47153 - RNA, 18 nt, Artificial Sequence
  Description of Artificial Sequence: Synthetic oligonucleotide
gauggaaauggaugugug

SEQ ID NO: 47154 - RNA, 18 nt, Artificial Sequence
  Description of Artificial Sequence: Synthetic oligonucleotide
auuaggauggaaauggau

SEQ ID NO: 47155 - RNA, 18 nt, Artificial Sequence
  Description of Artificial Sequence: Synthetic oligonucleotide
uuaauauuaggauggaaa

SEQ ID NO: 47156 - RNA, 18 nt, Artificial Sequence
  Description of Artificial Sequence: Synthetic oligonucleotide
auuguuuaauauuaggau

SEQ ID NO: 47157 - RNA, 18 nt, Artificial Sequence
  Description of Artificial Sequence: Synthetic oligonucleotide
auuauauuguuuaauauu

SEQ ID NO: 47158 - RNA, 18 nt, Artificial Sequence
  Description of Artificial Sequence: Synthetic oligonucleotide
cuuucauuauauuguuua

SEQ ID NO: 47159 - RNA, 18 nt, Artificial Sequence
  Description of Artificial Sequence: Synthetic oligonucleotide
gcuuucuuucauuauauu

SEQ ID NO: 47160 - RNA, 18 nt, Artificial Sequence
  Description of Artificial Sequence: Synthetic oligonucleotide
guaaagcuuucuuucauu

SEQ ID NO: 47161 - RNA, 18 nt, Artificial Sequence
  Description of Artificial Sequence: Synthetic oligonucleotide
uuguuguaaagcuuucuu

SEQ ID NO: 47162 - RNA, 18 nt, Artificial Sequence
  Description of Artificial Sequence: Synthetic oligonucleotide
uagacuuguuguaaagcu

SEQ ID NO: 47163 - RNA, 18 nt, Artificial Sequence
  Description of Artificial Sequence: Synthetic oligonucleotide
cuauuuagacuuguugua

SEQ ID NO: 47164 - RNA, 18 nt, Artificial Sequence
  Description of Artificial Sequence: Synthetic oligonucleotide
aaaaacuauuuagacuug

SEQ ID NO: 47165 - RNA, 18 nt, Artificial Sequence
  Description of Artificial Sequence: Synthetic oligonucleotide
aaaauaaaaacuauuuag

SEQ ID NO: 47166 - RNA, 18 nt, Artificial Sequence
  Description of Artificial Sequence: Synthetic oligonucleotide
gcccgaaaauaaaaacua

SEQ ID NO: 47167 - RNA, 18 nt, Artificial Sequence
  Description of Artificial Sequence: Synthetic oligonucleotide
agacugcccgaaaauaaa

SEQ ID NO: 47168 - RNA, 18 nt, Artificial Sequence
  Description of Artificial Sequence: Synthetic oligonucleotide
uuaaaagacugcccgaaa

SEQ ID NO: 47169 - RNA, 18 nt, Artificial Sequence
  Description of Artificial Sequence: Synthetic oligonucleotide
cuuuguuaaaagacugcc

SEQ ID NO: 47170 - RNA, 18 nt, Artificial Sequence
  Description of Artificial Sequence: Synthetic oligonucleotide
cuuugcuuuguuaaaaga

SEQ ID NO: 47171 - RNA, 18 nt, Artificial Sequence
  Description of Artificial Sequence: Synthetic oligonucleotide
gguugcuuugcuuuguua

SEQ ID NO: 47172 - RNA, 18 nt, Artificial Sequence
  Description of Artificial Sequence: Synthetic oligonucleotide
cacacgguugcuuugcuu

SEQ ID NO: 47173 - RNA, 18 nt, Artificial Sequence
  Description of Artificial Sequence: Synthetic oligonucleotide
uaacucacacgguugcuu

SEQ ID NO: 47174 - RNA, 18 nt, Artificial Sequence
  Description of Artificial Sequence: Synthetic oligonucleotide
ugaccuaacucacacggu

SEQ ID NO: 47175 - RNA, 18 nt, Artificial Sequence
  Description of Artificial Sequence: Synthetic oligonucleotide
ucuggugaccuaacucac

SEQ ID NO: 47176 - RNA, 18 nt, Artificial Sequence
  Description of Artificial Sequence: Synthetic oligonucleotide
gugucucuggugaccuaa

SEQ ID NO: 47177 - RNA, 18 nt, Artificial Sequence
  Description of Artificial Sequence: Synthetic oligonucleotide
gcuuggugucucugguga

SEQ ID NO: 47178 - RNA, 18 nt, Artificial Sequence
  Description of Artificial Sequence: Synthetic oligonucleotide
ccauugcuuggugucucu

SEQ ID NO: 47179 - RNA, 18 nt, Artificial Sequence
  Description of Artificial Sequence: Synthetic oligonucleotide
cuucaccauugcuuggug

SEQ ID NO: 47180 - RNA, 18 nt, Artificial Sequence
  Description of Artificial Sequence: Synthetic oligonucleotide
ggguccuucaccauugcu

SEQ ID NO: 47181 - RNA, 18 nt, Artificial Sequence
  Description of Artificial Sequence: Synthetic oligonucleotide
agagaauugggcggaggg

SEQ ID NO: 47182 - RNA, 18 nt, Artificial Sequence
  Description of Artificial Sequence: Synthetic oligonucleotide
ggauagagaauugggcgg

SEQ ID NO: 47183 - RNA, 18 nt, Artificial Sequence
  Description of Artificial Sequence: Synthetic oligonucleotide
uaguuggauagagaauug

SEQ ID NO: 47184 - RNA, 18 nt, Artificial Sequence
  Description of Artificial Sequence: Synthetic oligonucleotide
aaauuuaguuggauagag

SEQ ID NO: 47185 - RNA, 18 nt, Artificial Sequence
  Description of Artificial Sequence: Synthetic oligonucleotide
cauggaaauuuaguugga

SEQ ID NO: 47186 - RNA, 18 nt, Artificial Sequence
  Description of Artificial Sequence: Synthetic oligonucleotide
uugggcauggaaauuuag

SEQ ID NO: 47187 - RNA, 18 nt, Artificial Sequence
  Description of Artificial Sequence: Synthetic oligonucleotide
ucacuuugggcauggaaa

SEQ ID NO: 47188 - RNA, 18 nt, Artificial Sequence
  Description of Artificial Sequence: Synthetic oligonucleotide
agcuaucacuuugggcau

SEQ ID NO: 47189 - RNA, 18 nt, Artificial Sequence
  Description of Artificial Sequence: Synthetic oligonucleotide
augauagcuaucacuuug

SEQ ID NO: 47190 - RNA, 18 nt, Artificial Sequence
  Description of Artificial Sequence: Synthetic oligonucleotide
aaaaaaugauagcuauca

SEQ ID NO: 47191 - RNA, 18 nt, Artificial Sequence
  Description of Artificial Sequence: Synthetic oligonucleotide
cguggaaaaaaugauagc

SEQ ID NO: 47192 - RNA, 18 nt, Artificial Sequence
  Description of Artificial Sequence: Synthetic oligonucleotide
uacaccguggaaaaaaug

SEQ ID NO: 47193 - RNA, 18 nt, Artificial Sequence
  Description of Artificial Sequence: Synthetic oligonucleotide
gcagauacaccguggaaa

SEQ ID NO: 47194 - RNA, 18 nt, Artificial Sequence
  Description of Artificial Sequence: Synthetic oligonucleotide
gauuugcagauacaccgu

SEQ ID NO: 47195 - RNA, 18 nt, Artificial Sequence
  Description of Artificial Sequence: Synthetic oligonucleotide
ggguggauuugcagauac

SEQ ID NO: 47196 - RNA, 18 nt, Artificial Sequence
  Description of Artificial Sequence: Synthetic oligonucleotide
acaguggguggauuugca

SEQ ID NO: 47197 - RNA, 18 nt, Artificial Sequence
  Description of Artificial Sequence: Synthetic oligonucleotide
ccgggacaguggguggau

SEQ ID NO: 47198 - RNA, 18 nt, Artificial Sequence
  Description of Artificial Sequence: Synthetic oligonucleotide
ccaccccgggacaguggg

SEQ ID NO: 47199 - RNA, 18 nt, Artificial Sequence
  Description of Artificial Sequence: Synthetic oligonucleotide
cccagccaccccgggaca

SEQ ID NO: 47200 - RNA, 18 nt, Artificial Sequence
  Description of Artificial Sequence: Synthetic oligonucleotide
aagcucccagccaccccg

SEQ ID NO: 47201 - RNA, 18 nt, Artificial Sequence
  Description of Artificial Sequence: Synthetic oligonucleotide
uuaaaaagcucccagcca

SEQ ID NO: 47202 - RNA, 18 nt, Artificial Sequence
  Description of Artificial Sequence: Synthetic oligonucleotide
acccguuaaaaagcuccc

SEQ ID NO: 47203 - RNA, 18 nt, Artificial Sequence
  Description of Artificial Sequence: Synthetic oligonucleotide
ucucaacccguuaaaaag

SEQ ID NO: 47204 - RNA, 18 nt, Artificial Sequence
  Description of Artificial Sequence: Synthetic oligonucleotide
gcaacucucaacccguua

SEQ ID NO: 47205 - RNA, 18 nt, Artificial Sequence
  Description of Artificial Sequence: Synthetic oligonucleotide
aaaaagcaacucucaacc

SEQ ID NO: 47206 - RNA, 18 nt, Artificial Sequence
  Description of Artificial Sequence: Synthetic oligonucleotide
accuuaaaaagcaacucu

SEQ ID NO: 47207 - RNA, 18 nt, Artificial Sequence
  Description of Artificial Sequence: Synthetic oligonucleotide
ccacaaccuuaaaaagca

SEQ ID NO: 47208 - RNA, 18 nt, Artificial Sequence
  Description of Artificial Sequence: Synthetic oligonucleotide
cucacccacaaccuuaaa

SEQ ID NO: 47209 - RNA, 18 nt, Artificial Sequence
  Description of Artificial Sequence: Synthetic oligonucleotide
cucagcucacccacaacc

SEQ ID NO: 47210 - RNA, 18 nt, Artificial Sequence
  Description of Artificial Sequence: Synthetic oligonucleotide
cccaucucagcucaccca

SEQ ID NO: 47211 - RNA, 18 nt, Artificial Sequence
  Description of Artificial Sequence: Synthetic oligonucleotide
agucacccaucucagcuc

SEQ ID NO: 47212 - RNA, 18 nt, Artificial Sequence
  Description of Artificial Sequence: Synthetic oligonucleotide
gacacagucacccaucuc

SEQ ID NO: 47213 - RNA, 18 nt, Artificial Sequence
  Description of Artificial Sequence: Synthetic oligonucleotide
cugaagacacagucaccc

SEQ ID NO: 47214 - RNA, 18 nt, Artificial Sequence
  Description of Artificial Sequence: Synthetic oligonucleotide
gucuccugaagacacagu

SEQ ID NO: 47215 - RNA, 18 nt, Artificial Sequence
  Description of Artificial Sequence: Synthetic oligonucleotide
guagugucuccugaagac

SEQ ID NO: 47216 - RNA, 18 nt, Artificial Sequence
  Description of Artificial Sequence: Synthetic oligonucleotide
aaaugguagugucuccug

SEQ ID NO: 47217 - RNA, 18 nt, Artificial Sequence
  Description of Artificial Sequence: Synthetic oligonucleotide
aaaccaaaugguaguguc

SEQ ID NO: 47218 - RNA, 18 nt, Artificial Sequence
  Description of Artificial Sequence: Synthetic oligonucleotide
aaaucaaaccaaauggua

SEQ ID NO: 47219 - RNA, 18 nt, Artificial Sequence
  Description of Artificial Sequence: Synthetic oligonucleotide
cucuguuuauugaugaca

SEQ ID NO: 47220 - RNA, 18 nt, Artificial Sequence
  Description of Artificial Sequence: Synthetic oligonucleotide
aagaacucuguuuauuga

SEQ ID NO: 47221 - RNA, 18 nt, Artificial Sequence
  Description of Artificial Sequence: Synthetic oligonucleotide
uugcgaagaacucuguuu

SEQ ID NO: 47222 - RNA, 18 nt, Artificial Sequence
  Description of Artificial Sequence: Synthetic oligonucleotide
ccagguugcgaagaacuc

SEQ ID NO: 47223 - RNA, 18 nt, Artificial Sequence
  Description of Artificial Sequence: Synthetic oligonucleotide
gcuagccagguugcgaag

SEQ ID NO: 47224 - RNA, 18 nt, Artificial Sequence
  Description of Artificial Sequence: Synthetic oligonucleotide
uuuucgcuagccagguug

SEQ ID NO: 47225 - RNA, 18 nt, Artificial Sequence
  Description of Artificial Sequence: Synthetic oligonucleotide
guugcuuuucgcuagcca

SEQ ID NO: 47226 - RNA, 18 nt, Artificial Sequence
  Description of Artificial Sequence: Synthetic oligonucleotide
caucuguugcuuuucgcu

SEQ ID NO: 47227 - RNA, 18 nt, Artificial Sequence
  Description of Artificial Sequence: Synthetic oligonucleotide
gcgcccaucuguugcuuu

SEQ ID NO: 47228 - RNA, 18 nt, Artificial Sequence
  Description of Artificial Sequence: Synthetic oligonucleotide
cgucugcgcccaucuguu

SEQ ID NO: 47229 - RNA, 18 nt, Artificial Sequence
  Description of Artificial Sequence: Synthetic oligonucleotide
caugccgucugcgcccau

SEQ ID NO: 47230 - RNA, 18 nt, Artificial Sequence
  Description of Artificial Sequence: Synthetic oligonucleotide
ucauacaugccgucugcg

SEQ ID NO: 47231 - RNA, 18 nt, Artificial Sequence
  Description of Artificial Sequence: Synthetic oligonucleotide
guuuaucauacaugccgu

SEQ ID NO: 47232 - RNA, 18 nt, Artificial Sequence
  Description of Artificial Sequence: Synthetic oligonucleotide
ccuuaguuuaucauacau

SEQ ID NO: 47233 - RNA, 18 nt, Artificial Sequence
  Description of Artificial Sequence: Synthetic oligonucleotide
aacauccuuaguuuauca

SEQ ID NO: 47234 - RNA, 18 nt, Artificial Sequence
  Description of Artificial Sequence: Synthetic oligonucleotide
cguucaacauccuuaguu

SEQ ID NO: 47235 - RNA, 18 nt, Artificial Sequence
  Description of Artificial Sequence: Synthetic oligonucleotide
cugcccguucaacauccu

SEQ ID NO: 47236 - RNA, 18 nt, Artificial Sequence
  Description of Artificial Sequence: Synthetic oligonucleotide
ccggucugcccguucaac

SEQ ID NO: 47237 - RNA, 18 nt, Artificial Sequence
  Description of Artificial Sequence: Synthetic oligonucleotide
agcuuccggucugcccgu

SEQ ID NO: 47238 - RNA, 18 nt, Artificial Sequence
  Description of Artificial Sequence: Synthetic oligonucleotide
gccccagcuuccggucug

SEQ ID NO: 47239 - RNA, 18 nt, Artificial Sequence
  Description of Artificial Sequence: Synthetic oligonucleotide
cgggugccccagcuuccg

SEQ ID NO: 47240 - RNA, 18 nt, Artificial Sequence
  Description of Artificial Sequence: Synthetic oligonucleotide
cagggcgggugccccagc

SEQ ID NO: 47241 - RNA, 18 nt, Artificial Sequence
  Description of Artificial Sequence: Synthetic oligonucleotide
ccaaccagggcgggugcc

SEQ ID NO: 47242 - RNA, 18 nt, Artificial Sequence
  Description of Artificial Sequence: Synthetic oligonucleotide
ggauaccaaccagggcgg

SEQ ID NO: 47243 - RNA, 18 nt, Artificial Sequence
  Description of Artificial Sequence: Synthetic oligonucleotide
uccccggauaccaaccag

SEQ ID NO: 47244 - RNA, 18 nt, Artificial Sequence
  Description of Artificial Sequence: Synthetic oligonucleotide
cgaaguccccggauacca

SEQ ID NO: 47245 - RNA, 18 nt, Artificial Sequence
  Description of Artificial Sequence: Synthetic oligonucleotide
ggcaccgaaguccccgga

SEQ ID NO: 47246 - RNA, 18 nt, Artificial Sequence
  Description of Artificial Sequence: Synthetic oligonucleotide
gcccuggcaccgaagucc

SEQ ID NO: 47247 - RNA, 18 nt, Artificial Sequence
  Description of Artificial Sequence: Synthetic oligonucleotide
agguugcccuggcaccga

SEQ ID NO: 47248 - RNA, 18 nt, Artificial Sequence
  Description of Artificial Sequence: Synthetic oligonucleotide
ugcguagguugcccuggc

SEQ ID NO: 47249 - RNA, 18 nt, Artificial Sequence
  Description of Artificial Sequence: Synthetic oligonucleotide
gccgcgggauuccacggg

SEQ ID NO: 47250 - RNA, 18 nt, Artificial Sequence
  Description of Artificial Sequence: Synthetic oligonucleotide
augcuggcucuggcuggg

SEQ ID NO: 47251 - RNA, 18 nt, Artificial Sequence
  Description of Artificial Sequence: Synthetic oligonucleotide
ucugcaugcuggcucugg

SEQ ID NO: 47252 - RNA, 18 nt, Artificial Sequence
  Description of Artificial Sequence: Synthetic oligonucleotide
ccagaaagaccagaggca

SEQ ID NO: 47253 - RNA, 18 nt, Artificial Sequence
  Description of Artificial Sequence: Synthetic oligonucleotide
aagucccagaaagaccag

SEQ ID NO: 47254 - RNA, 18 nt, Artificial Sequence
  Description of Artificial Sequence: Synthetic oligonucleotide
gcccgaagucccagaaag

SEQ ID NO: 47255 - RNA, 18 nt, Artificial Sequence
  Description of Artificial Sequence: Synthetic oligonucleotide
cccgagcccgaaguccca

SEQ ID NO: 47256 - RNA, 18 nt, Artificial Sequence
  Description of Artificial Sequence: Synthetic oligonucleotide
cgcaccccgagcccgaag

SEQ ID NO: 47257 - RNA, 18 nt, Artificial Sequence
  Description of Artificial Sequence: Synthetic oligonucleotide
guccgcgcaccccgagcc

SEQ ID NO: 47258 - RNA, 18 nt, Artificial Sequence
  Description of Artificial Sequence: Synthetic oligonucleotide
cucggguccgcgcacccc

SEQ ID NO: 47259 - RNA, 18 nt, Artificial Sequence
  Description of Artificial Sequence: Synthetic oligonucleotide
ugacccucggguccgcgc

SEQ ID NO: 47260 - RNA, 18 nt, Artificial Sequence
  Description of Artificial Sequence: Synthetic oligonucleotide
uccccugacccucggguc

SEQ ID NO: 47261 - RNA, 18 nt, Artificial Sequence
  Description of Artificial Sequence: Synthetic oligonucleotide
uguccuccccugacccuc

SEQ ID NO: 47262 - RNA, 18 nt, Artificial Sequence
  Description of Artificial Sequence: Synthetic oligonucleotide
cccuguguccuccccuga

SEQ ID NO: 47263 - RNA, 18 nt, Artificial Sequence
  Description of Artificial Sequence: Synthetic oligonucleotide
cgagucccuguguccucc

SEQ ID NO: 47264 - RNA, 18 nt, Artificial Sequence
  Description of Artificial Sequence: Synthetic oligonucleotide
cgucgcgagucccugugu

SEQ ID NO: 47265 - RNA, 18 nt, Artificial Sequence
  Description of Artificial Sequence: Synthetic oligonucleotide
gcgggcgucgcgaguccc

SEQ ID NO: 47266 - RNA, 18 nt, Artificial Sequence
  Description of Artificial Sequence: Synthetic oligonucleotide
ccagcgcgggcgucgcga

SEQ ID NO: 47267 - RNA, 18 nt, Artificial Sequence
  Description of Artificial Sequence: Synthetic oligonucleotide
ccgggccagcgcgggcgu

SEQ ID NO: 47268 - RNA, 18 nt, Artificial Sequence
  Description of Artificial Sequence: Synthetic oligonucleotide
ggcggccgggccagcgcg

SEQ ID NO: 47269 - RNA, 18 nt, Artificial Sequence
  Description of Artificial Sequence: Synthetic oligonucleotide
cggucggcggccgggcca

SEQ ID NO: 47270 - RNA, 18 nt, Artificial Sequence
  Description of Artificial Sequence: Synthetic oligonucleotide
ucagucggucggcggccg

SEQ ID NO: 47271 - RNA, 18 nt, Artificial Sequence
  Description of Artificial Sequence: Synthetic oligonucleotide
gggccucagucggucggc

SEQ ID NO: 47272 - RNA, 18 nt, Artificial Sequence
  Description of Artificial Sequence: Synthetic oligonucleotide
uccccgggccucagucgg

SEQ ID NO: 47273 - RNA, 18 nt, Artificial Sequence
  Description of Artificial Sequence: Synthetic oligonucleotide
gcagguccccgggccuca

SEQ ID NO: 47274 - RNA, 18 nt, Artificial Sequence
  Description of Artificial Sequence: Synthetic oligonucleotide
ccgccgcagguccccggg

SEQ ID NO: 47275 - RNA, 18 nt, Artificial Sequence
  Description of Artificial Sequence: Synthetic oligonucleotide
agcagccgccgcaggucc

SEQ ID NO: 47276 - RNA, 18 nt, Artificial Sequence
  Description of Artificial Sequence: Synthetic oligonucleotide
gggagcagccgccgcagg

SEQ ID NO: 47277 - RNA, 18 nt, Artificial Sequence
  Description of Artificial Sequence: Synthetic oligonucleotide
ugccgggcgcggagcggg

SEQ ID NO: 47278 - RNA, 18 nt, Artificial Sequence
  Description of Artificial Sequence: Synthetic oligonucleotide
cgggcugccgggcgcgga

SEQ ID NO: 47279 - RNA, 18 nt, Artificial Sequence
  Description of Artificial Sequence: Synthetic oligonucleotide
ccucccgggcugccgggc

SEQ ID NO: 47280 - RNA, 18 nt, Artificial Sequence
  Description of Artificial Sequence: Synthetic oligonucleotide
ccuccccucccgggcugc

SEQ ID NO: 47281 - RNA, 18 nt, Artificial Sequence
  Description of Artificial Sequence: Synthetic oligonucleotide
aacgcccuccccucccgg

SEQ ID NO: 47282 - RNA, 18 nt, Artificial Sequence
  Description of Artificial Sequence: Synthetic oligonucleotide
aagcaaacgcccuccccu

SEQ ID NO: 47283 - RNA, 18 nt, Artificial Sequence
  Description of Artificial Sequence: Synthetic oligonucleotide
gagccaagcaaacgcccu

SEQ ID NO: 47284 - RNA, 18 nt, Artificial Sequence
  Description of Artificial Sequence: Synthetic oligonucleotide
gagaagagccaagcaaac

SEQ ID NO: 47285 - RNA, 18 nt, Artificial Sequence
  Description of Artificial Sequence: Synthetic oligonucleotide
guaucgagaagagccaag

SEQ ID NO: 47286 - RNA, 18 nt, Artificial Sequence
  Description of Artificial Sequence: Synthetic oligonucleotide
cuccaguaucgagaagag

SEQ ID NO: 47287 - RNA, 18 nt, Artificial Sequence
  Description of Artificial Sequence: Synthetic oligonucleotide
ugcuucuccaguaucgag

SEQ ID NO: 47288 - RNA, 18 nt, Artificial Sequence
  Description of Artificial Sequence: Synthetic oligonucleotide
gccccugcuucuccagua

SEQ ID NO: 47289 - RNA, 18 nt, Artificial Sequence
  Description of Artificial Sequence: Synthetic oligonucleotide
gcccagccccugcuucuc

SEQ ID NO: 47290 - RNA, 18 nt, Artificial Sequence
  Description of Artificial Sequence: Synthetic oligonucleotide
uaagggcccagccccugc

SEQ ID NO: 47291 - RNA, 18 nt, Artificial Sequence
  Description of Artificial Sequence: Synthetic oligonucleotide
guucuuaagggcccagcc

SEQ ID NO: 47292 - RNA, 18 nt, Artificial Sequence
  Description of Artificial Sequence: Synthetic oligonucleotide
gggcuguucuuaagggcc

SEQ ID NO: 47293 - RNA, 18 nt, Artificial Sequence
  Description of Artificial Sequence: Synthetic oligonucleotide
cgggcgggcuguucuuaa

SEQ ID NO: 47294 - RNA, 18 nt, Artificial Sequence
  Description of Artificial Sequence: Synthetic oligonucleotide
aaacucgggcgggcuguu

SEQ ID NO: 47295 - RNA, 18 nt, Artificial Sequence
  Description of Artificial Sequence: Synthetic oligonucleotide
uucgaaaacucgggcggg

SEQ ID NO: 47296 - RNA, 18 nt, Artificial Sequence
  Description of Artificial Sequence: Synthetic oligonucleotide
gcagcuucgaaaacucgg

SEQ ID NO: 47297 - RNA, 18 nt, Artificial Sequence
  Description of Artificial Sequence: Synthetic oligonucleotide
cuaccgcagcuucgaaaa

SEQ ID NO: 47298 - RNA, 18 nt, Artificial Sequence
  Description of Artificial Sequence: Synthetic oligonucleotide
uuucucuaccgcagcuuc

SEQ ID NO: 47299 - RNA, 18 nt, Artificial Sequence
  Description of Artificial Sequence: Synthetic oligonucleotide
ggguuucucuaccgcagc

SEQ ID NO: 47300 - RNA, 18 nt, Artificial Sequence
  Description of Artificial Sequence: Synthetic oligonucleotide
ugaguuacaggauuuggg

SEQ ID NO: 47301 - RNA, 18 nt, Artificial Sequence
  Description of Artificial Sequence: Synthetic oligonucleotide
gggugugaguuacaggau

SEQ ID NO: 47302 - RNA, 18 nt, Artificial Sequence
  Description of Artificial Sequence: Synthetic oligonucleotide
gggucagagcccgggcag

SEQ ID NO: 47303 - RNA, 18 nt, Artificial Sequence
  Description of Artificial Sequence: Synthetic oligonucleotide
ccagccccucucuccggg

SEQ ID NO: 47304 - RNA, 18 nt, Artificial Sequence
  Description of Artificial Sequence: Synthetic oligonucleotide
ucagcccagccccucucu

SEQ ID NO: 47305 - RNA, 18 nt, Artificial Sequence
  Description of Artificial Sequence: Synthetic oligonucleotide
ccugaucagcccagcccc

SEQ ID NO: 47306 - RNA, 18 nt, Artificial Sequence
  Description of Artificial Sequence: Synthetic oligonucleotide
cccgcccugaucagccca

SEQ ID NO: 47307 - RNA, 18 nt, Artificial Sequence
  Description of Artificial Sequence: Synthetic oligonucleotide
uucgccccgcccugauca

SEQ ID NO: 47308 - RNA, 18 nt, Artificial Sequence
  Description of Artificial Sequence: Synthetic oligonucleotide
aagacuucgccccgcccu

SEQ ID NO: 47309 - RNA, 18 nt, Artificial Sequence
  Description of Artificial Sequence: Synthetic oligonucleotide
aggagaagacuucgcccc

SEQ ID NO: 47310 - RNA, 18 nt, Artificial Sequence
  Description of Artificial Sequence: Synthetic oligonucleotide
caacuaggagaagacuuc

SEQ ID NO: 47311 - RNA, 18 nt, Artificial Sequence
  Description of Artificial Sequence: Synthetic oligonucleotide
ucgcucaacuaggagaag

SEQ ID NO: 47312 - RNA, 18 nt, Artificial Sequence
  Description of Artificial Sequence: Synthetic oligonucleotide
ccuucucgcucaacuagg

SEQ ID NO: 47313 - RNA, 18 nt, Artificial Sequence
  Description of Artificial Sequence: Synthetic oligonucleotide
ggccuccuucucgcucaa

SEQ ID NO: 47314 - RNA, 18 nt, Artificial Sequence
  Description of Artificial Sequence: Synthetic oligonucleotide
gggccuccuucucgcuca

SEQ ID NO: 47315 - RNA, 18 nt, Artificial Sequence
  Description of Artificial Sequence: Synthetic oligonucleotide
uuggcuaagcccaaaggg

SEQ ID NO: 47316 - RNA, 18 nt, Artificial Sequence
  Description of Artificial Sequence: Synthetic oligonucleotide
cagucuuggcuaagccca

SEQ ID NO: 47317 - RNA, 18 nt, Artificial Sequence
  Description of Artificial Sequence: Synthetic oligonucleotide
acuuucagucuuggcuaa

SEQ ID NO: 47318 - RNA, 18 nt, Artificial Sequence
  Description of Artificial Sequence: Synthetic oligonucleotide
uggagacuuucagucuug

SEQ ID NO: 47319 - RNA, 18 nt, Artificial Sequence
  Description of Artificial Sequence: Synthetic oligonucleotide
guugguggagacuuucag

SEQ ID NO: 47320 - RNA, 18 nt, Artificial Sequence
  Description of Artificial Sequence: Synthetic oligonucleotide
gccggguugguggagacu

SEQ ID NO: 47321 - RNA, 18 nt, Artificial Sequence
  Description of Artificial Sequence: Synthetic oligonucleotide
accccgccggguuggugg

SEQ ID NO: 47322 - RNA, 18 nt, Artificial Sequence
  Description of Artificial Sequence: Synthetic oligonucleotide
ccccaaccccgccggguu

SEQ ID NO: 47323 - RNA, 18 nt, Artificial Sequence
  Description of Artificial Sequence: Synthetic oligonucleotide
gaagcccccaaccccgcc

SEQ ID NO: 47324 - RNA, 18 nt, Artificial Sequence
  Description of Artificial Sequence: Synthetic oligonucleotide
ggagagaagcccccaacc

SEQ ID NO: 47325 - RNA, 18 nt, Artificial Sequence
  Description of Artificial Sequence: Synthetic oligonucleotide
gggagagaagcccccaac

SEQ ID NO: 47326 - RNA, 18 nt, Artificial Sequence
  Description of Artificial Sequence: Synthetic oligonucleotide
cccugagagugacuuggg

SEQ ID NO: 47327 - RNA, 18 nt, Artificial Sequence
  Description of Artificial Sequence: Synthetic oligonucleotide
agcugcccugagagugac

SEQ ID NO: 47328 - RNA, 18 nt, Artificial Sequence
  Description of Artificial Sequence: Synthetic oligonucleotide
ggaggagcugcccugaga

SEQ ID NO: 47329 - RNA, 18 nt, Artificial Sequence
  Description of Artificial Sequence: Synthetic oligonucleotide
gggaggagcugcccugag

SEQ ID NO: 47330 - RNA, 18 nt, Artificial Sequence
  Description of Artificial Sequence: Synthetic oligonucleotide
uucuaggcccguaguggg

SEQ ID NO: 47331 - RNA, 18 nt, Artificial Sequence
  Description of Artificial Sequence: Synthetic oligonucleotide
aucccuucuaggcccgua

SEQ ID NO: 47332 - RNA, 18 nt, Artificial Sequence
  Description of Artificial Sequence: Synthetic oligonucleotide
uccccaucccuucuaggc

SEQ ID NO: 47333 - RNA, 18 nt, Artificial Sequence
  Description of Artificial Sequence: Synthetic oligonucleotide
uggguucuacagauccca

SEQ ID NO: 47334 - RNA, 18 nt, Artificial Sequence
  Description of Artificial Sequence: Synthetic oligonucleotide
aaccauggguucuacaga

SEQ ID NO: 47335 - RNA, 18 nt, Artificial Sequence
  Description of Artificial Sequence: Synthetic oligonucleotide
ccgcaaaccauggguucu

SEQ ID NO: 47336 - RNA, 18 nt, Artificial Sequence
  Description of Artificial Sequence: Synthetic oligonucleotide
ugucaccgcaaaccaugg

SEQ ID NO: 47337 - RNA, 18 nt, Artificial Sequence
  Description of Artificial Sequence: Synthetic oligonucleotide
cugagugucaccgcaaac

SEQ ID NO: 47338 - RNA, 18 nt, Artificial Sequence
  Description of Artificial Sequence: Synthetic oligonucleotide
ccccucugagugucaccg

SEQ ID NO: 47339 - RNA, 18 nt, Artificial Sequence
  Description of Artificial Sequence: Synthetic oligonucleotide
aagauccccucugagugu

SEQ ID NO: 47340 - RNA, 18 nt, Artificial Sequence
  Description of Artificial Sequence: Synthetic oligonucleotide
ucccaaagauccccucug

SEQ ID NO: 47341 - RNA, 18 nt, Artificial Sequence
  Description of Artificial Sequence: Synthetic oligonucleotide
aaaucucccaaagauccc

SEQ ID NO: 47342 - RNA, 18 nt, Artificial Sequence
  Description of Artificial Sequence: Synthetic oligonucleotide
ucuauaaaucucccaaag

SEQ ID NO: 47343 - RNA, 18 nt, Artificial Sequence
  Description of Artificial Sequence: Synthetic oligonucleotide
ccggcucuauaaaucucc

SEQ ID NO: 47344 - RNA, 18 nt, Artificial Sequence
  Description of Artificial Sequence: Synthetic oligonucleotide
aagaaccggcucuauaaa

SEQ ID NO: 47345 - RNA, 18 nt, Artificial Sequence
  Description of Artificial Sequence: Synthetic oligonucleotide
gcgcuaagaaccggcucu

SEQ ID NO: 47346 - RNA, 18 nt, Artificial Sequence
  Description of Artificial Sequence: Synthetic oligonucleotide
acaaagcgcuaagaaccg

SEQ ID NO: 47347 - RNA, 18 nt, Artificial Sequence
  Description of Artificial Sequence: Synthetic oligonucleotide
aacccacaaagcgcuaag

SEQ ID NO: 47348 - RNA, 18 nt, Artificial Sequence
  Description of Artificial Sequence: Synthetic oligonucleotide
cucugaacccacaaagcg

SEQ ID NO: 47349 - RNA, 18 nt, Artificial Sequence
  Description of Artificial Sequence: Synthetic oligonucleotide
ccagccucugaacccaca

SEQ ID NO: 47350 - RNA, 18 nt, Artificial Sequence
  Description of Artificial Sequence: Synthetic oligonucleotide
ugcagccagccucugaac

SEQ ID NO: 47351 - RNA, 18 nt, Artificial Sequence
  Description of Artificial Sequence: Synthetic oligonucleotide
aacacugcagccagccuc

SEQ ID NO: 47352 - RNA, 18 nt, Artificial Sequence
  Description of Artificial Sequence: Synthetic oligonucleotide
ucauaaacacugcagcca

SEQ ID NO: 47353 - RNA, 18 nt, Artificial Sequence
  Description of Artificial Sequence: Synthetic oligonucleotide
ccucuucauaaacacugc

SEQ ID NO: 47354 - RNA, 18 nt, Artificial Sequence
  Description of Artificial Sequence: Synthetic oligonucleotide
cugccccucuucauaaac

SEQ ID NO: 47355 - RNA, 18 nt, Artificial Sequence
  Description of Artificial Sequence: Synthetic oligonucleotide
gcccacugccccucuuca

SEQ ID NO: 47356 - RNA, 18 nt, Artificial Sequence
  Description of Artificial Sequence: Synthetic oligonucleotide
ccccagcccacugccccu

SEQ ID NO: 47357 - RNA, 18 nt, Artificial Sequence
  Description of Artificial Sequence: Synthetic oligonucleotide
aguguccccagcccacug

SEQ ID NO: 47358 - RNA, 18 nt, Artificial Sequence
  Description of Artificial Sequence: Synthetic oligonucleotide
ccagcaguguccccagcc

SEQ ID NO: 47359 - RNA, 18 nt, Artificial Sequence
  Description of Artificial Sequence: Synthetic oligonucleotide
uaaccccagcaguguccc

SEQ ID NO: 47360 - RNA, 18 nt, Artificial Sequence
  Description of Artificial Sequence: Synthetic oligonucleotide
agccauaaccccagcagu

SEQ ID NO: 47361 - RNA, 18 nt, Artificial Sequence
  Description of Artificial Sequence: Synthetic oligonucleotide
acuacagccauaacccca

SEQ ID NO: 47362 - RNA, 18 nt, Artificial Sequence
  Description of Artificial Sequence: Synthetic oligonucleotide
accucacuacagccauaa

SEQ ID NO: 47363 - RNA, 18 nt, Artificial Sequence
  Description of Artificial Sequence: Synthetic oligonucleotide
cauggaccucacuacagc

SEQ ID NO: 47364 - RNA, 18 nt, Artificial Sequence
  Description of Artificial Sequence: Synthetic oligonucleotide
guacacauggaccucacu

SEQ ID NO: 47365 - RNA, 18 nt, Artificial Sequence
  Description of Artificial Sequence: Synthetic oligonucleotide
aacaaguacacauggacc

SEQ ID NO: 47366 - RNA, 18 nt, Artificial Sequence
  Description of Artificial Sequence: Synthetic oligonucleotide
caaggaacaaguacacau

SEQ ID NO: 47367 - RNA, 18 nt, Artificial Sequence
  Description of Artificial Sequence: Synthetic oligonucleotide
caugccaaggaacaagua

SEQ ID NO: 47368 - RNA, 18 nt, Artificial Sequence
  Description of Artificial Sequence: Synthetic oligonucleotide
agacacaugccaaggaac

SEQ ID NO: 47369 - RNA, 18 nt, Artificial Sequence
  Description of Artificial Sequence: Synthetic oligonucleotide
gagucagacacaugccaa

SEQ ID NO: 47370 - RNA, 18 nt, Artificial Sequence
  Description of Artificial Sequence: Synthetic oligonucleotide
acacagagucagacacau

SEQ ID NO: 47371 - RNA, 18 nt, Artificial Sequence
  Description of Artificial Sequence: Synthetic oligonucleotide
cagcaacacagagucaga

SEQ ID NO: 47372 - RNA, 18 nt, Artificial Sequence
  Description of Artificial Sequence: Synthetic oligonucleotide
ugcagcagcaacacagag

SEQ ID NO: 47373 - RNA, 18 nt, Artificial Sequence
  Description of Artificial Sequence: Synthetic oligonucleotide
uguacugcagcagcaaca

SEQ ID NO: 47374 - RNA, 18 nt, Artificial Sequence
  Description of Artificial Sequence: Synthetic oligonucleotide
cccacuguacugcagcag

SEQ ID NO: 47375 - RNA, 18 nt, Artificial Sequence
  Description of Artificial Sequence: Synthetic oligonucleotide
cccugcccacuguacugc

SEQ ID NO: 47376 - RNA, 18 nt, Artificial Sequence
  Description of Artificial Sequence: Synthetic oligonucleotide
cgugccccugcccacugu

SEQ ID NO: 47377 - RNA, 18 nt, Artificial Sequence
  Description of Artificial Sequence: Synthetic oligonucleotide
gcaaccgugccccugccc

SEQ ID NO: 47378 - RNA, 18 nt, Artificial Sequence
  Description of Artificial Sequence: Synthetic oligonucleotide
uccaagcaaccgugcccc

SEQ ID NO: 47379 - RNA, 18 nt, Artificial Sequence
  Description of Artificial Sequence: Synthetic oligonucleotide
cccaguccaagcaaccgu

SEQ ID NO: 47380 - RNA, 18 nt, Artificial Sequence
  Description of Artificial Sequence: Synthetic oligonucleotide
ggcagcccaguccaagca

SEQ ID NO: 47381 - RNA, 18 nt, Artificial Sequence
  Description of Artificial Sequence: Synthetic oligonucleotide
caucgggcagcccagucc

SEQ ID NO: 47382 - RNA, 18 nt, Artificial Sequence
  Description of Artificial Sequence: Synthetic oligonucleotide
ccagacaucgggcagccc

SEQ ID NO: 47383 - RNA, 18 nt, Artificial Sequence
  Description of Artificial Sequence: Synthetic oligonucleotide
ccaugccagacaucgggc

SEQ ID NO: 47384 - RNA, 18 nt, Artificial Sequence
  Description of Artificial Sequence: Synthetic oligonucleotide
accagccaugccagacau

SEQ ID NO: 47385 - RNA, 18 nt, Artificial Sequence
  Description of Artificial Sequence: Synthetic oligonucleotide
ggaccaccagccaugcca

SEQ ID NO: 47386 - RNA, 18 nt, Artificial Sequence
  Description of Artificial Sequence: Synthetic oligonucleotide
caacaggaccaccagcca

SEQ ID NO: 47387 - RNA, 18 nt, Artificial Sequence
  Description of Artificial Sequence: Synthetic oligonucleotide
aaggacaacaggaccacc

SEQ ID NO: 47388 - RNA, 18 nt, Artificial Sequence
  Description of Artificial Sequence: Synthetic oligonucleotide
aaauaaaggacaacagga

SEQ ID NO: 47389 - RNA, 18 nt, Artificial Sequence
  Description of Artificial Sequence: Synthetic oligonucleotide
cgaucaaauaaaggacaa

SEQ ID NO: 47390 - RNA, 18 nt, Artificial Sequence
  Description of Artificial Sequence: Synthetic oligonucleotide
gcuaucgaucaaauaaag

SEQ ID NO: 47391 - RNA, 18 nt, Artificial Sequence
  Description of Artificial Sequence: Synthetic oligonucleotide
ucccugcuaucgaucaaa

SEQ ID NO: 47392 - RNA, 18 nt, Artificial Sequence
  Description of Artificial Sequence: Synthetic oligonucleotide
ucaguucccugcuaucga

SEQ ID NO: 47393 - RNA, 18 nt, Artificial Sequence
  Description of Artificial Sequence: Synthetic oligonucleotide
ggcggucaguucccugcu

SEQ ID NO: 47394 - RNA, 18 nt, Artificial Sequence
  Description of Artificial Sequence: Synthetic oligonucleotide
accucggcggucaguucc

SEQ ID NO: 47395 - RNA, 18 nt, Artificial Sequence
  Description of Artificial Sequence: Synthetic oligonucleotide
ugccaaccucggcgguca

SEQ ID NO: 47396 - RNA, 18 nt, Artificial Sequence
  Description of Artificial Sequence: Synthetic oligonucleotide
accugugccaaccucggc

SEQ ID NO: 47397 - RNA, 18 nt, Artificial Sequence
  Description of Artificial Sequence: Synthetic oligonucleotide
ugccaaccugugccaacc

SEQ ID NO: 47398 - RNA, 18 nt, Artificial Sequence
  Description of Artificial Sequence: Synthetic oligonucleotide
cccccugccaaccugugc

SEQ ID NO: 47399 - RNA, 18 nt, Artificial Sequence
  Description of Artificial Sequence: Synthetic oligonucleotide
cucaucccccugccaacc

SEQ ID NO: 47400 - RNA, 18 nt, Artificial Sequence
  Description of Artificial Sequence: Synthetic oligonucleotide
gcauccucaucccccugc

SEQ ID NO: 47401 - RNA, 18 nt, Artificial Sequence
  Description of Artificial Sequence: Synthetic oligonucleotide
acaaugcauccucauccc

SEQ ID NO: 47402 - RNA, 18 nt, Artificial Sequence
  Description of Artificial Sequence: Synthetic oligonucleotide
caaccacaaugcauccuc

SEQ ID NO: 47403 - RNA, 18 nt, Artificial Sequence
  Description of Artificial Sequence: Synthetic oligonucleotide
ggagacaaccacaaugca

SEQ ID NO: 47404 - RNA, 18 nt, Artificial Sequence
  Description of Artificial Sequence: Synthetic oligonucleotide
gaggaggagacaaccaca

SEQ ID NO: 47405 - RNA, 18 nt, Artificial Sequence
  Description of Artificial Sequence: Synthetic oligonucleotide
gagaggaggaggagacaa

SEQ ID NO: 47406 - RNA, 18 nt, Artificial Sequence
  Description of Artificial Sequence: Synthetic oligonucleotide
agaaggagaggaggagga

SEQ ID NO: 47407 - RNA, 18 nt, Artificial Sequence
  Description of Artificial Sequence: Synthetic oligonucleotide
gaggaagaaggagaggag

SEQ ID NO: 47408 - RNA, 18 nt, Artificial Sequence
  Description of Artificial Sequence: Synthetic oligonucleotide
gggaagaggaagaaggag

SEQ ID NO: 47409 - RNA, 18 nt, Artificial Sequence
  Description of Artificial Sequence: Synthetic oligonucleotide
aaaggagaggaggaaggg

SEQ ID NO: 47410 - RNA, 18 nt, Artificial Sequence
  Description of Artificial Sequence: Synthetic oligonucleotide
agaaaggagaggaggaag

SEQ ID NO: 47411 - RNA, 18 nt, Artificial Sequence
  Description of Artificial Sequence: Synthetic oligonucleotide
agaacagaaaggagagga

SEQ ID NO: 47412 - RNA, 18 nt, Artificial Sequence
  Description of Artificial Sequence: Synthetic oligonucleotide
gaacaagaacagaaagga

SEQ ID NO: 47413 - RNA, 18 nt, Artificial Sequence
  Description of Artificial Sequence: Synthetic oligonucleotide
agggagaacaagaacaga

SEQ ID NO: 47414 - RNA, 18 nt, Artificial Sequence
  Description of Artificial Sequence: Synthetic oligonucleotide
agaugagggagaacaaga

SEQ ID NO: 47415 - RNA, 18 nt, Artificial Sequence
  Description of Artificial Sequence: Synthetic oligonucleotide
gaggaagaugagggagaa

SEQ ID NO: 47416 - RNA, 18 nt, Artificial Sequence
  Description of Artificial Sequence: Synthetic oligonucleotide
aggaagaggaagaugagg

SEQ ID NO: 47417 - RNA, 18 nt, Artificial Sequence
  Description of Artificial Sequence: Synthetic oligonucleotide
gaagaaggaagaggaaga

SEQ ID NO: 47418 - RNA, 18 nt, Artificial Sequence
  Description of Artificial Sequence: Synthetic oligonucleotide
agggagaagaaggaagag

SEQ ID NO: 47419 - RNA, 18 nt, Artificial Sequence
  Description of Artificial Sequence: Synthetic oligonucleotide
agaagagggagaagaagg

SEQ ID NO: 47420 - RNA, 18 nt, Artificial Sequence
  Description of Artificial Sequence: Synthetic oligonucleotide
gaggaagaagagggagaa

SEQ ID NO: 47421 - RNA, 18 nt, Artificial Sequence
  Description of Artificial Sequence: Synthetic oligonucleotide
gugaagaggaagaagagg

SEQ ID NO: 47422 - RNA, 18 nt, Artificial Sequence
  Description of Artificial Sequence: Synthetic oligonucleotide
gcagagugaagaggaaga

SEQ ID NO: 47423 - RNA, 18 nt, Artificial Sequence
  Description of Artificial Sequence: Synthetic oligonucleotide
agagagcagagugaagag

SEQ ID NO: 47424 - RNA, 18 nt, Artificial Sequence
  Description of Artificial Sequence: Synthetic oligonucleotide
agagaagagagcagagug

SEQ ID NO: 47425 - RNA, 18 nt, Artificial Sequence
  Description of Artificial Sequence: Synthetic oligonucleotide
aaagaagagaagagagca

SEQ ID NO: 47426 - RNA, 18 nt, Artificial Sequence
  Description of Artificial Sequence: Synthetic oligonucleotide
ugauucacuccgcuguga

SEQ ID NO: 47427 - RNA, 18 nt, Artificial Sequence
  Description of Artificial Sequence: Synthetic oligonucleotide
cgagcugauucacuccgc

SEQ ID NO: 47428 - RNA, 18 nt, Artificial Sequence
  Description of Artificial Sequence: Synthetic oligonucleotide
accaccgagcugauucac

SEQ ID NO: 47429 - RNA, 18 nt, Artificial Sequence
  Description of Artificial Sequence: Synthetic oligonucleotide
aagacaccaccgagcuga

SEQ ID NO: 47430 - RNA, 18 nt, Artificial Sequence
  Description of Artificial Sequence: Synthetic oligonucleotide
ugacaaagacaccaccga

SEQ ID NO: 47431 - RNA, 18 nt, Artificial Sequence
  Description of Artificial Sequence: Synthetic oligonucleotide
cccguugacaaagacacc

SEQ ID NO: 47432 - RNA, 18 nt, Artificial Sequence
  Description of Artificial Sequence: Synthetic oligonucleotide
ggccgcccguugacaaag

SEQ ID NO: 47433 - RNA, 18 nt, Artificial Sequence
  Description of Artificial Sequence: Synthetic oligonucleotide
gcaguggccgcccguuga

SEQ ID NO: 47434 - RNA, 18 nt, Artificial Sequence
  Description of Artificial Sequence: Synthetic oligonucleotide
guccggcaguggccgccc

SEQ ID NO: 47435 - RNA, 18 nt, Artificial Sequence
  Description of Artificial Sequence: Synthetic oligonucleotide
guggaguccggcaguggc

SEQ ID NO: 47436 - RNA, 18 nt, Artificial Sequence
  Description of Artificial Sequence: Synthetic oligonucleotide
gccggguggaguccggca

SEQ ID NO: 47437 - RNA, 18 nt, Artificial Sequence
  Description of Artificial Sequence: Synthetic oligonucleotide
cuucugccggguggaguc

SEQ ID NO: 47438 - RNA, 18 nt, Artificial Sequence
  Description of Artificial Sequence: Synthetic oligonucleotide
acaaucuucugccgggug

SEQ ID NO: 47439 - RNA, 18 nt, Artificial Sequence
  Description of Artificial Sequence: Synthetic oligonucleotide
gcucuacaaucuucugcc

SEQ ID NO: 47440 - RNA, 18 nt, Artificial Sequence
  Description of Artificial Sequence: Synthetic oligonucleotide
agcuagcucuacaaucuu

SEQ ID NO: 47441 - RNA, 18 nt, Artificial Sequence
  Description of Artificial Sequence: Synthetic oligonucleotide
cugugagcuagcucuaca

SEQ ID NO: 47442 - RNA, 18 nt, Artificial Sequence
  Description of Artificial Sequence: Synthetic oligonucleotide
ccccgcugugagcuagcu

SEQ ID NO: 47443 - RNA, 18 nt, Artificial Sequence
  Description of Artificial Sequence: Synthetic oligonucleotide
ccgggccccgcugugagc

SEQ ID NO: 47444 - RNA, 18 nt, Artificial Sequence
  Description of Artificial Sequence: Synthetic oligonucleotide
cacggccgggccccgcug

SEQ ID NO: 47445 - RNA, 18 nt, Artificial Sequence
  Description of Artificial Sequence: Synthetic oligonucleotide
ugucgcacggccgggccc

SEQ ID NO: 47446 - RNA, 18 nt, Artificial Sequence
  Description of Artificial Sequence: Synthetic oligonucleotide
ggaaaugucgcacggccg

SEQ ID NO: 47447 - RNA, 18 nt, Artificial Sequence
  Description of Artificial Sequence: Synthetic oligonucleotide
auucgggaaaugucgcac

SEQ ID NO: 47448 - RNA, 18 nt, Artificial Sequence
  Description of Artificial Sequence: Synthetic oligonucleotide
gcagaauucgggaaaugu

SEQ ID NO: 47449 - RNA, 18 nt, Artificial Sequence
  Description of Artificial Sequence: Synthetic oligonucleotide
gauucacuccgcugugac

SEQ ID NO: 47450 - RNA, 18 nt, Artificial Sequence
  Description of Artificial Sequence: Synthetic oligonucleotide
gagcugauucacuccgcu

SEQ ID NO: 47451 - RNA, 18 nt, Artificial Sequence
  Description of Artificial Sequence: Synthetic oligonucleotide
ccaccgagcugauucacu

SEQ ID NO: 47452 - RNA, 18 nt, Artificial Sequence
  Description of Artificial Sequence: Synthetic oligonucleotide
agacaccaccgagcugau

SEQ ID NO: 47453 - RNA, 18 nt, Artificial Sequence
  Description of Artificial Sequence: Synthetic oligonucleotide
gacaaagacaccaccgag

SEQ ID NO: 47454 - RNA, 18 nt, Artificial Sequence
  Description of Artificial Sequence: Synthetic oligonucleotide
ccguugacaaagacacca

SEQ ID NO: 47455 - RNA, 18 nt, Artificial Sequence
  Description of Artificial Sequence: Synthetic oligonucleotide
gccgcccguugacaaaga

SEQ ID NO: 47456 - RNA, 18 nt, Artificial Sequence
  Description of Artificial Sequence: Synthetic oligonucleotide
caguggccgcccguugac

SEQ ID NO: 47457 - RNA, 18 nt, Artificial Sequence
  Description of Artificial Sequence: Synthetic oligonucleotide
uccggcaguggccgcccg

SEQ ID NO: 47458 - RNA, 18 nt, Artificial Sequence
  Description of Artificial Sequence: Synthetic oligonucleotide
uggaguccggcaguggcc

SEQ ID NO: 47459 - RNA, 18 nt, Artificial Sequence
  Description of Artificial Sequence: Synthetic oligonucleotide
ccggguggaguccggcag

SEQ ID NO: 47460 - RNA, 18 nt, Artificial Sequence
  Description of Artificial Sequence: Synthetic oligonucleotide
uucugccggguggagucc

SEQ ID NO: 47461 - RNA, 18 nt, Artificial Sequence
  Description of Artificial Sequence: Synthetic oligonucleotide
caaucuucugccgggugg

SEQ ID NO: 47462 - RNA, 18 nt, Artificial Sequence
  Description of Artificial Sequence: Synthetic oligonucleotide
cucuacaaucuucugccg

SEQ ID NO: 47463 - RNA, 18 nt, Artificial Sequence
  Description of Artificial Sequence: Synthetic oligonucleotide
gcuagcucuacaaucuuc

SEQ ID NO: 47464 - RNA, 18 nt, Artificial Sequence
  Description of Artificial Sequence: Synthetic oligonucleotide
ugugagcuagcucuacaa

SEQ ID NO: 47465 - RNA, 18 nt, Artificial Sequence
  Description of Artificial Sequence: Synthetic oligonucleotide
cccgcugugagcuagcuc

SEQ ID NO: 47466 - RNA, 18 nt, Artificial Sequence
  Description of Artificial Sequence: Synthetic oligonucleotide
cgggccccgcugugagcu

SEQ ID NO: 47467 - RNA, 18 nt, Artificial Sequence
  Description of Artificial Sequence: Synthetic oligonucleotide
acggccgggccccgcugu

SEQ ID NO: 47468 - RNA, 18 nt, Artificial Sequence
  Description of Artificial Sequence: Synthetic oligonucleotide
gucgcacggccgggcccc

SEQ ID NO: 47469 - RNA, 18 nt, Artificial Sequence
  Description of Artificial Sequence: Synthetic oligonucleotide
gaaaugucgcacggccgg

SEQ ID NO: 47470 - RNA, 18 nt, Artificial Sequence
  Description of Artificial Sequence: Synthetic oligonucleotide
uucgggaaaugucgcacg

SEQ ID NO: 47471 - RNA, 18 nt, Artificial Sequence
  Description of Artificial Sequence: Synthetic oligonucleotide
cagaauucgggaaauguc

SEQ ID NO: 47472 - RNA, 18 nt, Artificial Sequence
  Description of Artificial Sequence: Synthetic oligonucleotide
gggcggcgccgggaggau

SEQ ID NO: 47473 - RNA, 18 nt, Artificial Sequence
  Description of Artificial Sequence: Synthetic oligonucleotide
agaguggagggccgcggg

SEQ ID NO: 47474 - RNA, 18 nt, Artificial Sequence
  Description of Artificial Sequence: Synthetic oligonucleotide
cguugagaguggagggcc

SEQ ID NO: 47475 - RNA, 18 nt, Artificial Sequence
  Description of Artificial Sequence: Synthetic oligonucleotide
gagggcguugagagugga

SEQ ID NO: 47476 - RNA, 18 nt, Artificial Sequence
  Description of Artificial Sequence: Synthetic oligonucleotide
gaagagagggcguugaga

SEQ ID NO: 47477 - RNA, 18 nt, Artificial Sequence
  Description of Artificial Sequence: Synthetic oligonucleotide
gaaaugaagagagggcgu

SEQ ID NO: 47478 - RNA, 18 nt, Artificial Sequence
  Description of Artificial Sequence: Synthetic oligonucleotide
aguaagaaaugaagagag

SEQ ID NO: 47479 - RNA, 18 nt, Artificial Sequence
  Description of Artificial Sequence: Synthetic oligonucleotide
uuuacaguaagaaaugaa

SEQ ID NO: 47480 - RNA, 18 nt, Artificial Sequence
  Description of Artificial Sequence: Synthetic oligonucleotide
caucguuuacaguaagaa

SEQ ID NO: 47481 - RNA, 18 nt, Artificial Sequence
  Description of Artificial Sequence: Synthetic oligonucleotide
auuagcaucguuuacagu

SEQ ID NO: 47482 - RNA, 18 nt, Artificial Sequence
  Description of Artificial Sequence: Synthetic oligonucleotide
ccauaauuagcaucguuu

SEQ ID NO: 47483 - RNA, 18 nt, Artificial Sequence
  Description of Artificial Sequence: Synthetic oligonucleotide
ggguccauaauuagcauc

SEQ ID NO: 47484 - RNA, 18 nt, Artificial Sequence
  Description of Artificial Sequence: Synthetic oligonucleotide
gaaagugggaaggcaggg

SEQ ID NO: 47485 - RNA, 18 nt, Artificial Sequence
  Description of Artificial Sequence: Synthetic oligonucleotide
gggaaagugggaaggcag

SEQ ID NO: 47486 - RNA, 18 nt, Artificial Sequence
  Description of Artificial Sequence: Synthetic oligonucleotide
gaugguggaaggagaggg

SEQ ID NO: 47487 - RNA, 18 nt, Artificial Sequence
  Description of Artificial Sequence: Synthetic oligonucleotide
ggaaggaugguggaagga

SEQ ID NO: 47488 - RNA, 18 nt, Artificial Sequence
  Description of Artificial Sequence: Synthetic oligonucleotide
gauagggaaggauggugg

SEQ ID NO: 47489 - RNA, 18 nt, Artificial Sequence
  Description of Artificial Sequence: Synthetic oligonucleotide
aaagagauagggaaggau

SEQ ID NO: 47490 - RNA, 18 nt, Artificial Sequence
  Description of Artificial Sequence: Synthetic oligonucleotide
gguugaaagagauaggga

SEQ ID NO: 47491 - RNA, 18 nt, Artificial Sequence
  Description of Artificial Sequence: Synthetic oligonucleotide
acccagguugaaagagau

SEQ ID NO: 47492 - RNA, 18 nt, Artificial Sequence
  Description of Artificial Sequence: Synthetic oligonucleotide
aacugacccagguugaaa

SEQ ID NO: 47493 - RNA, 18 nt, Artificial Sequence
  Description of Artificial Sequence: Synthetic oligonucleotide
uauguaacugacccaggu

SEQ ID NO: 47494 - RNA, 18 nt, Artificial Sequence
  Description of Artificial Sequence: Synthetic oligonucleotide
uaucuuauguaacugacc

SEQ ID NO: 47495 - RNA, 18 nt, Artificial Sequence
  Description of Artificial Sequence: Synthetic oligonucleotide
ugaguuaucuuauguaac

SEQ ID NO: 47496 - RNA, 18 nt, Artificial Sequence
  Description of Artificial Sequence: Synthetic oligonucleotide
gcagaugaguuaucuuau

SEQ ID NO: 47497 - RNA, 18 nt, Artificial Sequence
  Description of Artificial Sequence: Synthetic oligonucleotide
cugaagcagaugaguuau

SEQ ID NO: 47498 - RNA, 18 nt, Artificial Sequence
  Description of Artificial Sequence: Synthetic oligonucleotide
uuuuucugaagcagauga

SEQ ID NO: 47499 - RNA, 18 nt, Artificial Sequence
  Description of Artificial Sequence: Synthetic oligonucleotide
caauauuuuucugaagca

SEQ ID NO: 47500 - RNA, 18 nt, Artificial Sequence
  Description of Artificial Sequence: Synthetic oligonucleotide
gcacacaauauuuuucug

SEQ ID NO: 47501 - RNA, 18 nt, Artificial Sequence
  Description of Artificial Sequence: Synthetic oligonucleotide
aauccgcacacaauauuu

SEQ ID NO: 47502 - RNA, 18 nt, Artificial Sequence
  Description of Artificial Sequence: Synthetic oligonucleotide
aaaaaaauccgcacacaa

SEQ ID NO: 47503 - RNA, 18 nt, Artificial Sequence
  Description of Artificial Sequence: Synthetic oligonucleotide
uuuuuaaaaaaauccgca

SEQ ID NO: 47504 - RNA, 18 nt, Artificial Sequence
  Description of Artificial Sequence: Synthetic oligonucleotide
agauuuuuuuaaaaaaau

SEQ ID NO: 47505 - RNA, 18 nt, Artificial Sequence
  Description of Artificial Sequence: Synthetic oligonucleotide
gagaaagauuuuuuuaaa

SEQ ID NO: 47506 - RNA, 18 nt, Artificial Sequence
  Description of Artificial Sequence: Synthetic oligonucleotide
aaaaagagaaagauuuuu

SEQ ID NO: 47507 - RNA, 18 nt, Artificial Sequence
  Description of Artificial Sequence: Synthetic oligonucleotide
caaauaaaaagagaaaga

SEQ ID NO: 47508 - RNA, 18 nt, Artificial Sequence
  Description of Artificial Sequence: Synthetic oligonucleotide
uuuaccaaauaaaaagag

SEQ ID NO: 47509 - RNA, 18 nt, Artificial Sequence
  Description of Artificial Sequence: Synthetic oligonucleotide
augucuuuaccaaauaaa

SEQ ID NO: 47510 - RNA, 18 nt, Artificial Sequence
  Description of Artificial Sequence: Synthetic oligonucleotide
aaugaaugucuuuaccaa

SEQ ID NO: 47511 - RNA, 18 nt, Artificial Sequence
  Description of Artificial Sequence: Synthetic oligonucleotide
cccacaaugaaugucuuu

SEQ ID NO: 47512 - RNA, 18 nt, Artificial Sequence
  Description of Artificial Sequence: Synthetic oligonucleotide
cuguucccacaaugaaug

SEQ ID NO: 47513 - RNA, 18 nt, Artificial Sequence
  Description of Artificial Sequence: Synthetic oligonucleotide
auaaacuguucccacaau

SEQ ID NO: 47514 - RNA, 18 nt, Artificial Sequence
  Description of Artificial Sequence: Synthetic oligonucleotide
gguucauaaacuguuccc

SEQ ID NO: 47515 - RNA, 18 nt, Artificial Sequence
  Description of Artificial Sequence: Synthetic oligonucleotide
auuacgguucauaaacug

SEQ ID NO: 47516 - RNA, 18 nt, Artificial Sequence
  Description of Artificial Sequence: Synthetic oligonucleotide
agcuuauuacgguucaua

SEQ ID NO: 47517 - RNA, 18 nt, Artificial Sequence
  Description of Artificial Sequence: Synthetic oligonucleotide
aacucagcuuauuacggu

SEQ ID NO: 47518 - RNA, 18 nt, Artificial Sequence
  Description of Artificial Sequence: Synthetic oligonucleotide
uauauaacucagcuuauu

SEQ ID NO: 47519 - RNA, 18 nt, Artificial Sequence
  Description of Artificial Sequence: Synthetic oligonucleotide
cgguuuauauaacucagc

SEQ ID NO: 47520 - RNA, 18 nt, Artificial Sequence
  Description of Artificial Sequence: Synthetic oligonucleotide
uaugccgguuuauauaac

SEQ ID NO: 47521 - RNA, 18 nt, Artificial Sequence
  Description of Artificial Sequence: Synthetic oligonucleotide
gaaauuaugccgguuuau

SEQ ID NO: 47522 - RNA, 18 nt, Artificial Sequence
  Description of Artificial Sequence: Synthetic oligonucleotide
agaaugaaauuaugccgg

SEQ ID NO: 47523 - RNA, 18 nt, Artificial Sequence
  Description of Artificial Sequence: Synthetic oligonucleotide
agagcagaaugaaauuau

SEQ ID NO: 47524 - RNA, 18 nt, Artificial Sequence
  Description of Artificial Sequence: Synthetic oligonucleotide
gggagagcagaaugaaau

SEQ ID NO: 47525 - RNA, 18 nt, Artificial Sequence
  Description of Artificial Sequence: Synthetic oligonucleotide
agguaagcaugggcuggg

SEQ ID NO: 47526 - RNA, 18 nt, Artificial Sequence
  Description of Artificial Sequence: Synthetic oligonucleotide
agcugagguaagcauggg

SEQ ID NO: 47527 - RNA, 18 nt, Artificial Sequence
  Description of Artificial Sequence: Synthetic oligonucleotide
ucaaaagcugagguaagc

SEQ ID NO: 47528 - RNA, 18 nt, Artificial Sequence
  Description of Artificial Sequence: Synthetic oligonucleotide
auaccucaaaagcugagg

SEQ ID NO: 47529 - RNA, 18 nt, Artificial Sequence
  Description of Artificial Sequence: Synthetic oligonucleotide
aacaaauaccucaaaagc

SEQ ID NO: 47530 - RNA, 18 nt, Artificial Sequence
  Description of Artificial Sequence: Synthetic oligonucleotide
gaauaaacaaauaccuca

SEQ ID NO: 47531 - RNA, 18 nt, Artificial Sequence
  Description of Artificial Sequence: Synthetic oligonucleotide
augaagaauaaacaaaua

SEQ ID NO: 47532 - RNA, 18 nt, Artificial Sequence
  Description of Artificial Sequence: Synthetic oligonucleotide
uaaacaugaagaauaaac

SEQ ID NO: 47533 - RNA, 18 nt, Artificial Sequence
  Description of Artificial Sequence: Synthetic oligonucleotide
auucauaaacaugaagaa

SEQ ID NO: 47534 - RNA, 18 nt, Artificial Sequence
  Description of Artificial Sequence: Synthetic oligonucleotide
auauuauucauaaacaug

SEQ ID NO: 47535 - RNA, 18 nt, Artificial Sequence
  Description of Artificial Sequence: Synthetic oligonucleotide
aauauauauuauucauaa

SEQ ID NO: 47536 - RNA, 18 nt, Artificial Sequence
  Description of Artificial Sequence: Synthetic oligonucleotide
aaaucaauauauauuauu

SEQ ID NO: 47537 - RNA, 18 nt, Artificial Sequence
  Description of Artificial Sequence: Synthetic oligonucleotide
uuuuaaaaucaauauaua

SEQ ID NO: 47538 - RNA, 18 nt, Artificial Sequence
  Description of Artificial Sequence: Synthetic oligonucleotide
uugccuuuuaaaaucaau

SEQ ID NO: 47539 - RNA, 18 nt, Artificial Sequence
  Description of Artificial Sequence: Synthetic oligonucleotide
agcauuugccuuuuaaaa

SEQ ID NO: 47540 - RNA, 18 nt, Artificial Sequence
  Description of Artificial Sequence: Synthetic oligonucleotide
uaaauagcauuugccuuu

SEQ ID NO: 47541 - RNA, 18 nt, Artificial Sequence
  Description of Artificial Sequence: Synthetic oligonucleotide
aggaguaaauagcauuug

SEQ ID NO: 47542 - RNA, 18 nt, Artificial Sequence
  Description of Artificial Sequence: Synthetic oligonucleotide
uagggaggaguaaauagc

SEQ ID NO: 47543 - RNA, 18 nt, Artificial Sequence
  Description of Artificial Sequence: Synthetic oligonucleotide
ugaguuagggaggaguaa

SEQ ID NO: 47544 - RNA, 18 nt, Artificial Sequence
  Description of Artificial Sequence: Synthetic oligonucleotide
aaaugugaguuagggagg

SEQ ID NO: 47545 - RNA, 18 nt, Artificial Sequence
  Description of Artificial Sequence: Synthetic oligonucleotide
ugaguaaaugugaguuag

SEQ ID NO: 47546 - RNA, 18 nt, Artificial Sequence
  Description of Artificial Sequence: Synthetic oligonucleotide
ucaauugaguaaauguga

SEQ ID NO: 47547 - RNA, 18 nt, Artificial Sequence
  Description of Artificial Sequence: Synthetic oligonucleotide
aauacucaauugaguaaa

SEQ ID NO: 47548 - RNA, 18 nt, Artificial Sequence
  Description of Artificial Sequence: Synthetic oligonucleotide
agcauuugccuuuuaaaa

SEQ ID NO: 47549 - RNA, 18 nt, Artificial Sequence
  Description of Artificial Sequence: Synthetic oligonucleotide
uaaauagcauuugccuuu

SEQ ID NO: 47550 - RNA, 18 nt, Artificial Sequence
  Description of Artificial Sequence: Synthetic oligonucleotide
aggaguaaauagcauuug

SEQ ID NO: 47551 - RNA, 18 nt, Artificial Sequence
  Description of Artificial Sequence: Synthetic oligonucleotide
uagggaggaguaaauagc

SEQ ID NO: 47552 - RNA, 18 nt, Artificial Sequence
  Description of Artificial Sequence: Synthetic oligonucleotide
ugaguuagggaggaguaa

SEQ ID NO: 47553 - RNA, 18 nt, Artificial Sequence
  Description of Artificial Sequence: Synthetic oligonucleotide
aaaugugaguuagggagg

SEQ ID NO: 47554 - RNA, 18 nt, Artificial Sequence
  Description of Artificial Sequence: Synthetic oligonucleotide
ugaguaaaugugaguuag

SEQ ID NO: 47555 - RNA, 18 nt, Artificial Sequence
  Description of Artificial Sequence: Synthetic oligonucleotide
ucaauugaguaaauguga

SEQ ID NO: 47556 - RNA, 18 nt, Artificial Sequence
  Description of Artificial Sequence: Synthetic oligonucleotide
aauacucaauugaguaaa

SEQ ID NO: 47557 - RNA, 18 nt, Artificial Sequence
  Description of Artificial Sequence: Synthetic oligonucleotide
uaaaaaauacucaauuga

SEQ ID NO: 47558 - RNA, 18 nt, Artificial Sequence
  Description of Artificial Sequence: Synthetic oligonucleotide
uucuuuaaaaaauacuca

SEQ ID NO: 47559 - RNA, 18 nt, Artificial Sequence
  Description of Artificial Sequence: Synthetic oligonucleotide
ucuucuucuuuaaaaaau

SEQ ID NO: 47560 - RNA, 18 nt, Artificial Sequence
  Description of Artificial Sequence: Synthetic oligonucleotide
uuacuucuucuucuuuaa

SEQ ID NO: 47561 - RNA, 18 nt, Artificial Sequence
  Description of Artificial Sequence: Synthetic oligonucleotide
uuuuuuuacuucuucuuc

SEQ ID NO: 47562 - RNA, 18 nt, Artificial Sequence
  Description of Artificial Sequence: Synthetic oligonucleotide
acugauuuuuuuacuucu

SEQ ID NO: 47563 - RNA, 18 nt, Artificial Sequence
  Description of Artificial Sequence: Synthetic oligonucleotide
aauaaacugauuuuuuua

SEQ ID NO: 47564 - RNA, 18 nt, Artificial Sequence
  Description of Artificial Sequence: Synthetic oligonucleotide
uaaaaaauaaacugauuu

SEQ ID NO: 47565 - RNA, 18 nt, Artificial Sequence
  Description of Artificial Sequence: Synthetic oligonucleotide
aaagguaaaaaauaaacu

SEQ ID NO: 47566 - RNA, 18 nt, Artificial Sequence
  Description of Artificial Sequence: Synthetic oligonucleotide
agaacaaagguaaaaaau

SEQ ID NO: 47567 - RNA, 18 nt, Artificial Sequence
  Description of Artificial Sequence: Synthetic oligonucleotide
uuuaaagaacaaagguaa

SEQ ID NO: 47568 - RNA, 18 nt, Artificial Sequence
  Description of Artificial Sequence: Synthetic oligonucleotide
uauguuuuaaagaacaaa

SEQ ID NO: 47569 - RNA, 18 nt, Artificial Sequence
  Description of Artificial Sequence: Synthetic oligonucleotide
ggcguuauguuuuaaaga

SEQ ID NO: 47570 - RNA, 18 nt, Artificial Sequence
  Description of Artificial Sequence: Synthetic oligonucleotide
aaaguggcguuauguuuu

SEQ ID NO: 47571 - RNA, 18 nt, Artificial Sequence
  Description of Artificial Sequence: Synthetic oligonucleotide
ugcuuaaaguggcguuau

SEQ ID NO: 47572 - RNA, 18 nt, Artificial Sequence
  Description of Artificial Sequence: Synthetic oligonucleotide
gaccuugcuuaaaguggc

SEQ ID NO: 47573 - RNA, 18 nt, Artificial Sequence
  Description of Artificial Sequence: Synthetic oligonucleotide
gugcugaccuugcuuaaa

SEQ ID NO: 47574 - RNA, 18 nt, Artificial Sequence
  Description of Artificial Sequence: Synthetic oligonucleotide
uuuuugugcugaccuugc

SEQ ID NO: 47575 - RNA, 18 nt, Artificial Sequence
  Description of Artificial Sequence: Synthetic oligonucleotide
auuuauuuuugugcugac

SEQ ID NO: 47576 - RNA, 18 nt, Artificial Sequence
  Description of Artificial Sequence: Synthetic oligonucleotide
gauaaauuuauuuuugug

SEQ ID NO: 47577 - RNA, 18 nt, Artificial Sequence
  Description of Artificial Sequence: Synthetic oligonucleotide
aaguagauaaauuuauuu

SEQ ID NO: 47578 - RNA, 18 nt, Artificial Sequence
  Description of Artificial Sequence: Synthetic oligonucleotide
aaacgaaguagauaaauu

SEQ ID NO: 47579 - RNA, 18 nt, Artificial Sequence
  Description of Artificial Sequence: Synthetic oligonucleotide
caucaaaacgaaguagau

SEQ ID NO: 47580 - RNA, 18 nt, Artificial Sequence
  Description of Artificial Sequence: Synthetic oligonucleotide
agaugcaucaaaacgaag

SEQ ID NO: 47581 - RNA, 18 nt, Artificial Sequence
  Description of Artificial Sequence: Synthetic oligonucleotide
ccugaagaugcaucaaaa

SEQ ID NO: 47582 - RNA, 18 nt, Artificial Sequence
  Description of Artificial Sequence: Synthetic oligonucleotide
cacugccugaagaugcau

SEQ ID NO: 47583 - RNA, 18 nt, Artificial Sequence
  Description of Artificial Sequence: Synthetic oligonucleotide
uuaaacacugccugaaga

SEQ ID NO: 47584 - RNA, 18 nt, Artificial Sequence
  Description of Artificial Sequence: Synthetic oligonucleotide
uuuucuuaaacacugccu

SEQ ID NO: 47585 - RNA, 18 nt, Artificial Sequence
  Description of Artificial Sequence: Synthetic oligonucleotide
aaaacuuuucuuaaacac

SEQ ID NO: 47586 - RNA, 18 nt, Artificial Sequence
  Description of Artificial Sequence: Synthetic oligonucleotide
aaaaaaaaacuuuucuua

SEQ ID NO: 47587 - RNA, 18 nt, Artificial Sequence
  Description of Artificial Sequence: Synthetic oligonucleotide
uuuuaaaaaaaaaacuuu

SEQ ID NO: 47588 - RNA, 18 nt, Artificial Sequence
  Description of Artificial Sequence: Synthetic oligonucleotide
gcuuuuuuuaaaaaaaaa

SEQ ID NO: 47589 - RNA, 18 nt, Artificial Sequence
  Description of Artificial Sequence: Synthetic oligonucleotide
uaaaagcuuuuuuuaaaa

SEQ ID NO: 47590 - RNA, 18 nt, Artificial Sequence
  Description of Artificial Sequence: Synthetic oligonucleotide
gaauuuaaaagcuuuuuu

SEQ ID NO: 47591 - RNA, 18 nt, Artificial Sequence
  Description of Artificial Sequence: Synthetic oligonucleotide
aaaacgaauuuaaaagcu

SEQ ID NO: 47592 - RNA, 18 nt, Artificial Sequence
  Description of Artificial Sequence: Synthetic oligonucleotide
acuaaaaaacgaauuuaa

SEQ ID NO: 47593 - RNA, 18 nt, Artificial Sequence
  Description of Artificial Sequence: Synthetic oligonucleotide
uuugaacuaaaaaacgaa

SEQ ID NO: 47594 - RNA, 18 nt, Artificial Sequence
  Description of Artificial Sequence: Synthetic oligonucleotide
aacaauuugaacuaaaaa

SEQ ID NO: 47595 - RNA, 18 nt, Artificial Sequence
  Description of Artificial Sequence: Synthetic oligonucleotide
uuucaaacaauuugaacu

SEQ ID NO: 47596 - RNA, 18 nt, Artificial Sequence
  Description of Artificial Sequence: Synthetic oligonucleotide
gauacuuucaaacaauuu

SEQ ID NO: 47597 - RNA, 18 nt, Artificial Sequence
  Description of Artificial Sequence: Synthetic oligonucleotide
augaugauacuuucaaac

SEQ ID NO: 47598 - RNA, 18 nt, Artificial Sequence
  Description of Artificial Sequence: Synthetic oligonucleotide
caaauaugaugauacuuu

SEQ ID NO: 47599 - RNA, 18 nt, Artificial Sequence
  Description of Artificial Sequence: Synthetic oligonucleotide
aacuacaaauaugaugau

SEQ ID NO: 47600 - RNA, 18 nt, Artificial Sequence
  Description of Artificial Sequence: Synthetic oligonucleotide
cuaaaaacuacaaauaug

SEQ ID NO: 47601 - RNA, 18 nt, Artificial Sequence
  Description of Artificial Sequence: Synthetic oligonucleotide
uagcccuaaaaacuacaa

SEQ ID NO: 47602 - RNA, 18 nt, Artificial Sequence
  Description of Artificial Sequence: Synthetic oligonucleotide
auuuguagcccuaaaaac

SEQ ID NO: 47603 - RNA, 18 nt, Artificial Sequence
  Description of Artificial Sequence: Synthetic oligonucleotide
auuacauuuguagcccua

SEQ ID NO: 47604 - RNA, 18 nt, Artificial Sequence
  Description of Artificial Sequence: Synthetic oligonucleotide
uuaaaauuacauuuguag

SEQ ID NO: 47605 - RNA, 18 nt, Artificial Sequence
  Description of Artificial Sequence: Synthetic oligonucleotide
uuuucuuaaaauuacauu

SEQ ID NO: 47606 - RNA, 18 nt, Artificial Sequence
  Description of Artificial Sequence: Synthetic oligonucleotide
gcuuuuuuucuuaaaauu

SEQ ID NO: 47607 - RNA, 18 nt, Artificial Sequence
  Description of Artificial Sequence: Synthetic oligonucleotide
agagagcuuuuuuucuua

SEQ ID NO: 47608 - RNA, 18 nt, Artificial Sequence
  Description of Artificial Sequence: Synthetic oligonucleotide
acuguagagagcuuuuuu

SEQ ID NO: 47609 - RNA, 18 nt, Artificial Sequence
  Description of Artificial Sequence: Synthetic oligonucleotide
aacuuacuguagagagcu

SEQ ID NO: 47610 - RNA, 18 nt, Artificial Sequence
  Description of Artificial Sequence: Synthetic oligonucleotide
augagaacuuacuguaga

SEQ ID NO: 47611 - RNA, 18 nt, Artificial Sequence
  Description of Artificial Sequence: Synthetic oligonucleotide
augguaugagaacuuacu

SEQ ID NO: 47612 - RNA, 18 nt, Artificial Sequence
  Description of Artificial Sequence: Synthetic oligonucleotide
cuucaaugguaugagaac

SEQ ID NO: 47613 - RNA, 18 nt, Artificial Sequence
  Description of Artificial Sequence: Synthetic oligonucleotide
uauaccuucaaugguaug

SEQ ID NO: 47614 - RNA, 18 nt, Artificial Sequence
  Description of Artificial Sequence: Synthetic oligonucleotide
aaaaauauaccuucaaug

SEQ ID NO: 47615 - RNA, 18 nt, Artificial Sequence
  Description of Artificial Sequence: Synthetic oligonucleotide
aacacaaaaauauaccuu

SEQ ID NO: 47616 - RNA, 18 nt, Artificial Sequence
  Description of Artificial Sequence: Synthetic oligonucleotide
ucuauaacacaaaaauau

SEQ ID NO: 47617 - RNA, 18 nt, Artificial Sequence
  Description of Artificial Sequence: Synthetic oligonucleotide
augggucuauaacacaaa

SEQ ID NO: 47618 - RNA, 18 nt, Artificial Sequence
  Description of Artificial Sequence: Synthetic oligonucleotide
ucugcaugggucuauaac

SEQ ID NO: 47619 - RNA, 18 nt, Artificial Sequence
  Description of Artificial Sequence: Synthetic oligonucleotide
uugcaucugcaugggucu

SEQ ID NO: 47620 - RNA, 18 nt, Artificial Sequence
  Description of Artificial Sequence: Synthetic oligonucleotide
gacuuuugcaucugcaug

SEQ ID NO: 47621 - RNA, 18 nt, Artificial Sequence
  Description of Artificial Sequence: Synthetic oligonucleotide
acuuggacuuuugcaucu

SEQ ID NO: 47622 - RNA, 18 nt, Artificial Sequence
  Description of Artificial Sequence: Synthetic oligonucleotide
ccagcacuuggacuuuug

SEQ ID NO: 47623 - RNA, 18 nt, Artificial Sequence
  Description of Artificial Sequence: Synthetic oligonucleotide
auuguccagcacuuggac

SEQ ID NO: 47624 - RNA, 18 nt, Artificial Sequence
  Description of Artificial Sequence: Synthetic oligonucleotide
uuuugauuguccagcacu

SEQ ID NO: 47625 - RNA, 18 nt, Artificial Sequence
  Description of Artificial Sequence: Synthetic oligonucleotide
uuacguuuugauugucca

SEQ ID NO: 47626 - RNA, 18 nt, Artificial Sequence
  Description of Artificial Sequence: Synthetic oligonucleotide
caagcuuacguuuugauu

SEQ ID NO: 47627 - RNA, 18 nt, Artificial Sequence
  Description of Artificial Sequence: Synthetic oligonucleotide
aaugacaagcuuacguuu

SEQ ID NO: 47628 - RNA, 18 nt, Artificial Sequence
  Description of Artificial Sequence: Synthetic oligonucleotide
uaaacaaugacaagcuua

SEQ ID NO: 47629 - RNA, 18 nt, Artificial Sequence
  Description of Artificial Sequence: Synthetic oligonucleotide
ugcauuaaacaaugacaa

SEQ ID NO: 47630 - RNA, 18 nt, Artificial Sequence
  Description of Artificial Sequence: Synthetic oligonucleotide
aaguaugcauuaaacaau

SEQ ID NO: 47631 - RNA, 18 nt, Artificial Sequence
  Description of Artificial Sequence: Synthetic oligonucleotide
uguuuaaguaugcauuaa

SEQ ID NO: 47632 - RNA, 18 nt, Artificial Sequence
  Description of Artificial Sequence: Synthetic oligonucleotide
aaaauuguuuaaguaugc

SEQ ID NO: 47633 - RNA, 18 nt, Artificial Sequence
  Description of Artificial Sequence: Synthetic oligonucleotide
aaaauaaaauuguuuaag

SEQ ID NO: 47634 - RNA, 18 nt, Artificial Sequence
  Description of Artificial Sequence: Synthetic oligonucleotide
agacaaaaauaaaauugu

SEQ ID NO: 47635 - RNA, 18 nt, Artificial Sequence
  Description of Artificial Sequence: Synthetic oligonucleotide
uuucaagacaaaaauaaa

SEQ ID NO: 47636 - RNA, 18 nt, Artificial Sequence
  Description of Artificial Sequence: Synthetic oligonucleotide
aauaauuucaagacaaaa

SEQ ID NO: 47637 - RNA, 18 nt, Artificial Sequence
  Description of Artificial Sequence: Synthetic oligonucleotide
uuauuaauaauuucaaga

SEQ ID NO: 47638 - RNA, 18 nt, Artificial Sequence
  Description of Artificial Sequence: Synthetic oligonucleotide
ccacauuauuaauaauuu

SEQ ID NO: 47639 - RNA, 18 nt, Artificial Sequence
  Description of Artificial Sequence: Synthetic oligonucleotide
gaaaaccacauuauuaau

SEQ ID NO: 47640 - RNA, 18 nt, Artificial Sequence
  Description of Artificial Sequence: Synthetic oligonucleotide
ggacagaaaaccacauua

SEQ ID NO: 47641 - RNA, 18 nt, Artificial Sequence
  Description of Artificial Sequence: Synthetic oligonucleotide
ucacacauccguuggaca

SEQ ID NO: 47642 - RNA, 18 nt, Artificial Sequence
  Description of Artificial Sequence: Synthetic oligonucleotide
uuuacucacacauccguu

SEQ ID NO: 47643 - RNA, 18 nt, Artificial Sequence
  Description of Artificial Sequence: Synthetic oligonucleotide
agaauuuuacucacacau

SEQ ID NO: 47644 - RNA, 18 nt, Artificial Sequence
  Description of Artificial Sequence: Synthetic oligonucleotide
ugcccagaauuuuacuca

SEQ ID NO: 47645 - RNA, 18 nt, Artificial Sequence
  Description of Artificial Sequence: Synthetic oligonucleotide
auaccugcccagaauuuu

SEQ ID NO: 47646 - RNA, 18 nt, Artificial Sequence
  Description of Artificial Sequence: Synthetic oligonucleotide
ucguaauaccugcccaga

SEQ ID NO: 47647 - RNA, 18 nt, Artificial Sequence
  Description of Artificial Sequence: Synthetic oligonucleotide
cagucucguaauaccugc

SEQ ID NO: 47648 - RNA, 18 nt, Artificial Sequence
  Description of Artificial Sequence: Synthetic oligonucleotide
ggagccagucucguaaua

SEQ ID NO: 47649 - RNA, 18 nt, Artificial Sequence
  Description of Artificial Sequence: Synthetic oligonucleotide
cugauggagccagucucg

SEQ ID NO: 47650 - RNA, 18 nt, Artificial Sequence
  Description of Artificial Sequence: Synthetic oligonucleotide
ugggucugauggagccag

SEQ ID NO: 47651 - RNA, 18 nt, Artificial Sequence
  Description of Artificial Sequence: Synthetic oligonucleotide
ugcccugggucugaugga

SEQ ID NO: 47652 - RNA, 18 nt, Artificial Sequence
  Description of Artificial Sequence: Synthetic oligonucleotide
ccgauugcccugggucug

SEQ ID NO: 47653 - RNA, 18 nt, Artificial Sequence
  Description of Artificial Sequence: Synthetic oligonucleotide
uaccaccgauugcccugg

SEQ ID NO: 47654 - RNA, 18 nt, Artificial Sequence
  Description of Artificial Sequence: Synthetic oligonucleotide
uuuacuaccaccgauugc

SEQ ID NO: 47655 - RNA, 18 nt, Artificial Sequence
  Description of Artificial Sequence: Synthetic oligonucleotide
cucgguuuacuaccaccg

SEQ ID NO: 47656 - RNA, 18 nt, Artificial Sequence
  Description of Artificial Sequence: Synthetic oligonucleotide
cuacucucgguuuacuac

SEQ ID NO: 47657 - RNA, 18 nt, Artificial Sequence
  Description of Artificial Sequence: Synthetic oligonucleotide
agucgcuacucucgguuu

SEQ ID NO: 47658 - RNA, 18 nt, Artificial Sequence
  Description of Artificial Sequence: Synthetic oligonucleotide
ucuggagucgcuacucuc

SEQ ID NO: 47659 - RNA, 18 nt, Artificial Sequence
  Description of Artificial Sequence: Synthetic oligonucleotide
caacuucuggagucgcua

SEQ ID NO: 47660 - RNA, 18 nt, Artificial Sequence
  Description of Artificial Sequence: Synthetic oligonucleotide
gcuuacaacuucuggagu

SEQ ID NO: 47661 - RNA, 18 nt, Artificial Sequence
  Description of Artificial Sequence: Synthetic oligonucleotide
auuuugcuuacaacuucu

SEQ ID NO: 47662 - RNA, 18 nt, Artificial Sequence
  Description of Artificial Sequence: Synthetic oligonucleotide
gggcuauuuugcuuacaa

SEQ ID NO: 47663 - RNA, 18 nt, Artificial Sequence
  Description of Artificial Sequence: Synthetic oligonucleotide
auacugggcuauuuugcu

SEQ ID NO: 47664 - RNA, 18 nt, Artificial Sequence
  Description of Artificial Sequence: Synthetic oligonucleotide
cgcuuauacugggcuauu

SEQ ID NO: 47665 - RNA, 18 nt, Artificial Sequence
  Description of Artificial Sequence: Synthetic oligonucleotide
acucccgcuuauacuggg

SEQ ID NO: 47666 - RNA, 18 nt, Artificial Sequence
  Description of Artificial Sequence: Synthetic oligonucleotide
cgggcacucccgcuuaua

SEQ ID NO: 47667 - RNA, 18 nt, Artificial Sequence
  Description of Artificial Sequence: Synthetic oligonucleotide
auggacgggcacucccgc

SEQ ID NO: 47668 - RNA, 18 nt, Artificial Sequence
  Description of Artificial Sequence: Synthetic oligonucleotide
caaagauggacgggcacu

SEQ ID NO: 47669 - RNA, 18 nt, Artificial Sequence
  Description of Artificial Sequence: Synthetic oligonucleotide
ccaagcaaagauggacgg

SEQ ID NO: 47670 - RNA, 18 nt, Artificial Sequence
  Description of Artificial Sequence: Synthetic oligonucleotide
auuucccaagcaaagaug

SEQ ID NO: 47671 - RNA, 18 nt, Artificial Sequence
  Description of Artificial Sequence: Synthetic oligonucleotide
cucggauuucccaagcaa

SEQ ID NO: 47672 - RNA, 18 nt, Artificial Sequence
  Description of Artificial Sequence: Synthetic oligonucleotide
ucugucucggauuuccca

SEQ ID NO: 47673 - RNA, 18 nt, Artificial Sequence
  Description of Artificial Sequence: Synthetic oligonucleotide
aguaaucugucucggauu

SEQ ID NO: 47674 - RNA, 18 nt, Artificial Sequence
  Description of Artificial Sequence: Synthetic oligonucleotide
cggacaguaaucugucuc

SEQ ID NO: 47675 - RNA, 18 nt, Artificial Sequence
  Description of Artificial Sequence: Synthetic oligonucleotide
ccccucggacaguaaucu

SEQ ID NO: 47676 - RNA, 18 nt, Artificial Sequence
  Description of Artificial Sequence: Synthetic oligonucleotide
cagacccccucggacagu

SEQ ID NO: 47677 - RNA, 18 nt, Artificial Sequence
  Description of Artificial Sequence: Synthetic oligonucleotide
ugguacagacccccucgg

SEQ ID NO: 47678 - RNA, 18 nt, Artificial Sequence
  Description of Artificial Sequence: Synthetic oligonucleotide
aucguugguacagacccc

SEQ ID NO: 47679 - RNA, 18 nt, Artificial Sequence
  Description of Artificial Sequence: Synthetic oligonucleotide
auguuaucguugguacag

SEQ ID NO: 47680 - RNA, 18 nt, Artificial Sequence
  Description of Artificial Sequence: Synthetic oligonucleotide
uugguauguuaucguugg

SEQ ID NO: 47681 - RNA, 18 nt, Artificial Sequence
  Description of Artificial Sequence: Synthetic oligonucleotide
cacacauccguuggacac

SEQ ID NO: 47682 - RNA, 18 nt, Artificial Sequence
  Description of Artificial Sequence: Synthetic oligonucleotide
uuacucacacauccguug

SEQ ID NO: 47683 - RNA, 18 nt, Artificial Sequence
  Description of Artificial Sequence: Synthetic oligonucleotide
gaauuuuacucacacauc

SEQ ID NO: 47684 - RNA, 18 nt, Artificial Sequence
  Description of Artificial Sequence: Synthetic oligonucleotide
gcccagaauuuuacucac

SEQ ID NO: 47685 - RNA, 18 nt, Artificial Sequence
  Description of Artificial Sequence: Synthetic oligonucleotide
uaccugcccagaauuuua

SEQ ID NO: 47686 - RNA, 18 nt, Artificial Sequence
  Description of Artificial Sequence: Synthetic oligonucleotide
cguaauaccugcccagaa

SEQ ID NO: 47687 - RNA, 18 nt, Artificial Sequence
  Description of Artificial Sequence: Synthetic oligonucleotide
agucucguaauaccugcc

SEQ ID NO: 47688 - RNA, 18 nt, Artificial Sequence
  Description of Artificial Sequence: Synthetic oligonucleotide
gagccagucucguaauac

SEQ ID NO: 47689 - RNA, 18 nt, Artificial Sequence
  Description of Artificial Sequence: Synthetic oligonucleotide
ugauggagccagucucgu

SEQ ID NO: 47690 - RNA, 18 nt, Artificial Sequence
  Description of Artificial Sequence: Synthetic oligonucleotide
gggucugauggagccagu

SEQ ID NO: 47691 - RNA, 18 nt, Artificial Sequence
  Description of Artificial Sequence: Synthetic oligonucleotide
gcccugggucugauggag

SEQ ID NO: 47692 - RNA, 18 nt, Artificial Sequence
  Description of Artificial Sequence: Synthetic oligonucleotide
cgauugcccugggucuga

SEQ ID NO: 47693 - RNA, 18 nt, Artificial Sequence
  Description of Artificial Sequence: Synthetic oligonucleotide
accaccgauugcccuggg

SEQ ID NO: 47694 - RNA, 18 nt, Artificial Sequence
  Description of Artificial Sequence: Synthetic oligonucleotide
uuacuaccaccgauugcc

SEQ ID NO: 47695 - RNA, 18 nt, Artificial Sequence
  Description of Artificial Sequence: Synthetic oligonucleotide
ucgguuuacuaccaccga

SEQ ID NO: 47696 - RNA, 18 nt, Artificial Sequence
  Description of Artificial Sequence: Synthetic oligonucleotide
uacucucgguuuacuacc

SEQ ID NO: 47697 - RNA, 18 nt, Artificial Sequence
  Description of Artificial Sequence: Synthetic oligonucleotide
gucgcuacucucgguuua

SEQ ID NO: 47698 - RNA, 18 nt, Artificial Sequence
  Description of Artificial Sequence: Synthetic oligonucleotide
cuggagucgcuacucucg

SEQ ID NO: 47699 - RNA, 18 nt, Artificial Sequence
  Description of Artificial Sequence: Synthetic oligonucleotide
aacuucuggagucgcuac

SEQ ID NO: 47700 - RNA, 18 nt, Artificial Sequence
  Description of Artificial Sequence: Synthetic oligonucleotide
cuuacaacuucuggaguc

SEQ ID NO: 47701 - RNA, 18 nt, Artificial Sequence
  Description of Artificial Sequence: Synthetic oligonucleotide
uuuugcuuacaacuucug

SEQ ID NO: 47702 - RNA, 18 nt, Artificial Sequence
  Description of Artificial Sequence: Synthetic oligonucleotide
ggcuauuuugcuuacaac

SEQ ID NO: 47703 - RNA, 18 nt, Artificial Sequence
  Description of Artificial Sequence: Synthetic oligonucleotide
uacugggcuauuuugcuu

SEQ ID NO: 47704 - RNA, 18 nt, Artificial Sequence
  Description of Artificial Sequence: Synthetic oligonucleotide
gcuuauacugggcuauuu

SEQ ID NO: 47705 - RNA, 18 nt, Artificial Sequence
  Description of Artificial Sequence: Synthetic oligonucleotide
cucccgcuuauacugggc

SEQ ID NO: 47706 - RNA, 18 nt, Artificial Sequence
  Description of Artificial Sequence: Synthetic oligonucleotide
gggcacucccgcuuauac

SEQ ID NO: 47707 - RNA, 18 nt, Artificial Sequence
  Description of Artificial Sequence: Synthetic oligonucleotide
uggacgggcacucccgcu

SEQ ID NO: 47708 - RNA, 18 nt, Artificial Sequence
  Description of Artificial Sequence: Synthetic oligonucleotide
aaagauggacgggcacuc

SEQ ID NO: 47709 - RNA, 18 nt, Artificial Sequence
  Description of Artificial Sequence: Synthetic oligonucleotide
caagcaaagauggacggg

SEQ ID NO: 47710 - RNA, 18 nt, Artificial Sequence
  Description of Artificial Sequence: Synthetic oligonucleotide
uuucccaagcaaagaugg

SEQ ID NO: 47711 - RNA, 18 nt, Artificial Sequence
  Description of Artificial Sequence: Synthetic oligonucleotide
ucggauuucccaagcaaa

SEQ ID NO: 47712 - RNA, 18 nt, Artificial Sequence
  Description of Artificial Sequence: Synthetic oligonucleotide
cugucucggauuucccaa

SEQ ID NO: 47713 - RNA, 18 nt, Artificial Sequence
  Description of Artificial Sequence: Synthetic oligonucleotide
guaaucugucucggauuu

SEQ ID NO: 47714 - RNA, 18 nt, Artificial Sequence
  Description of Artificial Sequence: Synthetic oligonucleotide
ggacaguaaucugucucg

SEQ ID NO: 47715 - RNA, 18 nt, Artificial Sequence
  Description of Artificial Sequence: Synthetic oligonucleotide
cccucggacaguaaucug

SEQ ID NO: 47716 - RNA, 18 nt, Artificial Sequence
  Description of Artificial Sequence: Synthetic oligonucleotide
agacccccucggacagua

SEQ ID NO: 47717 - RNA, 18 nt, Artificial Sequence
  Description of Artificial Sequence: Synthetic oligonucleotide
gguacagacccccucgga

SEQ ID NO: 47718 - RNA, 18 nt, Artificial Sequence
  Description of Artificial Sequence: Synthetic oligonucleotide
ucguugguacagaccccc

SEQ ID NO: 47719 - RNA, 18 nt, Artificial Sequence
  Description of Artificial Sequence: Synthetic oligonucleotide
uguuaucguugguacaga

SEQ ID NO: 47720 - RNA, 18 nt, Artificial Sequence
  Description of Artificial Sequence: Synthetic oligonucleotide
ugguauguuaucguuggu

SEQ ID NO: 47721 - RNA, 18 nt, Artificial Sequence
  Description of Artificial Sequence: Synthetic oligonucleotide
gcagauguucucaaugaa

SEQ ID NO: 47722 - RNA, 18 nt, Artificial Sequence
  Description of Artificial Sequence: Synthetic oligonucleotide
ggagggcagauguucuca

SEQ ID NO: 47723 - RNA, 18 nt, Artificial Sequence
  Description of Artificial Sequence: Synthetic oligonucleotide
ggcagggagggcagaugu

SEQ ID NO: 47724 - RNA, 18 nt, Artificial Sequence
  Description of Artificial Sequence: Synthetic oligonucleotide
cuuagggcagggagggca

SEQ ID NO: 47725 - RNA, 18 nt, Artificial Sequence
  Description of Artificial Sequence: Synthetic oligonucleotide
uugggcuuagggcaggga

SEQ ID NO: 47726 - RNA, 18 nt, Artificial Sequence
  Description of Artificial Sequence: Synthetic oligonucleotide
gagcauugggcuuagggc

SEQ ID NO: 47727 - RNA, 18 nt, Artificial Sequence
  Description of Artificial Sequence: Synthetic oligonucleotide
ggagagagcauugggcuu

SEQ ID NO: 47728 - RNA, 18 nt, Artificial Sequence
  Description of Artificial Sequence: Synthetic oligonucleotide
aaagaggagagagcauug

SEQ ID NO: 47729 - RNA, 18 nt, Artificial Sequence
  Description of Artificial Sequence: Synthetic oligonucleotide
gagguaaagaggagagag

SEQ ID NO: 47730 - RNA, 18 nt, Artificial Sequence
  Description of Artificial Sequence: Synthetic oligonucleotide
gggaggagguaaagagga

SEQ ID NO: 47731 - RNA, 18 nt, Artificial Sequence
  Description of Artificial Sequence: Synthetic oligonucleotide
agggugggaggagguaaa

SEQ ID NO: 47732 - RNA, 18 nt, Artificial Sequence
  Description of Artificial Sequence: Synthetic oligonucleotide
gagagagggugggaggag

SEQ ID NO: 47733 - RNA, 18 nt, Artificial Sequence
  Description of Artificial Sequence: Synthetic oligonucleotide
guggagagagaggguggg

SEQ ID NO: 47734 - RNA, 18 nt, Artificial Sequence
  Description of Artificial Sequence: Synthetic oligonucleotide
agacaguggagagagagg

SEQ ID NO: 47735 - RNA, 18 nt, Artificial Sequence
  Description of Artificial Sequence: Synthetic oligonucleotide
cuaagagacaguggagag

SEQ ID NO: 47736 - RNA, 18 nt, Artificial Sequence
  Description of Artificial Sequence: Synthetic oligonucleotide
acagacuaagagacagug

SEQ ID NO: 47737 - RNA, 18 nt, Artificial Sequence
  Description of Artificial Sequence: Synthetic oligonucleotide
aggacacagacuaagaga

SEQ ID NO: 47738 - RNA, 18 nt, Artificial Sequence
  Description of Artificial Sequence: Synthetic oligonucleotide
gggagaggacacagacua

SEQ ID NO: 47739 - RNA, 18 nt, Artificial Sequence
  Description of Artificial Sequence: Synthetic oligonucleotide
gagcagggagaggacaca

SEQ ID NO: 47740 - RNA, 18 nt, Artificial Sequence
  Description of Artificial Sequence: Synthetic oligonucleotide
auguggagcagggagagg

SEQ ID NO: 47741 - RNA, 18 nt, Artificial Sequence
  Description of Artificial Sequence: Synthetic oligonucleotide
gacaaauguggagcaggg

SEQ ID NO: 47742 - RNA, 18 nt, Artificial Sequence
  Description of Artificial Sequence: Synthetic oligonucleotide
aaggagacaaauguggag

SEQ ID NO: 47743 - RNA, 18 nt, Artificial Sequence
  Description of Artificial Sequence: Synthetic oligonucleotide
guacaaaggagacaaaug

SEQ ID NO: 47744 - RNA, 18 nt, Artificial Sequence
  Description of Artificial Sequence: Synthetic oligonucleotide
cccagguacaaaggagac

SEQ ID NO: 47745 - RNA, 18 nt, Artificial Sequence
  Description of Artificial Sequence: Synthetic oligonucleotide
guucccccagguacaaag

SEQ ID NO: 47746 - RNA, 18 nt, Artificial Sequence
  Description of Artificial Sequence: Synthetic oligonucleotide
ucucuguucccccaggua

SEQ ID NO: 47747 - RNA, 18 nt, Artificial Sequence
  Description of Artificial Sequence: Synthetic oligonucleotide
auuccucucuguuccccc

SEQ ID NO: 47748 - RNA, 18 nt, Artificial Sequence
  Description of Artificial Sequence: Synthetic oligonucleotide
agggcauuccucucuguu

SEQ ID NO: 47749 - RNA, 18 nt, Artificial Sequence
  Description of Artificial Sequence: Synthetic oligonucleotide
aagucagggcauuccucu

SEQ ID NO: 47750 - RNA, 18 nt, Artificial Sequence
  Description of Artificial Sequence: Synthetic oligonucleotide
aagaaaagucagggcauu

SEQ ID NO: 47751 - RNA, 18 nt, Artificial Sequence
  Description of Artificial Sequence: Synthetic oligonucleotide
agucaaagaaaagucagg

SEQ ID NO: 47752 - RNA, 18 nt, Artificial Sequence
  Description of Artificial Sequence: Synthetic oligonucleotide
cagacagucaaagaaaag

SEQ ID NO: 47753 - RNA, 18 nt, Artificial Sequence
  Description of Artificial Sequence: Synthetic oligonucleotide
uuuuccagacagucaaag

SEQ ID NO: 47754 - RNA, 18 nt, Artificial Sequence
  Description of Artificial Sequence: Synthetic oligonucleotide
ucccauuuuccagacagu

SEQ ID NO: 47755 - RNA, 18 nt, Artificial Sequence
  Description of Artificial Sequence: Synthetic oligonucleotide
uugacucccauuuuccag

SEQ ID NO: 47756 - RNA, 18 nt, Artificial Sequence
  Description of Artificial Sequence: Synthetic oligonucleotide
cacacuugacucccauuu

SEQ ID NO: 47757 - RNA, 18 nt, Artificial Sequence
  Description of Artificial Sequence: Synthetic oligonucleotide
cuccccacacuugacucc

SEQ ID NO: 47758 - RNA, 18 nt, Artificial Sequence
  Description of Artificial Sequence: Synthetic oligonucleotide
aaugacuccccacacuug

SEQ ID NO: 47759 - RNA, 18 nt, Artificial Sequence
  Description of Artificial Sequence: Synthetic oligonucleotide
aagugaaugacuccccac

SEQ ID NO: 47760 - RNA, 18 nt, Artificial Sequence
  Description of Artificial Sequence: Synthetic oligonucleotide
aaaugaagugaaugacuc

SEQ ID NO: 47761 - RNA, 18 nt, Artificial Sequence
  Description of Artificial Sequence: Synthetic oligonucleotide
caugcaaaugaagugaau

SEQ ID NO: 47762 - RNA, 18 nt, Artificial Sequence
  Description of Artificial Sequence: Synthetic oligonucleotide
ugcagcaugcaaaugaag

SEQ ID NO: 47763 - RNA, 18 nt, Artificial Sequence
  Description of Artificial Sequence: Synthetic oligonucleotide
uguuuugcagcaugcaaa

SEQ ID NO: 47764 - RNA, 18 nt, Artificial Sequence
  Description of Artificial Sequence: Synthetic oligonucleotide
cccucuguuuugcagcau

SEQ ID NO: 47765 - RNA, 18 nt, Artificial Sequence
  Description of Artificial Sequence: Synthetic oligonucleotide
cuccgcccucuguuuugc

SEQ ID NO: 47766 - RNA, 18 nt, Artificial Sequence
  Description of Artificial Sequence: Synthetic oligonucleotide
ggugccuccgcccucugu

SEQ ID NO: 47767 - RNA, 18 nt, Artificial Sequence
  Description of Artificial Sequence: Synthetic oligonucleotide
ucccuggugccuccgccc

SEQ ID NO: 47768 - RNA, 18 nt, Artificial Sequence
  Description of Artificial Sequence: Synthetic oligonucleotide
gccuuucccuggugccuc

SEQ ID NO: 47769 - RNA, 18 nt, Artificial Sequence
  Description of Artificial Sequence: Synthetic oligonucleotide
caagugccuuucccuggu

SEQ ID NO: 47770 - RNA, 18 nt, Artificial Sequence
  Description of Artificial Sequence: Synthetic oligonucleotide
ucauucaagugccuuucc

SEQ ID NO: 47771 - RNA, 18 nt, Artificial Sequence
  Description of Artificial Sequence: Synthetic oligonucleotide
cuucuucauucaagugcc

SEQ ID NO: 47772 - RNA, 18 nt, Artificial Sequence
  Description of Artificial Sequence: Synthetic oligonucleotide
uuuuccuucuucauucaa

SEQ ID NO: 47773 - RNA, 18 nt, Artificial Sequence
  Description of Artificial Sequence: Synthetic oligonucleotide
ucucauuuuccuucuuca

SEQ ID NO: 47774 - RNA, 18 nt, Artificial Sequence
  Description of Artificial Sequence: Synthetic oligonucleotide
cugguucucauuuuccuu

SEQ ID NO: 47775 - RNA, 18 nt, Artificial Sequence
  Description of Artificial Sequence: Synthetic oligonucleotide
acaaucugguucucauuu

SEQ ID NO: 47776 - RNA, 18 nt, Artificial Sequence
  Description of Artificial Sequence: Synthetic oligonucleotide
aaguuacaaucugguucu

SEQ ID NO: 47777 - RNA, 18 nt, Artificial Sequence
  Description of Artificial Sequence: Synthetic oligonucleotide
ggacgaaguuacaaucug

SEQ ID NO: 47778 - RNA, 18 nt, Artificial Sequence
  Description of Artificial Sequence: Synthetic oligonucleotide
gauuaggacgaaguuaca

SEQ ID NO: 47779 - RNA, 18 nt, Artificial Sequence
  Description of Artificial Sequence: Synthetic oligonucleotide
agguggauuaggacgaag

SEQ ID NO: 47780 - RNA, 18 nt, Artificial Sequence
  Description of Artificial Sequence: Synthetic oligonucleotide
cuggcagguggauuagga

SEQ ID NO: 47781 - RNA, 18 nt, Artificial Sequence
  Description of Artificial Sequence: Synthetic oligonucleotide
aaguucuggcagguggau

SEQ ID NO: 47782 - RNA, 18 nt, Artificial Sequence
  Description of Artificial Sequence: Synthetic oligonucleotide
aaggaaaguucuggcagg

SEQ ID NO: 47783 - RNA, 18 nt, Artificial Sequence
  Description of Artificial Sequence: Synthetic oligonucleotide
accugaaggaaaguucug

SEQ ID NO: 47784 - RNA, 18 nt, Artificial Sequence
  Description of Artificial Sequence: Synthetic oligonucleotide
gugacaccugaaggaaag

SEQ ID NO: 47785 - RNA, 18 nt, Artificial Sequence
  Description of Artificial Sequence: Synthetic oligonucleotide
gaugugugacaccugaag

SEQ ID NO: 47786 - RNA, 18 nt, Artificial Sequence
  Description of Artificial Sequence: Synthetic oligonucleotide
aaauggaugugugacacc

SEQ ID NO: 47787 - RNA, 18 nt, Artificial Sequence
  Description of Artificial Sequence: Synthetic oligonucleotide
gauggaaauggaugugug

SEQ ID NO: 47788 - RNA, 18 nt, Artificial Sequence
  Description of Artificial Sequence: Synthetic oligonucleotide
auuaggauggaaauggau

SEQ ID NO: 47789 - RNA, 18 nt, Artificial Sequence
  Description of Artificial Sequence: Synthetic oligonucleotide
uuaauauuaggauggaaa

SEQ ID NO: 47790 - RNA, 18 nt, Artificial Sequence
  Description of Artificial Sequence: Synthetic oligonucleotide
auuguuuaauauuaggau

SEQ ID NO: 47791 - RNA, 18 nt, Artificial Sequence
  Description of Artificial Sequence: Synthetic oligonucleotide
auuauauuguuuaauauu

SEQ ID NO: 47792 - RNA, 18 nt, Artificial Sequence
  Description of Artificial Sequence: Synthetic oligonucleotide
cuuucauuauauuguuua

SEQ ID NO: 47793 - RNA, 18 nt, Artificial Sequence
  Description of Artificial Sequence: Synthetic oligonucleotide
gcuuucuuucauuauauu

SEQ ID NO: 47794 - RNA, 18 nt, Artificial Sequence
  Description of Artificial Sequence: Synthetic oligonucleotide
gaugugugacaccugaag

SEQ ID NO: 47795 - RNA, 18 nt, Artificial Sequence
  Description of Artificial Sequence: Synthetic oligonucleotide
aaauggaugugugacacc

SEQ ID NO: 47796 - RNA, 18 nt, Artificial Sequence
  Description of Artificial Sequence: Synthetic oligonucleotide
gauggaaauggaugugug

SEQ ID NO: 47797 - RNA, 18 nt, Artificial Sequence
  Description of Artificial Sequence: Synthetic oligonucleotide
auuaggauggaaauggau

SEQ ID NO: 47798 - RNA, 18 nt, Artificial Sequence
  Description of Artificial Sequence: Synthetic oligonucleotide
uuaauauuaggauggaaa

SEQ ID NO: 47799 - RNA, 18 nt, Artificial Sequence
  Description of Artificial Sequence: Synthetic oligonucleotide
auuguuuaauauuaggau

SEQ ID NO: 47800 - RNA, 18 nt, Artificial Sequence
  Description of Artificial Sequence: Synthetic oligonucleotide
auuauauuguuuaauauu

SEQ ID NO: 47801 - RNA, 18 nt, Artificial Sequence
  Description of Artificial Sequence: Synthetic oligonucleotide
cuuucauuauauuguuua

SEQ ID NO: 47802 - RNA, 18 nt, Artificial Sequence
  Description of Artificial Sequence: Synthetic oligonucleotide
gcuuucuuucauuauauu

SEQ ID NO: 47803 - RNA, 18 nt, Artificial Sequence
  Description of Artificial Sequence: Synthetic oligonucleotide
guaaagcuuucuuucauu

SEQ ID NO: 47804 - RNA, 18 nt, Artificial Sequence
  Description of Artificial Sequence: Synthetic oligonucleotide
uuguuguaaagcuuucuu

SEQ ID NO: 47805 - RNA, 18 nt, Artificial Sequence
  Description of Artificial Sequence: Synthetic oligonucleotide
uagacuuguuguaaagcu

SEQ ID NO: 47806 - RNA, 18 nt, Artificial Sequence
  Description of Artificial Sequence: Synthetic oligonucleotide
cuauuuagacuuguugua

SEQ ID NO: 47807 - RNA, 18 nt, Artificial Sequence
  Description of Artificial Sequence: Synthetic oligonucleotide
aaaaacuauuuagacuug

SEQ ID NO: 47808 - RNA, 18 nt, Artificial Sequence
  Description of Artificial Sequence: Synthetic oligonucleotide
aaaauaaaaacuauuuag

SEQ ID NO: 47809 - RNA, 18 nt, Artificial Sequence
  Description of Artificial Sequence: Synthetic oligonucleotide
gcccgaaaauaaaaacua

SEQ ID NO: 47810 - RNA, 18 nt, Artificial Sequence
  Description of Artificial Sequence: Synthetic oligonucleotide
agacugcccgaaaauaaa

SEQ ID NO: 47811 - RNA, 18 nt, Artificial Sequence
  Description of Artificial Sequence: Synthetic oligonucleotide
uuaaaagacugcccgaaa

SEQ ID NO: 47812 - RNA, 18 nt, Artificial Sequence
  Description of Artificial Sequence: Synthetic oligonucleotide
cuuuguuaaaagacugcc

SEQ ID NO: 47813 - RNA, 18 nt, Artificial Sequence
  Description of Artificial Sequence: Synthetic oligonucleotide
cuuugcuuuguuaaaaga

SEQ ID NO: 47814 - RNA, 18 nt, Artificial Sequence
  Description of Artificial Sequence: Synthetic oligonucleotide
gguugcuuugcuuuguua

SEQ ID NO: 47815 - RNA, 18 nt, Artificial Sequence
  Description of Artificial Sequence: Synthetic oligonucleotide
cacacgguugcuuugcuu

SEQ ID NO: 47816 - RNA, 18 nt, Artificial Sequence
  Description of Artificial Sequence: Synthetic oligonucleotide
uaacucacacgguugcuu

SEQ ID NO: 47817 - RNA, 18 nt, Artificial Sequence
  Description of Artificial Sequence: Synthetic oligonucleotide
ugaccuaacucacacggu

SEQ ID NO: 47818 - RNA, 18 nt, Artificial Sequence
  Description of Artificial Sequence: Synthetic oligonucleotide
ucuggugaccuaacucac

SEQ ID NO: 47819 - RNA, 18 nt, Artificial Sequence
  Description of Artificial Sequence: Synthetic oligonucleotide
gugucucuggugaccuaa

SEQ ID NO: 47820 - RNA, 18 nt, Artificial Sequence
  Description of Artificial Sequence: Synthetic oligonucleotide
gcuuggugucucugguga

SEQ ID NO: 47821 - RNA, 18 nt, Artificial Sequence
  Description of Artificial Sequence: Synthetic oligonucleotide
ccauugcuuggugucucu

SEQ ID NO: 47822 - RNA, 18 nt, Artificial Sequence
  Description of Artificial Sequence: Synthetic oligonucleotide
cuucaccauugcuuggug

SEQ ID NO: 47823 - RNA, 18 nt, Artificial Sequence
  Description of Artificial Sequence: Synthetic oligonucleotide
ggguccuucaccauugcu

SEQ ID NO: 47824 - RNA, 18 nt, Artificial Sequence
  Description of Artificial Sequence: Synthetic oligonucleotide
agagaauugggcggaggg

SEQ ID NO: 47825 - RNA, 18 nt, Artificial Sequence
  Description of Artificial Sequence: Synthetic oligonucleotide
ggauagagaauugggcgg

SEQ ID NO: 47826 - RNA, 18 nt, Artificial Sequence
  Description of Artificial Sequence: Synthetic oligonucleotide
uaguuggauagagaauug

SEQ ID NO: 47827 - RNA, 18 nt, Artificial Sequence
  Description of Artificial Sequence: Synthetic oligonucleotide
aaauuuaguuggauagag

SEQ ID NO: 47828 - RNA, 18 nt, Artificial Sequence
  Description of Artificial Sequence: Synthetic oligonucleotide
cauggaaauuuaguugga

SEQ ID NO: 47829 - RNA, 18 nt, Artificial Sequence
  Description of Artificial Sequence: Synthetic oligonucleotide
uugggcauggaaauuuag

SEQ ID NO: 47830 - RNA, 18 nt, Artificial Sequence
  Description of Artificial Sequence: Synthetic oligonucleotide
ucacuuugggcauggaaa

SEQ ID NO: 47831 - RNA, 18 nt, Artificial Sequence
  Description of Artificial Sequence: Synthetic oligonucleotide
agcuaucacuuugggcau

SEQ ID NO: 47832 - RNA, 18 nt, Artificial Sequence
  Description of Artificial Sequence: Synthetic oligonucleotide
augauagcuaucacuuug

SEQ ID NO: 47833 - RNA, 18 nt, Artificial Sequence
  Description of Artificial Sequence: Synthetic oligonucleotide
aaaaaaugauagcuauca

SEQ ID NO: 47834 - RNA, 18 nt, Artificial Sequence
  Description of Artificial Sequence: Synthetic oligonucleotide
cguggaaaaaaugauagc

SEQ ID NO: 47835 - RNA, 18 nt, Artificial Sequence
  Description of Artificial Sequence: Synthetic oligonucleotide
uacaccguggaaaaaaug

SEQ ID NO: 47836 - RNA, 18 nt, Artificial Sequence
  Description of Artificial Sequence: Synthetic oligonucleotide
gcagauacaccguggaaa

SEQ ID NO: 47837 - RNA, 18 nt, Artificial Sequence
  Description of Artificial Sequence: Synthetic oligonucleotide
gauuugcagauacaccgu

SEQ ID NO: 47838 - RNA, 18 nt, Artificial Sequence
  Description of Artificial Sequence: Synthetic oligonucleotide
ggguggauuugcagauac

SEQ ID NO: 47839 - RNA, 18 nt, Artificial Sequence
  Description of Artificial Sequence: Synthetic oligonucleotide
acaguggguggauuugca

SEQ ID NO: 47840 - RNA, 18 nt, Artificial Sequence
  Description of Artificial Sequence: Synthetic oligonucleotide
ccgggacaguggguggau

SEQ ID NO: 47841 - RNA, 18 nt, Artificial Sequence
  Description of Artificial Sequence: Synthetic oligonucleotide
ccaccccgggacaguggg

SEQ ID NO: 47842 - RNA, 18 nt, Artificial Sequence
  Description of Artificial Sequence: Synthetic oligonucleotide
cccagccaccccgggaca

SEQ ID NO: 47843 - RNA, 18 nt, Artificial Sequence
  Description of Artificial Sequence: Synthetic oligonucleotide
aagcucccagccaccccg

SEQ ID NO: 47844 - RNA, 18 nt, Artificial Sequence
  Description of Artificial Sequence: Synthetic oligonucleotide
uuaaaaagcucccagcca

SEQ ID NO: 47845 - RNA, 18 nt, Artificial Sequence
  Description of Artificial Sequence: Synthetic oligonucleotide
acccguuaaaaagcuccc

SEQ ID NO: 47846 - RNA, 18 nt, Artificial Sequence
  Description of Artificial Sequence: Synthetic oligonucleotide
ucucaacccguuaaaaag

SEQ ID NO: 47847 - RNA, 18 nt, Artificial Sequence
  Description of Artificial Sequence: Synthetic oligonucleotide
gcaacucucaacccguua

SEQ ID NO: 47848 - RNA, 18 nt, Artificial Sequence
  Description of Artificial Sequence: Synthetic oligonucleotide
aaaaagcaacucucaacc

SEQ ID NO: 47849 - RNA, 18 nt, Artificial Sequence
  Description of Artificial Sequence: Synthetic oligonucleotide
accuuaaaaagcaacucu

SEQ ID NO: 47850 - RNA, 18 nt, Artificial Sequence
  Description of Artificial Sequence: Synthetic oligonucleotide
ccacaaccuuaaaaagca

SEQ ID NO: 47851 - RNA, 18 nt, Artificial Sequence
  Description of Artificial Sequence: Synthetic oligonucleotide
cucacccacaaccuuaaa

SEQ ID NO: 47852 - RNA, 18 nt, Artificial Sequence
  Description of Artificial Sequence: Synthetic oligonucleotide
cucagcucacccacaacc

SEQ ID NO: 47853 - RNA, 18 nt, Artificial Sequence
  Description of Artificial Sequence: Synthetic oligonucleotide
cccaucucagcucaccca

SEQ ID NO: 47854 - RNA, 18 nt, Artificial Sequence
  Description of Artificial Sequence: Synthetic oligonucleotide
agucacccaucucagcuc

SEQ ID NO: 47855 - RNA, 18 nt, Artificial Sequence
  Description of Artificial Sequence: Synthetic oligonucleotide
gacacagucacccaucuc

SEQ ID NO: 47856 - RNA, 18 nt, Artificial Sequence
  Description of Artificial Sequence: Synthetic oligonucleotide
cugaagacacagucaccc

SEQ ID NO: 47857 - RNA, 18 nt, Artificial Sequence
  Description of Artificial Sequence: Synthetic oligonucleotide
gucuccugaagacacagu

SEQ ID NO: 47858 - RNA, 18 nt, Artificial Sequence
  Description of Artificial Sequence: Synthetic oligonucleotide
guagugucuccugaagac

SEQ ID NO: 47859 - RNA, 18 nt, Artificial Sequence
  Description of Artificial Sequence: Synthetic oligonucleotide
aaaugguagugucuccug

SEQ ID NO: 47860 - RNA, 18 nt, Artificial Sequence
  Description of Artificial Sequence: Synthetic oligonucleotide
aaaccaaaugguaguguc

SEQ ID NO: 47861 - RNA, 18 nt, Artificial Sequence
  Description of Artificial Sequence: Synthetic oligonucleotide
aaaucaaaccaaauggua

SEQ ID NO: 47862 - RNA, 18 nt, Artificial Sequence
  Description of Artificial Sequence: Synthetic oligonucleotide
cucuguuuauugaugaca

SEQ ID NO: 47863 - RNA, 18 nt, Artificial Sequence
  Description of Artificial Sequence: Synthetic oligonucleotide
aagaacucuguuuauuga

SEQ ID NO: 47864 - RNA, 18 nt, Artificial Sequence
  Description of Artificial Sequence: Synthetic oligonucleotide
uugcgaagaacucuguuu

SEQ ID NO: 47865 - RNA, 18 nt, Artificial Sequence
  Description of Artificial Sequence: Synthetic oligonucleotide
ccagguugcgaagaacuc

SEQ ID NO: 47866 - RNA, 18 nt, Artificial Sequence
  Description of Artificial Sequence: Synthetic oligonucleotide
gcuagccagguugcgaag

SEQ ID NO: 47867 - RNA, 18 nt, Artificial Sequence
  Description of Artificial Sequence: Synthetic oligonucleotide
uuuucgcuagccagguug

SEQ ID NO: 47868 - RNA, 18 nt, Artificial Sequence
  Description of Artificial Sequence: Synthetic oligonucleotide
guugcuuuucgcuagcca

SEQ ID NO: 47869 - RNA, 18 nt, Artificial Sequence
  Description of Artificial Sequence: Synthetic oligonucleotide
caucuguugcuuuucgcu

SEQ ID NO: 47870 - RNA, 18 nt, Artificial Sequence
  Description of Artificial Sequence: Synthetic oligonucleotide
gcgcccaucuguugcuuu

SEQ ID NO: 47871 - RNA, 18 nt, Artificial Sequence
  Description of Artificial Sequence: Synthetic oligonucleotide
cgucugcgcccaucuguu

SEQ ID NO: 47872 - RNA, 18 nt, Artificial Sequence
  Description of Artificial Sequence: Synthetic oligonucleotide
caugccgucugcgcccau

SEQ ID NO: 47873 - RNA, 18 nt, Artificial Sequence
  Description of Artificial Sequence: Synthetic oligonucleotide
ucauacaugccgucugcg

SEQ ID NO: 47874 - RNA, 18 nt, Artificial Sequence
  Description of Artificial Sequence: Synthetic oligonucleotide
guuuaucauacaugccgu

SEQ ID NO: 47875 - RNA, 18 nt, Artificial Sequence
  Description of Artificial Sequence: Synthetic oligonucleotide
ccuuaguuuaucauacau

SEQ ID NO: 47876 - RNA, 18 nt, Artificial Sequence
  Description of Artificial Sequence: Synthetic oligonucleotide
aacauccuuaguuuauca

SEQ ID NO: 47877 - RNA, 18 nt, Artificial Sequence
  Description of Artificial Sequence: Synthetic oligonucleotide
cguucaacauccuuaguu

SEQ ID NO: 47878 - RNA, 18 nt, Artificial Sequence
  Description of Artificial Sequence: Synthetic oligonucleotide
cugcccguucaacauccu

SEQ ID NO: 47879 - RNA, 18 nt, Artificial Sequence
  Description of Artificial Sequence: Synthetic oligonucleotide
ccggucugcccguucaac

SEQ ID NO: 47880 - RNA, 18 nt, Artificial Sequence
  Description of Artificial Sequence: Synthetic oligonucleotide
agcuuccggucugcccgu

SEQ ID NO: 47881 - RNA, 18 nt, Artificial Sequence
  Description of Artificial Sequence: Synthetic oligonucleotide
gccccagcuuccggucug

SEQ ID NO: 47882 - RNA, 18 nt, Artificial Sequence
  Description of Artificial Sequence: Synthetic oligonucleotide
cgggugccccagcuuccg

SEQ ID NO: 47883 - RNA, 18 nt, Artificial Sequence
  Description of Artificial Sequence: Synthetic oligonucleotide
cagggcgggugccccagc

SEQ ID NO: 47884 - RNA, 18 nt, Artificial Sequence
  Description of Artificial Sequence: Synthetic oligonucleotide
ccaaccagggcgggugcc

SEQ ID NO: 47885 - RNA, 18 nt, Artificial Sequence
  Description of Artificial Sequence: Synthetic oligonucleotide
ggauaccaaccagggcgg

SEQ ID NO: 47886 - RNA, 18 nt, Artificial Sequence
  Description of Artificial Sequence: Synthetic oligonucleotide
uccccggauaccaaccag

SEQ ID NO: 47887 - RNA, 18 nt, Artificial Sequence
  Description of Artificial Sequence: Synthetic oligonucleotide
cgaaguccccggauacca

SEQ ID NO: 47888 - RNA, 18 nt, Artificial Sequence
  Description of Artificial Sequence: Synthetic oligonucleotide
ggcaccgaaguccccgga

SEQ ID NO: 47889 - RNA, 18 nt, Artificial Sequence
  Description of Artificial Sequence: Synthetic oligonucleotide
gcccuggcaccgaagucc

SEQ ID NO: 47890 - RNA, 18 nt, Artificial Sequence
  Description of Artificial Sequence: Synthetic oligonucleotide
agguugcccuggcaccga

SEQ ID NO: 47891 - RNA, 18 nt, Artificial Sequence
  Description of Artificial Sequence: Synthetic oligonucleotide
ugcguagguugcccuggc

SEQ ID NO: 47892 - RNA, 18 nt, Artificial Sequence
  Description of Artificial Sequence: Synthetic oligonucleotide
gccgcgggauuccacggg

SEQ ID NO: 47893 - RNA, 18 nt, Artificial Sequence
  Description of Artificial Sequence: Synthetic oligonucleotide
augcuggcucuggcuggg

SEQ ID NO: 47894 - RNA, 18 nt, Artificial Sequence
  Description of Artificial Sequence: Synthetic oligonucleotide
ucugcaugcuggcucugg

SEQ ID NO: 47895 - RNA, 18 nt, Artificial Sequence
  Description of Artificial Sequence: Synthetic oligonucleotide
ccagaaagaccagaggca

SEQ ID NO: 47896 - RNA, 18 nt, Artificial Sequence
  Description of Artificial Sequence: Synthetic oligonucleotide
aagucccagaaagaccag

SEQ ID NO: 47897 - RNA, 18 nt, Artificial Sequence
  Description of Artificial Sequence: Synthetic oligonucleotide
gcccgaagucccagaaag

SEQ ID NO: 47898 - RNA, 18 nt, Artificial Sequence
  Description of Artificial Sequence: Synthetic oligonucleotide
cccgagcccgaaguccca

SEQ ID NO: 47899 - RNA, 18 nt, Artificial Sequence
  Description of Artificial Sequence: Synthetic oligonucleotide
cgcaccccgagcccgaag

SEQ ID NO: 47900 - RNA, 18 nt, Artificial Sequence
  Description of Artificial Sequence: Synthetic oligonucleotide
guccgcgcaccccgagcc

SEQ ID NO: 47901 - RNA, 18 nt, Artificial Sequence
  Description of Artificial Sequence: Synthetic oligonucleotide
cucggguccgcgcacccc

SEQ ID NO: 47902 - RNA, 18 nt, Artificial Sequence
  Description of Artificial Sequence: Synthetic oligonucleotide
ugacccucggguccgcgc

SEQ ID NO: 47903 - RNA, 18 nt, Artificial Sequence
  Description of Artificial Sequence: Synthetic oligonucleotide
uccccugacccucggguc

SEQ ID NO: 47904 - RNA, 18 nt, Artificial Sequence
  Description of Artificial Sequence: Synthetic oligonucleotide
uguccuccccugacccuc

SEQ ID NO: 47905 - RNA, 18 nt, Artificial Sequence
  Description of Artificial Sequence: Synthetic oligonucleotide
cccuguguccuccccuga

SEQ ID NO: 47906 - RNA, 18 nt, Artificial Sequence
  Description of Artificial Sequence: Synthetic oligonucleotide
cgagucccuguguccucc

SEQ ID NO: 47907 - RNA, 18 nt, Artificial Sequence
  Description of Artificial Sequence: Synthetic oligonucleotide
cgucgcgagucccugugu

SEQ ID NO: 47908 - RNA, 18 nt, Artificial Sequence
  Description of Artificial Sequence: Synthetic oligonucleotide
gcgggcgucgcgaguccc

SEQ ID NO: 47909 - RNA, 18 nt, Artificial Sequence
  Description of Artificial Sequence: Synthetic oligonucleotide
ccagcgcgggcgucgcga

SEQ ID NO: 47910 - RNA, 18 nt, Artificial Sequence
  Description of Artificial Sequence: Synthetic oligonucleotide
ccgggccagcgcgggcgu

SEQ ID NO: 47911 - RNA, 18 nt, Artificial Sequence
  Description of Artificial Sequence: Synthetic oligonucleotide
ggcggccgggccagcgcg

SEQ ID NO: 47912 - RNA, 18 nt, Artificial Sequence
  Description of Artificial Sequence: Synthetic oligonucleotide
cggucggcggccgggcca

SEQ ID NO: 47913 - RNA, 18 nt, Artificial Sequence
  Description of Artificial Sequence: Synthetic oligonucleotide
ucagucggucggcggccg

SEQ ID NO: 47914 - RNA, 18 nt, Artificial Sequence
  Description of Artificial Sequence: Synthetic oligonucleotide
gggccucagucggucggc

SEQ ID NO: 47915 - RNA, 18 nt, Artificial Sequence
  Description of Artificial Sequence: Synthetic oligonucleotide
uccccgggccucagucgg

SEQ ID NO: 47916 - RNA, 18 nt, Artificial Sequence
  Description of Artificial Sequence: Synthetic oligonucleotide
gcagguccccgggccuca

SEQ ID NO: 47917 - RNA, 18 nt, Artificial Sequence
  Description of Artificial Sequence: Synthetic oligonucleotide
ccgccgcagguccccggg

SEQ ID NO: 47918 - RNA, 18 nt, Artificial Sequence
  Description of Artificial Sequence: Synthetic oligonucleotide
agcagccgccgcaggucc

SEQ ID NO: 47919 - RNA, 18 nt, Artificial Sequence
  Description of Artificial Sequence: Synthetic oligonucleotide
gggagcagccgccgcagg

SEQ ID NO: 47920 - RNA, 18 nt, Artificial Sequence
  Description of Artificial Sequence: Synthetic oligonucleotide
ugccgggcgcggagcggg

SEQ ID NO: 47921 - RNA, 18 nt, Artificial Sequence
  Description of Artificial Sequence: Synthetic oligonucleotide
cgggcugccgggcgcgga

SEQ ID NO: 47922 - RNA, 18 nt, Artificial Sequence
  Description of Artificial Sequence: Synthetic oligonucleotide
ccucccgggcugccgggc

SEQ ID NO: 47923 - RNA, 18 nt, Artificial Sequence
  Description of Artificial Sequence: Synthetic oligonucleotide
ccuccccucccgggcugc

SEQ ID NO: 47924 - RNA, 18 nt, Artificial Sequence
  Description of Artificial Sequence: Synthetic oligonucleotide
aacgcccuccccucccgg

SEQ ID NO: 47925 - RNA, 18 nt, Artificial Sequence
  Description of Artificial Sequence: Synthetic oligonucleotide
aagcaaacgcccuccccu

SEQ ID NO: 47926 - RNA, 18 nt, Artificial Sequence
  Description of Artificial Sequence: Synthetic oligonucleotide
gagccaagcaaacgcccu

SEQ ID NO: 47927 - RNA, 18 nt, Artificial Sequence
  Description of Artificial Sequence: Synthetic oligonucleotide
gagaagagccaagcaaac

SEQ ID NO: 47928 - RNA, 18 nt, Artificial Sequence
  Description of Artificial Sequence: Synthetic oligonucleotide
guaucgagaagagccaag

SEQ ID NO: 47929 - RNA, 18 nt, Artificial Sequence
  Description of Artificial Sequence: Synthetic oligonucleotide
cuccaguaucgagaagag

SEQ ID NO: 47930 - RNA, 18 nt, Artificial Sequence
  Description of Artificial Sequence: Synthetic oligonucleotide
ugcuucuccaguaucgag

SEQ ID NO: 47931 - RNA, 18 nt, Artificial Sequence
  Description of Artificial Sequence: Synthetic oligonucleotide
gccccugcuucuccagua

SEQ ID NO: 47932 - RNA, 18 nt, Artificial Sequence
  Description of Artificial Sequence: Synthetic oligonucleotide
gcccagccccugcuucuc

SEQ ID NO: 47933 - RNA, 18 nt, Artificial Sequence
  Description of Artificial Sequence: Synthetic oligonucleotide
uaagggcccagccccugc

SEQ ID NO: 47934 - RNA, 18 nt, Artificial Sequence
  Description of Artificial Sequence: Synthetic oligonucleotide
guucuuaagggcccagcc

SEQ ID NO: 47935 - RNA, 18 nt, Artificial Sequence
  Description of Artificial Sequence: Synthetic oligonucleotide
gggcuguucuuaagggcc

SEQ ID NO: 47936 - RNA, 18 nt, Artificial Sequence
  Description of Artificial Sequence: Synthetic oligonucleotide
cgggcgggcuguucuuaa

SEQ ID NO: 47937 - RNA, 18 nt, Artificial Sequence
  Description of Artificial Sequence: Synthetic oligonucleotide
aaacucgggcgggcuguu

SEQ ID NO: 47938 - RNA, 18 nt, Artificial Sequence
  Description of Artificial Sequence: Synthetic oligonucleotide
uucgaaaacucgggcggg

SEQ ID NO: 47939 - RNA, 18 nt, Artificial Sequence
  Description of Artificial Sequence: Synthetic oligonucleotide
gcagcuucgaaaacucgg

SEQ ID NO: 47940 - RNA, 18 nt, Artificial Sequence
  Description of Artificial Sequence: Synthetic oligonucleotide
cuaccgcagcuucgaaaa

SEQ ID NO: 47941 - RNA, 18 nt, Artificial Sequence
  Description of Artificial Sequence: Synthetic oligonucleotide
uuucucuaccgcagcuuc

SEQ ID NO: 47942 - RNA, 18 nt, Artificial Sequence
  Description of Artificial Sequence: Synthetic oligonucleotide
ggguuucucuaccgcagc

SEQ ID NO: 47943 - RNA, 18 nt, Artificial Sequence
  Description of Artificial Sequence: Synthetic oligonucleotide
ugaguuacaggauuuggg

SEQ ID NO: 47944 - RNA, 18 nt, Artificial Sequence
  Description of Artificial Sequence: Synthetic oligonucleotide
gggugugaguuacaggau

SEQ ID NO: 47945 - RNA, 18 nt, Artificial Sequence
  Description of Artificial Sequence: Synthetic oligonucleotide
gggucagagcccgggcag

SEQ ID NO: 47946 - RNA, 18 nt, Artificial Sequence
  Description of Artificial Sequence: Synthetic oligonucleotide
ccagccccucucuccggg

SEQ ID NO: 47947 - RNA, 18 nt, Artificial Sequence
  Description of Artificial Sequence: Synthetic oligonucleotide
ucagcccagccccucucu

SEQ ID NO: 47948 - RNA, 18 nt, Artificial Sequence
  Description of Artificial Sequence: Synthetic oligonucleotide
ccugaucagcccagcccc

SEQ ID NO: 47949 - RNA, 18 nt, Artificial Sequence
  Description of Artificial Sequence: Synthetic oligonucleotide
cccgcccugaucagccca

SEQ ID NO: 47950 - RNA, 18 nt, Artificial Sequence
  Description of Artificial Sequence: Synthetic oligonucleotide
uucgccccgcccugauca

SEQ ID NO: 47951 - RNA, 18 nt, Artificial Sequence
  Description of Artificial Sequence: Synthetic oligonucleotide
aagacuucgccccgcccu

SEQ ID NO: 47952 - RNA, 18 nt, Artificial Sequence
  Description of Artificial Sequence: Synthetic oligonucleotide
aggagaagacuucgcccc

SEQ ID NO: 47953 - RNA, 18 nt, Artificial Sequence
  Description of Artificial Sequence: Synthetic oligonucleotide
caacuaggagaagacuuc

SEQ ID NO: 47954 - RNA, 18 nt, Artificial Sequence
  Description of Artificial Sequence: Synthetic oligonucleotide
ucgcucaacuaggagaag

SEQ ID NO: 47955 - RNA, 18 nt, Artificial Sequence
  Description of Artificial Sequence: Synthetic oligonucleotide
ccuucucgcucaacuagg

SEQ ID NO: 47956 - RNA, 18 nt, Artificial Sequence
  Description of Artificial Sequence: Synthetic oligonucleotide
ggccuccuucucgcucaa

SEQ ID NO: 47957 - RNA, 18 nt, Artificial Sequence
  Description of Artificial Sequence: Synthetic oligonucleotide
gggccuccuucucgcuca

SEQ ID NO: 47958 - RNA, 18 nt, Artificial Sequence
  Description of Artificial Sequence: Synthetic oligonucleotide
uuggcuaagcccaaaggg

SEQ ID NO: 47959 - RNA, 18 nt, Artificial Sequence
  Description of Artificial Sequence: Synthetic oligonucleotide
cagucuuggcuaagccca

SEQ ID NO: 47960 - RNA, 18 nt, Artificial Sequence
  Description of Artificial Sequence: Synthetic oligonucleotide
acuuucagucuuggcuaa

SEQ ID NO: 47961 - RNA, 18 nt, Artificial Sequence
  Description of Artificial Sequence: Synthetic oligonucleotide
uggagacuuucagucuug

SEQ ID NO: 47962 - RNA, 18 nt, Artificial Sequence
  Description of Artificial Sequence: Synthetic oligonucleotide
guugguggagacuuucag

SEQ ID NO: 47963 - RNA, 18 nt, Artificial Sequence
  Description of Artificial Sequence: Synthetic oligonucleotide
gccggguugguggagacu

SEQ ID NO: 47964 - RNA, 18 nt, Artificial Sequence
  Description of Artificial Sequence: Synthetic oligonucleotide
accccgccggguuggugg

SEQ ID NO: 47965 - RNA, 18 nt, Artificial Sequence
  Description of Artificial Sequence: Synthetic oligonucleotide
ccccaaccccgccggguu

SEQ ID NO: 47966 - RNA, 18 nt, Artificial Sequence
  Description of Artificial Sequence: Synthetic oligonucleotide
gaagcccccaaccccgcc

SEQ ID NO: 47967 - RNA, 18 nt, Artificial Sequence
  Description of Artificial Sequence: Synthetic oligonucleotide
ggagagaagcccccaacc

SEQ ID NO: 47968 - RNA, 18 nt, Artificial Sequence
  Description of Artificial Sequence: Synthetic oligonucleotide
gggagagaagcccccaac

SEQ ID NO: 47969 - RNA, 18 nt, Artificial Sequence
  Description of Artificial Sequence: Synthetic oligonucleotide
cccugagagugacuuggg

SEQ ID NO: 47970 - RNA, 18 nt, Artificial Sequence
  Description of Artificial Sequence: Synthetic oligonucleotide
agcugcccugagagugac

SEQ ID NO: 47971 - RNA, 18 nt, Artificial Sequence
  Description of Artificial Sequence: Synthetic oligonucleotide
ggaggagcugcccugaga

SEQ ID NO: 47972 - RNA, 18 nt, Artificial Sequence
  Description of Artificial Sequence: Synthetic oligonucleotide
gggaggagcugcccugag

SEQ ID NO: 47973 - RNA, 18 nt, Artificial Sequence
  Description of Artificial Sequence: Synthetic oligonucleotide
uucuaggcccguaguggg

SEQ ID NO: 47974 - RNA, 18 nt, Artificial Sequence
  Description of Artificial Sequence: Synthetic oligonucleotide
aucccuucuaggcccgua

SEQ ID NO: 47975 - RNA, 18 nt, Artificial Sequence
  Description of Artificial Sequence: Synthetic oligonucleotide
uccccaucccuucuaggc

SEQ ID NO: 47976 - RNA, 18 nt, Artificial Sequence
  Description of Artificial Sequence: Synthetic oligonucleotide
uggguucuacagauccca

SEQ ID NO: 47977 - RNA, 18 nt, Artificial Sequence
  Description of Artificial Sequence: Synthetic oligonucleotide
aaccauggguucuacaga

SEQ ID NO: 47978 - RNA, 18 nt, Artificial Sequence
  Description of Artificial Sequence: Synthetic oligonucleotide
ccgcaaaccauggguucu

SEQ ID NO: 47979 - RNA, 18 nt, Artificial Sequence
  Description of Artificial Sequence: Synthetic oligonucleotide
ugucaccgcaaaccaugg

SEQ ID NO: 47980 - RNA, 18 nt, Artificial Sequence
  Description of Artificial Sequence: Synthetic oligonucleotide
cugagugucaccgcaaac

SEQ ID NO: 47981 - RNA, 18 nt, Artificial Sequence
  Description of Artificial Sequence: Synthetic oligonucleotide
ccccucugagugucaccg

SEQ ID NO: 47982 - RNA, 18 nt, Artificial Sequence
  Description of Artificial Sequence: Synthetic oligonucleotide
aagauccccucugagugu

SEQ ID NO: 47983 - RNA, 18 nt, Artificial Sequence
  Description of Artificial Sequence: Synthetic oligonucleotide
ucccaaagauccccucug

SEQ ID NO: 47984 - RNA, 18 nt, Artificial Sequence
  Description of Artificial Sequence: Synthetic oligonucleotide
aaaucucccaaagauccc

SEQ ID NO: 47985 - RNA, 18 nt, Artificial Sequence
  Description of Artificial Sequence: Synthetic oligonucleotide
ucuauaaaucucccaaag

SEQ ID NO: 47986 - RNA, 18 nt, Artificial Sequence
  Description of Artificial Sequence: Synthetic oligonucleotide
ccggcucuauaaaucucc

SEQ ID NO: 47987 - RNA, 18 nt, Artificial Sequence
  Description of Artificial Sequence: Synthetic oligonucleotide
aagaaccggcucuauaaa

SEQ ID NO: 47988 - RNA, 18 nt, Artificial Sequence
  Description of Artificial Sequence: Synthetic oligonucleotide
gcgcuaagaaccggcucu

SEQ ID NO: 47989 - RNA, 18 nt, Artificial Sequence
  Description of Artificial Sequence: Synthetic oligonucleotide
acaaagcgcuaagaaccg

SEQ ID NO: 47990 - RNA, 18 nt, Artificial Sequence
  Description of Artificial Sequence: Synthetic oligonucleotide
aacccacaaagcgcuaag

SEQ ID NO: 47991 - RNA, 18 nt, Artificial Sequence
  Description of Artificial Sequence: Synthetic oligonucleotide
cucugaacccacaaagcg

SEQ ID NO: 47992 - RNA, 18 nt, Artificial Sequence
  Description of Artificial Sequence: Synthetic oligonucleotide
ccagccucugaacccaca

SEQ ID NO: 47993 - RNA, 18 nt, Artificial Sequence
  Description of Artificial Sequence: Synthetic oligonucleotide
ugcagccagccucugaac

SEQ ID NO: 47994 - RNA, 18 nt, Artificial Sequence
  Description of Artificial Sequence: Synthetic oligonucleotide
aacacugcagccagccuc

SEQ ID NO: 47995 - RNA, 18 nt, Artificial Sequence
  Description of Artificial Sequence: Synthetic oligonucleotide
ucauaaacacugcagcca

SEQ ID NO: 47996 - RNA, 18 nt, Artificial Sequence
  Description of Artificial Sequence: Synthetic oligonucleotide
ccucuucauaaacacugc

SEQ ID NO: 47997 - RNA, 18 nt, Artificial Sequence
  Description of Artificial Sequence: Synthetic oligonucleotide
cugccccucuucauaaac

SEQ ID NO: 47998 - RNA, 18 nt, Artificial Sequence
  Description of Artificial Sequence: Synthetic oligonucleotide
gcccacugccccucuuca

SEQ ID NO: 47999 - RNA, 18 nt, Artificial Sequence
  Description of Artificial Sequence: Synthetic oligonucleotide
ccccagcccacugccccu

SEQ ID NO: 48000 - RNA, 18 nt, Artificial Sequence
  Description of Artificial Sequence: Synthetic oligonucleotide
aguguccccagcccacug

SEQ ID NO: 48001 - RNA, 18 nt, Artificial Sequence
  Description of Artificial Sequence: Synthetic oligonucleotide
ccagcaguguccccagcc

SEQ ID NO: 48002 - RNA, 18 nt, Artificial Sequence
  Description of Artificial Sequence: Synthetic oligonucleotide
uaaccccagcaguguccc

SEQ ID NO: 48003 - RNA, 18 nt, Artificial Sequence
  Description of Artificial Sequence: Synthetic oligonucleotide
agccauaaccccagcagu

SEQ ID NO: 48004 - RNA, 18 nt, Artificial Sequence
  Description of Artificial Sequence: Synthetic oligonucleotide
acuacagccauaacccca

SEQ ID NO: 48005 - RNA, 18 nt, Artificial Sequence
  Description of Artificial Sequence: Synthetic oligonucleotide
accucacuacagccauaa

SEQ ID NO: 48006 - RNA, 18 nt, Artificial Sequence
  Description of Artificial Sequence: Synthetic oligonucleotide
cauggaccucacuacagc

SEQ ID NO: 48007 - RNA, 18 nt, Artificial Sequence
  Description of Artificial Sequence: Synthetic oligonucleotide
guacacauggaccucacu

SEQ ID NO: 48008 - RNA, 18 nt, Artificial Sequence
  Description of Artificial Sequence: Synthetic oligonucleotide
aacaaguacacauggacc

SEQ ID NO: 48009 - RNA, 18 nt, Artificial Sequence
  Description of Artificial Sequence: Synthetic oligonucleotide
caaggaacaaguacacau

SEQ ID NO: 48010 - RNA, 18 nt, Artificial Sequence
  Description of Artificial Sequence: Synthetic oligonucleotide
caugccaaggaacaagua

SEQ ID NO: 48011 - RNA, 18 nt, Artificial Sequence
  Description of Artificial Sequence: Synthetic oligonucleotide
agacacaugccaaggaac

SEQ ID NO: 48012 - RNA, 18 nt, Artificial Sequence
  Description of Artificial Sequence: Synthetic oligonucleotide
gagucagacacaugccaa

SEQ ID NO: 48013 - RNA, 18 nt, Artificial Sequence
  Description of Artificial Sequence: Synthetic oligonucleotide
acacagagucagacacau

SEQ ID NO: 48014 - RNA, 18 nt, Artificial Sequence
  Description of Artificial Sequence: Synthetic oligonucleotide
cagcaacacagagucaga

SEQ ID NO: 48015 - RNA, 18 nt, Artificial Sequence
  Description of Artificial Sequence: Synthetic oligonucleotide
ugcagcagcaacacagag

SEQ ID NO: 48016 - RNA, 18 nt, Artificial Sequence
  Description of Artificial Sequence: Synthetic oligonucleotide
uguacugcagcagcaaca

SEQ ID NO: 48017 - RNA, 18 nt, Artificial Sequence
  Description of Artificial Sequence: Synthetic oligonucleotide
cccacuguacugcagcag

SEQ ID NO: 48018 - RNA, 18 nt, Artificial Sequence
  Description of Artificial Sequence: Synthetic oligonucleotide
cccugcccacuguacugc

SEQ ID NO: 48019 - RNA, 18 nt, Artificial Sequence
  Description of Artificial Sequence: Synthetic oligonucleotide
cgugccccugcccacugu

SEQ ID NO: 48020 - RNA, 18 nt, Artificial Sequence
  Description of Artificial Sequence: Synthetic oligonucleotide
gcaaccgugccccugccc

SEQ ID NO: 48021 - RNA, 18 nt, Artificial Sequence
  Description of Artificial Sequence: Synthetic oligonucleotide
uccaagcaaccgugcccc

SEQ ID NO: 48022 - RNA, 18 nt, Artificial Sequence
  Description of Artificial Sequence: Synthetic oligonucleotide
cccaguccaagcaaccgu

SEQ ID NO: 48023 - RNA, 18 nt, Artificial Sequence
  Description of Artificial Sequence: Synthetic oligonucleotide
ggcagcccaguccaagca

SEQ ID NO: 48024 - RNA, 18 nt, Artificial Sequence
  Description of Artificial Sequence: Synthetic oligonucleotide
caucgggcagcccagucc

SEQ ID NO: 48025 - RNA, 18 nt, Artificial Sequence
  Description of Artificial Sequence: Synthetic oligonucleotide
ccagacaucgggcagccc

SEQ ID NO: 48026 - RNA, 18 nt, Artificial Sequence
  Description of Artificial Sequence: Synthetic oligonucleotide
ccaugccagacaucgggc

SEQ ID NO: 48027 - RNA, 18 nt, Artificial Sequence
  Description of Artificial Sequence: Synthetic oligonucleotide
accagccaugccagacau

SEQ ID NO: 48028 - RNA, 18 nt, Artificial Sequence
  Description of Artificial Sequence: Synthetic oligonucleotide
ggaccaccagccaugcca

SEQ ID NO: 48029 - RNA, 18 nt, Artificial Sequence
  Description of Artificial Sequence: Synthetic oligonucleotide
caacaggaccaccagcca

SEQ ID NO: 48030 - RNA, 18 nt, Artificial Sequence
  Description of Artificial Sequence: Synthetic oligonucleotide
aaggacaacaggaccacc

SEQ ID NO: 48031 - RNA, 18 nt, Artificial Sequence
  Description of Artificial Sequence: Synthetic oligonucleotide
aaauaaaggacaacagga

SEQ ID NO: 48032 - RNA, 18 nt, Artificial Sequence
  Description of Artificial Sequence: Synthetic oligonucleotide
cgaucaaauaaaggacaa

SEQ ID NO: 48033 - RNA, 18 nt, Artificial Sequence
  Description of Artificial Sequence: Synthetic oligonucleotide
gcuaucgaucaaauaaag

SEQ ID NO: 48034 - RNA, 18 nt, Artificial Sequence
  Description of Artificial Sequence: Synthetic oligonucleotide
ucccugcuaucgaucaaa

SEQ ID NO: 48035 - RNA, 18 nt, Artificial Sequence
  Description of Artificial Sequence: Synthetic oligonucleotide
ucaguucccugcuaucga

SEQ ID NO: 48036 - RNA, 18 nt, Artificial Sequence
  Description of Artificial Sequence: Synthetic oligonucleotide
ggcggucaguucccugcu

SEQ ID NO: 48037 - RNA, 18 nt, Artificial Sequence
  Description of Artificial Sequence: Synthetic oligonucleotide
accucggcggucaguucc

SEQ ID NO: 48038 - RNA, 18 nt, Artificial Sequence
  Description of Artificial Sequence: Synthetic oligonucleotide
ugccaaccucggcgguca

SEQ ID NO: 48039 - RNA, 18 nt, Artificial Sequence
  Description of Artificial Sequence: Synthetic oligonucleotide
accugugccaaccucggc

SEQ ID NO: 48040 - RNA, 18 nt, Artificial Sequence
  Description of Artificial Sequence: Synthetic oligonucleotide
ugccaaccugugccaacc

SEQ ID NO: 48041 - RNA, 18 nt, Artificial Sequence
  Description of Artificial Sequence: Synthetic oligonucleotide
cccccugccaaccugugc

SEQ ID NO: 48042 - RNA, 18 nt, Artificial Sequence
  Description of Artificial Sequence: Synthetic oligonucleotide
cucaucccccugccaacc

SEQ ID NO: 48043 - RNA, 18 nt, Artificial Sequence
  Description of Artificial Sequence: Synthetic oligonucleotide
gcauccucaucccccugc

SEQ ID NO: 48044 - RNA, 18 nt, Artificial Sequence
  Description of Artificial Sequence: Synthetic oligonucleotide
acaaugcauccucauccc

SEQ ID NO: 48045 - RNA, 18 nt, Artificial Sequence
  Description of Artificial Sequence: Synthetic oligonucleotide
caaccacaaugcauccuc

SEQ ID NO: 48046 - RNA, 18 nt, Artificial Sequence
  Description of Artificial Sequence: Synthetic oligonucleotide
ggagacaaccacaaugca

SEQ ID NO: 48047 - RNA, 18 nt, Artificial Sequence
  Description of Artificial Sequence: Synthetic oligonucleotide
gaggaggagacaaccaca

SEQ ID NO: 48048 - RNA, 18 nt, Artificial Sequence
  Description of Artificial Sequence: Synthetic oligonucleotide
gagaggaggaggagacaa

SEQ ID NO: 48049 - RNA, 18 nt, Artificial Sequence
  Description of Artificial Sequence: Synthetic oligonucleotide
agaaggagaggaggagga

SEQ ID NO: 48050 - RNA, 18 nt, Artificial Sequence
  Description of Artificial Sequence: Synthetic oligonucleotide
gaggaagaaggagaggag

SEQ ID NO: 48051 - RNA, 18 nt, Artificial Sequence
  Description of Artificial Sequence: Synthetic oligonucleotide
gggaagaggaagaaggag

SEQ ID NO: 48052 - RNA, 18 nt, Artificial Sequence
  Description of Artificial Sequence: Synthetic oligonucleotide
aaaggagaggaggaaggg

SEQ ID NO: 48053 - RNA, 18 nt, Artificial Sequence
  Description of Artificial Sequence: Synthetic oligonucleotide
agaaaggagaggaggaag

SEQ ID NO: 48054 - RNA, 18 nt, Artificial Sequence
  Description of Artificial Sequence: Synthetic oligonucleotide
agaacagaaaggagagga

SEQ ID NO: 48055 - RNA, 18 nt, Artificial Sequence
  Description of Artificial Sequence: Synthetic oligonucleotide
gaacaagaacagaaagga

SEQ ID NO: 48056 - RNA, 18 nt, Artificial Sequence
  Description of Artificial Sequence: Synthetic oligonucleotide
agggagaacaagaacaga

SEQ ID NO: 48057 - RNA, 18 nt, Artificial Sequence
  Description of Artificial Sequence: Synthetic oligonucleotide
agaugagggagaacaaga

SEQ ID NO: 48058 - RNA, 18 nt, Artificial Sequence
  Description of Artificial Sequence: Synthetic oligonucleotide
gaggaagaugagggagaa

SEQ ID NO: 48059 - RNA, 18 nt, Artificial Sequence
  Description of Artificial Sequence: Synthetic oligonucleotide
aggaagaggaagaugagg

SEQ ID NO: 48060 - RNA, 18 nt, Artificial Sequence
  Description of Artificial Sequence: Synthetic oligonucleotide
gaagaaggaagaggaaga

SEQ ID NO: 48061 - RNA, 18 nt, Artificial Sequence
  Description of Artificial Sequence: Synthetic oligonucleotide
agggagaagaaggaagag

SEQ ID NO: 48062 - RNA, 18 nt, Artificial Sequence
  Description of Artificial Sequence: Synthetic oligonucleotide
agaagagggagaagaagg

SEQ ID NO: 48063 - RNA, 18 nt, Artificial Sequence
  Description of Artificial Sequence: Synthetic oligonucleotide
gaggaagaagagggagaa

SEQ ID NO: 48064 - RNA, 18 nt, Artificial Sequence
  Description of Artificial Sequence: Synthetic oligonucleotide
gugaagaggaagaagagg

SEQ ID NO: 48065 - RNA, 18 nt, Artificial Sequence
  Description of Artificial Sequence: Synthetic oligonucleotide
gcagagugaagaggaaga

SEQ ID NO: 48066 - RNA, 18 nt, Artificial Sequence
  Description of Artificial Sequence: Synthetic oligonucleotide
agagagcagagugaagag

SEQ ID NO: 48067 - RNA, 18 nt, Artificial Sequence
  Description of Artificial Sequence: Synthetic oligonucleotide
agagaagagagcagagug

SEQ ID NO: 48068 - RNA, 18 nt, Artificial Sequence
  Description of Artificial Sequence: Synthetic oligonucleotide
aaagaagagaagagagca

SEQ ID NO: 48069 - RNA, 18 nt, Artificial Sequence
  Description of Artificial Sequence: Synthetic oligonucleotide
ugauucacuccgcuguga

SEQ ID NO: 48070 - RNA, 18 nt, Artificial Sequence
  Description of Artificial Sequence: Synthetic oligonucleotide
cgagcugauucacuccgc

SEQ ID NO: 48071 - RNA, 18 nt, Artificial Sequence
  Description of Artificial Sequence: Synthetic oligonucleotide
accaccgagcugauucac

SEQ ID NO: 48072 - RNA, 18 nt, Artificial Sequence
  Description of Artificial Sequence: Synthetic oligonucleotide
aagacaccaccgagcuga

SEQ ID NO: 48073 - RNA, 18 nt, Artificial Sequence
  Description of Artificial Sequence: Synthetic oligonucleotide
ugacaaagacaccaccga

SEQ ID NO: 48074 - RNA, 18 nt, Artificial Sequence
  Description of Artificial Sequence: Synthetic oligonucleotide
cccguugacaaagacacc

SEQ ID NO: 48075 - RNA, 18 nt, Artificial Sequence
  Description of Artificial Sequence: Synthetic oligonucleotide
ggccgcccguugacaaag

SEQ ID NO: 48076 - RNA, 18 nt, Artificial Sequence
  Description of Artificial Sequence: Synthetic oligonucleotide
gcaguggccgcccguuga

SEQ ID NO: 48077 - RNA, 18 nt, Artificial Sequence
  Description of Artificial Sequence: Synthetic oligonucleotide
guccggcaguggccgccc

SEQ ID NO: 48078 - RNA, 18 nt, Artificial Sequence
  Description of Artificial Sequence: Synthetic oligonucleotide
guggaguccggcaguggc

SEQ ID NO: 48079 - RNA, 18 nt, Artificial Sequence
  Description of Artificial Sequence: Synthetic oligonucleotide
gccggguggaguccggca

SEQ ID NO: 48080 - RNA, 18 nt, Artificial Sequence
  Description of Artificial Sequence: Synthetic oligonucleotide
cuucugccggguggaguc

SEQ ID NO: 48081 - RNA, 18 nt, Artificial Sequence
  Description of Artificial Sequence: Synthetic oligonucleotide
acaaucuucugccgggug

SEQ ID NO: 48082 - RNA, 18 nt, Artificial Sequence
  Description of Artificial Sequence: Synthetic oligonucleotide
gcucuacaaucuucugcc

SEQ ID NO: 48083 - RNA, 18 nt, Artificial Sequence
  Description of Artificial Sequence: Synthetic oligonucleotide
agcuagcucuacaaucuu

SEQ ID NO: 48084 - RNA, 18 nt, Artificial Sequence
  Description of Artificial Sequence: Synthetic oligonucleotide
cugugagcuagcucuaca

SEQ ID NO: 48085 - RNA, 18 nt, Artificial Sequence
  Description of Artificial Sequence: Synthetic oligonucleotide
ccccgcugugagcuagcu

SEQ ID NO: 48086 - RNA, 18 nt, Artificial Sequence
  Description of Artificial Sequence: Synthetic oligonucleotide
ccgggccccgcugugagc

SEQ ID NO: 48087 - RNA, 18 nt, Artificial Sequence
  Description of Artificial Sequence: Synthetic oligonucleotide
cacggccgggccccgcug

SEQ ID NO: 48088 - RNA, 18 nt, Artificial Sequence
  Description of Artificial Sequence: Synthetic oligonucleotide
ugucgcacggccgggccc

SEQ ID NO: 48089 - RNA, 18 nt, Artificial Sequence
  Description of Artificial Sequence: Synthetic oligonucleotide
ggaaaugucgcacggccg

SEQ ID NO: 48090 - RNA, 18 nt, Artificial Sequence
  Description of Artificial Sequence: Synthetic oligonucleotide
auucgggaaaugucgcac

SEQ ID NO: 48091 - RNA, 18 nt, Artificial Sequence
  Description of Artificial Sequence: Synthetic oligonucleotide
gcagaauucgggaaaugu

SEQ ID NO: 48092 - RNA, 18 nt, Artificial Sequence
  Description of Artificial Sequence: Synthetic oligonucleotide
cuuuugcaucugcauggg

SEQ ID NO: 48093 - RNA, 18 nt, Artificial Sequence
  Description of Artificial Sequence: Synthetic oligonucleotide
uuggacuuuugcaucugc

SEQ ID NO: 48094 - RNA, 18 nt, Artificial Sequence
  Description of Artificial Sequence: Synthetic oligonucleotide
agcacuuggacuuuugca

SEQ ID NO: 48095 - RNA, 18 nt, Artificial Sequence
  Description of Artificial Sequence: Synthetic oligonucleotide
uguccagcacuuggacuu

SEQ ID NO: 48096 - RNA, 18 nt, Artificial Sequence
  Description of Artificial Sequence: Synthetic oligonucleotide
uugauuguccagcacuug

SEQ ID NO: 48097 - RNA, 18 nt, Artificial Sequence
  Description of Artificial Sequence: Synthetic oligonucleotide
gcauuaaacaaugacaag

SEQ ID NO: 48098 - RNA, 18 nt, Artificial Sequence
  Description of Artificial Sequence: Synthetic oligonucleotide
aguaugcauuaaacaaug

SEQ ID NO: 48099 - RNA, 18 nt, Artificial Sequence
  Description of Artificial Sequence: Synthetic oligonucleotide
guuuaaguaugcauuaaa

SEQ ID NO: 48100 - RNA, 18 nt, Artificial Sequence
  Description of Artificial Sequence: Synthetic oligonucleotide
aaauuguuuaaguaugca

SEQ ID NO: 48101 - RNA, 18 nt, Artificial Sequence
  Description of Artificial Sequence: Synthetic oligonucleotide
aaauaaaauuguuuaagu

SEQ ID NO: 48102 - RNA, 18 nt, Artificial Sequence
  Description of Artificial Sequence: Synthetic oligonucleotide
gacaaaaauaaaauuguu

SEQ ID NO: 48103 - RNA, 18 nt, Artificial Sequence
  Description of Artificial Sequence: Synthetic oligonucleotide
uucaagacaaaaauaaaa

SEQ ID NO: 48104 - RNA, 18 nt, Artificial Sequence
  Description of Artificial Sequence: Synthetic oligonucleotide
auaauuucaagacaaaaa

SEQ ID NO: 48105 - RNA, 18 nt, Artificial Sequence
  Description of Artificial Sequence: Synthetic oligonucleotide
uauuaauaauuucaagac

SEQ ID NO: 48106 - RNA, 18 nt, Artificial Sequence
  Description of Artificial Sequence: Synthetic oligonucleotide
cacauuauuaauaauuuc

SEQ ID NO: 48107 - RNA, 18 nt, Artificial Sequence
  Description of Artificial Sequence: Synthetic oligonucleotide
aaaaccacauuauuaaua

SEQ ID NO: 48108 - RNA, 18 nt, Artificial Sequence
  Description of Artificial Sequence: Synthetic oligonucleotide
gacagaaaaccacauuau

SEQ ID NO: 48109 - RNA, 18 nt, Artificial Sequence
  Description of Artificial Sequence: Synthetic oligonucleotide
uguuuaaguaugcauuaa

SEQ ID NO: 48110 - RNA, 18 nt, Artificial Sequence
  Description of Artificial Sequence: Synthetic oligonucleotide
aaaauuguuuaaguaugc

SEQ ID NO: 48111 - RNA, 18 nt, Artificial Sequence
  Description of Artificial Sequence: Synthetic oligonucleotide
aaaauaaaauuguuuaag

SEQ ID NO: 48112 - RNA, 18 nt, Artificial Sequence
  Description of Artificial Sequence: Synthetic oligonucleotide
agacaaaaauaaaauugu

SEQ ID NO: 48113 - RNA, 18 nt, Artificial Sequence
  Description of Artificial Sequence: Synthetic oligonucleotide
uuucaagacaaaaauaaa

SEQ ID NO: 48114 - RNA, 18 nt, Artificial Sequence
  Description of Artificial Sequence: Synthetic oligonucleotide
aauaauuucaagacaaaa

SEQ ID NO: 48115 - RNA, 18 nt, Artificial Sequence
  Description of Artificial Sequence: Synthetic oligonucleotide
uuauuaauaauuucaaga

SEQ ID NO: 48116 - RNA, 18 nt, Artificial Sequence
  Description of Artificial Sequence: Synthetic oligonucleotide
ccacauuauuaauaauuu

SEQ ID NO: 48117 - RNA, 18 nt, Artificial Sequence
  Description of Artificial Sequence: Synthetic oligonucleotide
gaaaaccacauuauuaau

SEQ ID NO: 48118 - RNA, 18 nt, Artificial Sequence
  Description of Artificial Sequence: Synthetic oligonucleotide
ggacagaaaaccacauua

SEQ ID NO: 48119 - RNA, 18 nt, Artificial Sequence
  Description of Artificial Sequence: Synthetic oligonucleotide
ucacacauccguuggaca

SEQ ID NO: 48120 - RNA, 18 nt, Artificial Sequence
  Description of Artificial Sequence: Synthetic oligonucleotide
uuuacucacacauccguu

SEQ ID NO: 48121 - RNA, 18 nt, Artificial Sequence
  Description of Artificial Sequence: Synthetic oligonucleotide
agaauuuuacucacacau

SEQ ID NO: 48122 - RNA, 18 nt, Artificial Sequence
  Description of Artificial Sequence: Synthetic oligonucleotide
ugcccagaauuuuacuca

SEQ ID NO: 48123 - RNA, 18 nt, Artificial Sequence
  Description of Artificial Sequence: Synthetic oligonucleotide
auaccugcccagaauuuu

SEQ ID NO: 48124 - RNA, 18 nt, Artificial Sequence
  Description of Artificial Sequence: Synthetic oligonucleotide
ucguaauaccugcccaga

SEQ ID NO: 48125 - RNA, 18 nt, Artificial Sequence
  Description of Artificial Sequence: Synthetic oligonucleotide
cagucucguaauaccugc

SEQ ID NO: 48126 - RNA, 18 nt, Artificial Sequence
  Description of Artificial Sequence: Synthetic oligonucleotide
ggagccagucucguaaua

SEQ ID NO: 48127 - RNA, 18 nt, Artificial Sequence
  Description of Artificial Sequence: Synthetic oligonucleotide
cugauggagccagucucg

SEQ ID NO: 48128 - RNA, 18 nt, Artificial Sequence
  Description of Artificial Sequence: Synthetic oligonucleotide
ugggucugauggagccag

SEQ ID NO: 48129 - RNA, 18 nt, Artificial Sequence
  Description of Artificial Sequence: Synthetic oligonucleotide
ugcccugggucugaugga

SEQ ID NO: 48130 - RNA, 18 nt, Artificial Sequence
  Description of Artificial Sequence: Synthetic oligonucleotide
ccgauugcccugggucug

SEQ ID NO: 48131 - RNA, 18 nt, Artificial Sequence
  Description of Artificial Sequence: Synthetic oligonucleotide
uaccaccgauugcccugg

SEQ ID NO: 48132 - RNA, 18 nt, Artificial Sequence
  Description of Artificial Sequence: Synthetic oligonucleotide
uuuacuaccaccgauugc

SEQ ID NO: 48133 - RNA, 18 nt, Artificial Sequence
  Description of Artificial Sequence: Synthetic oligonucleotide
cucgguuuacuaccaccg

SEQ ID NO: 48134 - RNA, 18 nt, Artificial Sequence
  Description of Artificial Sequence: Synthetic oligonucleotide
cuacucucgguuuacuac

SEQ ID NO: 48135 - RNA, 18 nt, Artificial Sequence
  Description of Artificial Sequence: Synthetic oligonucleotide
agucgcuacucucgguuu

SEQ ID NO: 48136 - RNA, 18 nt, Artificial Sequence
  Description of Artificial Sequence: Synthetic oligonucleotide
ucuggagucgcuacucuc

SEQ ID NO: 48137 - RNA, 18 nt, Artificial Sequence
  Description of Artificial Sequence: Synthetic oligonucleotide
caacuucuggagucgcua

SEQ ID NO: 48138 - RNA, 18 nt, Artificial Sequence
  Description of Artificial Sequence: Synthetic oligonucleotide
gcuuacaacuucuggagu

SEQ ID NO: 48139 - RNA, 18 nt, Artificial Sequence
  Description of Artificial Sequence: Synthetic oligonucleotide
auuuugcuuacaacuucu

SEQ ID NO: 48140 - RNA, 18 nt, Artificial Sequence
  Description of Artificial Sequence: Synthetic oligonucleotide
gggcuauuuugcuuacaa

SEQ ID NO: 48141 - RNA, 18 nt, Artificial Sequence
  Description of Artificial Sequence: Synthetic oligonucleotide
auacugggcuauuuugcu

SEQ ID NO: 48142 - RNA, 18 nt, Artificial Sequence
  Description of Artificial Sequence: Synthetic oligonucleotide
cgcuuauacugggcuauu

SEQ ID NO: 48143 - RNA, 18 nt, Artificial Sequence
  Description of Artificial Sequence: Synthetic oligonucleotide
acucccgcuuauacuggg

SEQ ID NO: 48144 - RNA, 18 nt, Artificial Sequence
  Description of Artificial Sequence: Synthetic oligonucleotide
cgggcacucccgcuuaua

SEQ ID NO: 48145 - RNA, 18 nt, Artificial Sequence
  Description of Artificial Sequence: Synthetic oligonucleotide
auggacgggcacucccgc

SEQ ID NO: 48146 - RNA, 18 nt, Artificial Sequence
  Description of Artificial Sequence: Synthetic oligonucleotide
caaagauggacgggcacu

SEQ ID NO: 48147 - RNA, 18 nt, Artificial Sequence
  Description of Artificial Sequence: Synthetic oligonucleotide
ccaagcaaagauggacgg

SEQ ID NO: 48148 - RNA, 18 nt, Artificial Sequence
  Description of Artificial Sequence: Synthetic oligonucleotide
auuucccaagcaaagaug

SEQ ID NO: 48149 - RNA, 18 nt, Artificial Sequence
  Description of Artificial Sequence: Synthetic oligonucleotide
cucggauuucccaagcaa

SEQ ID NO: 48150 - RNA, 18 nt, Artificial Sequence
  Description of Artificial Sequence: Synthetic oligonucleotide
ucugucucggauuuccca

SEQ ID NO: 48151 - RNA, 18 nt, Artificial Sequence
  Description of Artificial Sequence: Synthetic oligonucleotide
aguaaucugucucggauu

SEQ ID NO: 48152 - RNA, 18 nt, Artificial Sequence
  Description of Artificial Sequence: Synthetic oligonucleotide
cggacaguaaucugucuc

SEQ ID NO: 48153 - RNA, 18 nt, Artificial Sequence
  Description of Artificial Sequence: Synthetic oligonucleotide
ccccucggacaguaaucu

SEQ ID NO: 48154 - RNA, 18 nt, Artificial Sequence
  Description of Artificial Sequence: Synthetic oligonucleotide
cagacccccucggacagu

SEQ ID NO: 48155 - RNA, 18 nt, Artificial Sequence
  Description of Artificial Sequence: Synthetic oligonucleotide
ugguacagacccccucgg

SEQ ID NO: 48156 - RNA, 18 nt, Artificial Sequence
  Description of Artificial Sequence: Synthetic oligonucleotide
aucguugguacagacccc

SEQ ID NO: 48157 - RNA, 18 nt, Artificial Sequence
  Description of Artificial Sequence: Synthetic oligonucleotide
auguuaucguugguacag

SEQ ID NO: 48158 - RNA, 18 nt, Artificial Sequence
  Description of Artificial Sequence: Synthetic oligonucleotide
uugguauguuaucguugg

SEQ ID NO: 48159 - RNA, 18 nt, Artificial Sequence
  Description of Artificial Sequence: Synthetic oligonucleotide
cacacauccguuggacac

SEQ ID NO: 48160 - RNA, 18 nt, Artificial Sequence
  Description of Artificial Sequence: Synthetic oligonucleotide
uuacucacacauccguug

SEQ ID NO: 48161 - RNA, 18 nt, Artificial Sequence
  Description of Artificial Sequence: Synthetic oligonucleotide
gaauuuuacucacacauc

SEQ ID NO: 48162 - RNA, 18 nt, Artificial Sequence
  Description of Artificial Sequence: Synthetic oligonucleotide
gcccagaauuuuacucac

SEQ ID NO: 48163 - RNA, 18 nt, Artificial Sequence
  Description of Artificial Sequence: Synthetic oligonucleotide
uaccugcccagaauuuua

SEQ ID NO: 48164 - RNA, 18 nt, Artificial Sequence
  Description of Artificial Sequence: Synthetic oligonucleotide
cguaauaccugcccagaa

SEQ ID NO: 48165 - RNA, 18 nt, Artificial Sequence
  Description of Artificial Sequence: Synthetic oligonucleotide
agucucguaauaccugcc

SEQ ID NO: 48166 - RNA, 18 nt, Artificial Sequence
  Description of Artificial Sequence: Synthetic oligonucleotide
gagccagucucguaauac

SEQ ID NO: 48167 - RNA, 18 nt, Artificial Sequence
  Description of Artificial Sequence: Synthetic oligonucleotide
ugauggagccagucucgu

SEQ ID NO: 48168 - RNA, 18 nt, Artificial Sequence
  Description of Artificial Sequence: Synthetic oligonucleotide
gggucugauggagccagu

SEQ ID NO: 48169 - RNA, 18 nt, Artificial Sequence
  Description of Artificial Sequence: Synthetic oligonucleotide
gcccugggucugauggag

SEQ ID NO: 48170 - RNA, 18 nt, Artificial Sequence
  Description of Artificial Sequence: Synthetic oligonucleotide
cgauugcccugggucuga

SEQ ID NO: 48171 - RNA, 18 nt, Artificial Sequence
  Description of Artificial Sequence: Synthetic oligonucleotide
accaccgauugcccuggg

SEQ ID NO: 48172 - RNA, 18 nt, Artificial Sequence
  Description of Artificial Sequence: Synthetic oligonucleotide
uuacuaccaccgauugcc

SEQ ID NO: 48173 - RNA, 18 nt, Artificial Sequence
  Description of Artificial Sequence: Synthetic oligonucleotide
ucgguuuacuaccaccga

SEQ ID NO: 48174 - RNA, 18 nt, Artificial Sequence
  Description of Artificial Sequence: Synthetic oligonucleotide
uacucucgguuuacuacc

SEQ ID NO: 48175 - RNA, 18 nt, Artificial Sequence
  Description of Artificial Sequence: Synthetic oligonucleotide
gucgcuacucucgguuua

SEQ ID NO: 48176 - RNA, 18 nt, Artificial Sequence
  Description of Artificial Sequence: Synthetic oligonucleotide
cuggagucgcuacucucg

SEQ ID NO: 48177 - RNA, 18 nt, Artificial Sequence
  Description of Artificial Sequence: Synthetic oligonucleotide
aacuucuggagucgcuac

SEQ ID NO: 48178 - RNA, 18 nt, Artificial Sequence
  Description of Artificial Sequence: Synthetic oligonucleotide
cuuacaacuucuggaguc

SEQ ID NO: 48179 - RNA, 18 nt, Artificial Sequence
  Description of Artificial Sequence: Synthetic oligonucleotide
uuuugcuuacaacuucug

SEQ ID NO: 48180 - RNA, 18 nt, Artificial Sequence
  Description of Artificial Sequence: Synthetic oligonucleotide
ggcuauuuugcuuacaac

SEQ ID NO: 48181 - RNA, 18 nt, Artificial Sequence
  Description of Artificial Sequence: Synthetic oligonucleotide
uacugggcuauuuugcuu

SEQ ID NO: 48182 - RNA, 18 nt, Artificial Sequence
  Description of Artificial Sequence: Synthetic oligonucleotide
gcuuauacugggcuauuu

SEQ ID NO: 48183 - RNA, 18 nt, Artificial Sequence
  Description of Artificial Sequence: Synthetic oligonucleotide
cucccgcuuauacugggc

SEQ ID NO: 48184 - RNA, 18 nt, Artificial Sequence
  Description of Artificial Sequence: Synthetic oligonucleotide
gggcacucccgcuuauac

SEQ ID NO: 48185 - RNA, 18 nt, Artificial Sequence
  Description of Artificial Sequence: Synthetic oligonucleotide
uggacgggcacucccgcu

SEQ ID NO: 48186 - RNA, 18 nt, Artificial Sequence
  Description of Artificial Sequence: Synthetic oligonucleotide
aaagauggacgggcacuc

SEQ ID NO: 48187 - RNA, 18 nt, Artificial Sequence
  Description of Artificial Sequence: Synthetic oligonucleotide
caagcaaagauggacggg

SEQ ID NO: 48188 - RNA, 18 nt, Artificial Sequence
  Description of Artificial Sequence: Synthetic oligonucleotide
uuucccaagcaaagaugg

SEQ ID NO: 48189 - RNA, 18 nt, Artificial Sequence
  Description of Artificial Sequence: Synthetic oligonucleotide
ucggauuucccaagcaaa

SEQ ID NO: 48190 - RNA, 18 nt, Artificial Sequence
  Description of Artificial Sequence: Synthetic oligonucleotide
cugucucggauuucccaa

SEQ ID NO: 48191 - RNA, 18 nt, Artificial Sequence
  Description of Artificial Sequence: Synthetic oligonucleotide
guaaucugucucggauuu

SEQ ID NO: 48192 - RNA, 18 nt, Artificial Sequence
  Description of Artificial Sequence: Synthetic oligonucleotide
ggacaguaaucugucucg

SEQ ID NO: 48193 - RNA, 18 nt, Artificial Sequence
  Description of Artificial Sequence: Synthetic oligonucleotide
cccucggacaguaaucug

SEQ ID NO: 48194 - RNA, 18 nt, Artificial Sequence
  Description of Artificial Sequence: Synthetic oligonucleotide
agacccccucggacagua

SEQ ID NO: 48195 - RNA, 18 nt, Artificial Sequence
  Description of Artificial Sequence: Synthetic oligonucleotide
gguacagacccccucgga

SEQ ID NO: 48196 - RNA, 18 nt, Artificial Sequence
  Description of Artificial Sequence: Synthetic oligonucleotide
ucguugguacagaccccc

SEQ ID NO: 48197 - RNA, 18 nt, Artificial Sequence
  Description of Artificial Sequence: Synthetic oligonucleotide
uguuaucguugguacaga

SEQ ID NO: 48198 - RNA, 18 nt, Artificial Sequence
  Description of Artificial Sequence: Synthetic oligonucleotide
ugguauguuaucguuggu

SEQ ID NO: 48199 - RNA, 18 nt, Artificial Sequence
  Description of Artificial Sequence: Synthetic oligonucleotide
gcagauguucucaaugaa

SEQ ID NO: 48200 - RNA, 18 nt, Artificial Sequence
  Description of Artificial Sequence: Synthetic oligonucleotide
ggagggcagauguucuca

SEQ ID NO: 48201 - RNA, 18 nt, Artificial Sequence
  Description of Artificial Sequence: Synthetic oligonucleotide
ggcagggagggcagaugu

SEQ ID NO: 48202 - RNA, 18 nt, Artificial Sequence
  Description of Artificial Sequence: Synthetic oligonucleotide
cuuagggcagggagggca

SEQ ID NO: 48203 - RNA, 18 nt, Artificial Sequence
  Description of Artificial Sequence: Synthetic oligonucleotide
uugggcuuagggcaggga

SEQ ID NO: 48204 - RNA, 18 nt, Artificial Sequence
  Description of Artificial Sequence: Synthetic oligonucleotide
gagcauugggcuuagggc

SEQ ID NO: 48205 - RNA, 18 nt, Artificial Sequence
  Description of Artificial Sequence: Synthetic oligonucleotide
ggagagagcauugggcuu

SEQ ID NO: 48206 - RNA, 18 nt, Artificial Sequence
  Description of Artificial Sequence: Synthetic oligonucleotide
aaagaggagagagcauug

SEQ ID NO: 48207 - RNA, 18 nt, Artificial Sequence
  Description of Artificial Sequence: Synthetic oligonucleotide
gagguaaagaggagagag

SEQ ID NO: 48208 - RNA, 18 nt, Artificial Sequence
  Description of Artificial Sequence: Synthetic oligonucleotide
gggaggagguaaagagga

SEQ ID NO: 48209 - RNA, 18 nt, Artificial Sequence
  Description of Artificial Sequence: Synthetic oligonucleotide
agggugggaggagguaaa

SEQ ID NO: 48210 - RNA, 18 nt, Artificial Sequence
  Description of Artificial Sequence: Synthetic oligonucleotide
gagagagggugggaggag

SEQ ID NO: 48211 - RNA, 18 nt, Artificial Sequence
  Description of Artificial Sequence: Synthetic oligonucleotide
guggagagagaggguggg

SEQ ID NO: 48212 - RNA, 18 nt, Artificial Sequence
  Description of Artificial Sequence: Synthetic oligonucleotide
agacaguggagagagagg

SEQ ID NO: 48213 - RNA, 18 nt, Artificial Sequence
  Description of Artificial Sequence: Synthetic oligonucleotide
cuaagagacaguggagag

SEQ ID NO: 48214 - RNA, 18 nt, Artificial Sequence
  Description of Artificial Sequence: Synthetic oligonucleotide
acagacuaagagacagug

SEQ ID NO: 48215 - RNA, 18 nt, Artificial Sequence
  Description of Artificial Sequence: Synthetic oligonucleotide
aggacacagacuaagaga

SEQ ID NO: 48216 - RNA, 18 nt, Artificial Sequence
  Description of Artificial Sequence: Synthetic oligonucleotide
gggagaggacacagacua

SEQ ID NO: 48217 - RNA, 18 nt, Artificial Sequence
  Description of Artificial Sequence: Synthetic oligonucleotide
gagcagggagaggacaca

SEQ ID NO: 48218 - RNA, 18 nt, Artificial Sequence
  Description of Artificial Sequence: Synthetic oligonucleotide
auguggagcagggagagg

SEQ ID NO: 48219 - RNA, 18 nt, Artificial Sequence
  Description of Artificial Sequence: Synthetic oligonucleotide
gacaaauguggagcaggg

SEQ ID NO: 48220 - RNA, 18 nt, Artificial Sequence
  Description of Artificial Sequence: Synthetic oligonucleotide
aaggagacaaauguggag

SEQ ID NO: 48221 - RNA, 18 nt, Artificial Sequence
  Description of Artificial Sequence: Synthetic oligonucleotide
guacaaaggagacaaaug

SEQ ID NO: 48222 - RNA, 18 nt, Artificial Sequence
  Description of Artificial Sequence: Synthetic oligonucleotide
cccagguacaaaggagac

SEQ ID NO: 48223 - RNA, 18 nt, Artificial Sequence
  Description of Artificial Sequence: Synthetic oligonucleotide
guucccccagguacaaag

SEQ ID NO: 48224 - RNA, 18 nt, Artificial Sequence
  Description of Artificial Sequence: Synthetic oligonucleotide
ucucuguucccccaggua

SEQ ID NO: 48225 - RNA, 18 nt, Artificial Sequence
  Description of Artificial Sequence: Synthetic oligonucleotide
auuccucucuguuccccc

SEQ ID NO: 48226 - RNA, 18 nt, Artificial Sequence
  Description of Artificial Sequence: Synthetic oligonucleotide
agggcauuccucucuguu

SEQ ID NO: 48227 - RNA, 18 nt, Artificial Sequence
  Description of Artificial Sequence: Synthetic oligonucleotide
aagucagggcauuccucu

SEQ ID NO: 48228 - RNA, 18 nt, Artificial Sequence
  Description of Artificial Sequence: Synthetic oligonucleotide
aagaaaagucagggcauu

SEQ ID NO: 48229 - RNA, 18 nt, Artificial Sequence
  Description of Artificial Sequence: Synthetic oligonucleotide
agucaaagaaaagucagg

SEQ ID NO: 48230 - RNA, 18 nt, Artificial Sequence
  Description of Artificial Sequence: Synthetic oligonucleotide
cagacagucaaagaaaag

SEQ ID NO: 48231 - RNA, 18 nt, Artificial Sequence
  Description of Artificial Sequence: Synthetic oligonucleotide
uuuuccagacagucaaag

SEQ ID NO: 48232 - RNA, 18 nt, Artificial Sequence
  Description of Artificial Sequence: Synthetic oligonucleotide
ucccauuuuccagacagu

SEQ ID NO: 48233 - RNA, 18 nt, Artificial Sequence
  Description of Artificial Sequence: Synthetic oligonucleotide
uugacucccauuuuccag

SEQ ID NO: 48234 - RNA, 18 nt, Artificial Sequence
  Description of Artificial Sequence: Synthetic oligonucleotide
cacacuugacucccauuu

SEQ ID NO: 48235 - RNA, 18 nt, Artificial Sequence
  Description of Artificial Sequence: Synthetic oligonucleotide
cuccccacacuugacucc

SEQ ID NO: 48236 - RNA, 18 nt, Artificial Sequence
  Description of Artificial Sequence: Synthetic oligonucleotide
aaugacuccccacacuug

SEQ ID NO: 48237 - RNA, 18 nt, Artificial Sequence
  Description of Artificial Sequence: Synthetic oligonucleotide
aagugaaugacuccccac

SEQ ID NO: 48238 - RNA, 18 nt, Artificial Sequence
  Description of Artificial Sequence: Synthetic oligonucleotide
aaaugaagugaaugacuc

SEQ ID NO: 48239 - RNA, 18 nt, Artificial Sequence
  Description of Artificial Sequence: Synthetic oligonucleotide
caugcaaaugaagugaau

SEQ ID NO: 48240 - RNA, 18 nt, Artificial Sequence
  Description of Artificial Sequence: Synthetic oligonucleotide
ugcagcaugcaaaugaag

SEQ ID NO: 48241 - RNA, 18 nt, Artificial Sequence
  Description of Artificial Sequence: Synthetic oligonucleotide
uguuuugcagcaugcaaa

SEQ ID NO: 48242 - RNA, 18 nt, Artificial Sequence
  Description of Artificial Sequence: Synthetic oligonucleotide
cccucuguuuugcagcau

SEQ ID NO: 48243 - RNA, 18 nt, Artificial Sequence
  Description of Artificial Sequence: Synthetic oligonucleotide
cuccgcccucuguuuugc

SEQ ID NO: 48244 - RNA, 18 nt, Artificial Sequence
  Description of Artificial Sequence: Synthetic oligonucleotide
ggugccuccgcccucugu

SEQ ID NO: 48245 - RNA, 18 nt, Artificial Sequence
  Description of Artificial Sequence: Synthetic oligonucleotide
ucccuggugccuccgccc

SEQ ID NO: 48246 - RNA, 18 nt, Artificial Sequence
  Description of Artificial Sequence: Synthetic oligonucleotide
gccuuucccuggugccuc

SEQ ID NO: 48247 - RNA, 18 nt, Artificial Sequence
  Description of Artificial Sequence: Synthetic oligonucleotide
caagugccuuucccuggu

SEQ ID NO: 48248 - RNA, 18 nt, Artificial Sequence
  Description of Artificial Sequence: Synthetic oligonucleotide
ucauucaagugccuuucc

SEQ ID NO: 48249 - RNA, 18 nt, Artificial Sequence
  Description of Artificial Sequence: Synthetic oligonucleotide
cuucuucauucaagugcc

SEQ ID NO: 48250 - RNA, 18 nt, Artificial Sequence
  Description of Artificial Sequence: Synthetic oligonucleotide
uuuuccuucuucauucaa

SEQ ID NO: 48251 - RNA, 18 nt, Artificial Sequence
  Description of Artificial Sequence: Synthetic oligonucleotide
ucucauuuuccuucuuca

SEQ ID NO: 48252 - RNA, 18 nt, Artificial Sequence
  Description of Artificial Sequence: Synthetic oligonucleotide
cugguucucauuuuccuu

SEQ ID NO: 48253 - RNA, 18 nt, Artificial Sequence
  Description of Artificial Sequence: Synthetic oligonucleotide
acaaucugguucucauuu

SEQ ID NO: 48254 - RNA, 18 nt, Artificial Sequence
  Description of Artificial Sequence: Synthetic oligonucleotide
aaguuacaaucugguucu

SEQ ID NO: 48255 - RNA, 18 nt, Artificial Sequence
  Description of Artificial Sequence: Synthetic oligonucleotide
ggacgaaguuacaaucug

SEQ ID NO: 48256 - RNA, 18 nt, Artificial Sequence
  Description of Artificial Sequence: Synthetic oligonucleotide
gauuaggacgaaguuaca

SEQ ID NO: 48257 - RNA, 18 nt, Artificial Sequence
  Description of Artificial Sequence: Synthetic oligonucleotide
agguggauuaggacgaag

SEQ ID NO: 48258 - RNA, 18 nt, Artificial Sequence
  Description of Artificial Sequence: Synthetic oligonucleotide
cuggcagguggauuagga

SEQ ID NO: 48259 - RNA, 18 nt, Artificial Sequence
  Description of Artificial Sequence: Synthetic oligonucleotide
aaguucuggcagguggau

SEQ ID NO: 48260 - RNA, 18 nt, Artificial Sequence
  Description of Artificial Sequence: Synthetic oligonucleotide
aaggaaaguucuggcagg

SEQ ID NO: 48261 - RNA, 18 nt, Artificial Sequence
  Description of Artificial Sequence: Synthetic oligonucleotide
accugaaggaaaguucug

SEQ ID NO: 48262 - RNA, 18 nt, Artificial Sequence
  Description of Artificial Sequence: Synthetic oligonucleotide
gugacaccugaaggaaag

SEQ ID NO: 48263 - RNA, 18 nt, Artificial Sequence
  Description of Artificial Sequence: Synthetic oligonucleotide
gaugugugacaccugaag

SEQ ID NO: 48264 - RNA, 18 nt, Artificial Sequence
  Description of Artificial Sequence: Synthetic oligonucleotide
aaauggaugugugacacc

SEQ ID NO: 48265 - RNA, 18 nt, Artificial Sequence
  Description of Artificial Sequence: Synthetic oligonucleotide
gauggaaauggaugugug

SEQ ID NO: 48266 - RNA, 18 nt, Artificial Sequence
  Description of Artificial Sequence: Synthetic oligonucleotide
auuaggauggaaauggau

SEQ ID NO: 48267 - RNA, 18 nt, Artificial Sequence
  Description of Artificial Sequence: Synthetic oligonucleotide
uuaauauuaggauggaaa

SEQ ID NO: 48268 - RNA, 18 nt, Artificial Sequence
  Description of Artificial Sequence: Synthetic oligonucleotide
auuguuuaauauuaggau

SEQ ID NO: 48269 - RNA, 18 nt, Artificial Sequence
  Description of Artificial Sequence: Synthetic oligonucleotide
auuauauuguuuaauauu

SEQ ID NO: 48270 - RNA, 18 nt, Artificial Sequence
  Description of Artificial Sequence: Synthetic oligonucleotide
cuuucauuauauuguuua

SEQ ID NO: 48271 - RNA, 18 nt, Artificial Sequence
  Description of Artificial Sequence: Synthetic oligonucleotide
gcuuucuuucauuauauu

SEQ ID NO: 48272 - RNA, 18 nt, Artificial Sequence
  Description of Artificial Sequence: Synthetic oligonucleotide
gaugugugacaccugaag

SEQ ID NO: 48273 - RNA, 18 nt, Artificial Sequence
  Description of Artificial Sequence: Synthetic oligonucleotide
aaauggaugugugacacc

SEQ ID NO: 48274 - RNA, 18 nt, Artificial Sequence
  Description of Artificial Sequence: Synthetic oligonucleotide
gauggaaauggaugugug

SEQ ID NO: 48275 - RNA, 18 nt, Artificial Sequence
  Description of Artificial Sequence: Synthetic oligonucleotide
auuaggauggaaauggau

SEQ ID NO: 48276 - RNA, 18 nt, Artificial Sequence
  Description of Artificial Sequence: Synthetic oligonucleotide
uuaauauuaggauggaaa

SEQ ID NO: 48277 - RNA, 18 nt, Artificial Sequence
  Description of Artificial Sequence: Synthetic oligonucleotide
auuguuuaauauuaggau

SEQ ID NO: 48278 - RNA, 18 nt, Artificial Sequence
  Description of Artificial Sequence: Synthetic oligonucleotide
auuauauuguuuaauauu

SEQ ID NO: 48279 - RNA, 18 nt, Artificial Sequence
  Description of Artificial Sequence: Synthetic oligonucleotide
cuuucauuauauuguuua

SEQ ID NO: 48280 - RNA, 18 nt, Artificial Sequence
  Description of Artificial Sequence: Synthetic oligonucleotide
gcuuucuuucauuauauu

SEQ ID NO: 48281 - RNA, 18 nt, Artificial Sequence
  Description of Artificial Sequence: Synthetic oligonucleotide
guaaagcuuucuuucauu

SEQ ID NO: 48282 - RNA, 18 nt, Artificial Sequence
  Description of Artificial Sequence: Synthetic oligonucleotide
uuguuguaaagcuuucuu

SEQ ID NO: 48283 - RNA, 18 nt, Artificial Sequence
  Description of Artificial Sequence: Synthetic oligonucleotide
uagacuuguuguaaagcu

SEQ ID NO: 48284 - RNA, 18 nt, Artificial Sequence
  Description of Artificial Sequence: Synthetic oligonucleotide
cuauuuagacuuguugua

SEQ ID NO: 48285 - RNA, 18 nt, Artificial Sequence
  Description of Artificial Sequence: Synthetic oligonucleotide
aaaaacuauuuagacuug

SEQ ID NO: 48286 - RNA, 18 nt, Artificial Sequence
  Description of Artificial Sequence: Synthetic oligonucleotide
aaaauaaaaacuauuuag

SEQ ID NO: 48287 - RNA, 18 nt, Artificial Sequence
  Description of Artificial Sequence: Synthetic oligonucleotide
gcccgaaaauaaaaacua

SEQ ID NO: 48288 - RNA, 18 nt, Artificial Sequence
  Description of Artificial Sequence: Synthetic oligonucleotide
agacugcccgaaaauaaa

SEQ ID NO: 48289 - RNA, 18 nt, Artificial Sequence
  Description of Artificial Sequence: Synthetic oligonucleotide
uuaaaagacugcccgaaa

SEQ ID NO: 48290 - RNA, 18 nt, Artificial Sequence
  Description of Artificial Sequence: Synthetic oligonucleotide
cuuuguuaaaagacugcc

SEQ ID NO: 48291 - RNA, 18 nt, Artificial Sequence
  Description of Artificial Sequence: Synthetic oligonucleotide
cuuugcuuuguuaaaaga

SEQ ID NO: 48292 - RNA, 18 nt, Artificial Sequence
  Description of Artificial Sequence: Synthetic oligonucleotide
gguugcuuugcuuuguua

SEQ ID NO: 48293 - RNA, 18 nt, Artificial Sequence
  Description of Artificial Sequence: Synthetic oligonucleotide
cacacgguugcuuugcuu

SEQ ID NO: 48294 - RNA, 18 nt, Artificial Sequence
  Description of Artificial Sequence: Synthetic oligonucleotide
uaacucacacgguugcuu

SEQ ID NO: 48295 - RNA, 18 nt, Artificial Sequence
  Description of Artificial Sequence: Synthetic oligonucleotide
ugaccuaacucacacggu

SEQ ID NO: 48296 - RNA, 18 nt, Artificial Sequence
  Description of Artificial Sequence: Synthetic oligonucleotide
ucuggugaccuaacucac

SEQ ID NO: 48297 - RNA, 18 nt, Artificial Sequence
  Description of Artificial Sequence: Synthetic oligonucleotide
gugucucuggugaccuaa

SEQ ID NO: 48298 - RNA, 18 nt, Artificial Sequence
  Description of Artificial Sequence: Synthetic oligonucleotide
gcuuggugucucugguga

SEQ ID NO: 48299 - RNA, 18 nt, Artificial Sequence
  Description of Artificial Sequence: Synthetic oligonucleotide
ccauugcuuggugucucu

SEQ ID NO: 48300 - RNA, 18 nt, Artificial Sequence
  Description of Artificial Sequence: Synthetic oligonucleotide
cuucaccauugcuuggug

SEQ ID NO: 48301 - RNA, 18 nt, Artificial Sequence
  Description of Artificial Sequence: Synthetic oligonucleotide
ggguccuucaccauugcu

SEQ ID NO: 48302 - RNA, 18 nt, Artificial Sequence
  Description of Artificial Sequence: Synthetic oligonucleotide
agagaauugggcggaggg

SEQ ID NO: 48303 - RNA, 18 nt, Artificial Sequence
  Description of Artificial Sequence: Synthetic oligonucleotide
ggauagagaauugggcgg

SEQ ID NO: 48304 - RNA, 18 nt, Artificial Sequence
  Description of Artificial Sequence: Synthetic oligonucleotide
uaguuggauagagaauug

SEQ ID NO: 48305 - RNA, 18 nt, Artificial Sequence
  Description of Artificial Sequence: Synthetic oligonucleotide
aaauuuaguuggauagag

SEQ ID NO: 48306 - RNA, 18 nt, Artificial Sequence
  Description of Artificial Sequence: Synthetic oligonucleotide
cauggaaauuuaguugga

SEQ ID NO: 48307 - RNA, 18 nt, Artificial Sequence
  Description of Artificial Sequence: Synthetic oligonucleotide
uugggcauggaaauuuag

SEQ ID NO: 48308 - RNA, 18 nt, Artificial Sequence
  Description of Artificial Sequence: Synthetic oligonucleotide
ucacuuugggcauggaaa

SEQ ID NO: 48309 - RNA, 18 nt, Artificial Sequence
  Description of Artificial Sequence: Synthetic oligonucleotide
agcuaucacuuugggcau

SEQ ID NO: 48310 - RNA, 18 nt, Artificial Sequence
  Description of Artificial Sequence: Synthetic oligonucleotide
augauagcuaucacuuug

SEQ ID NO: 48311 - RNA, 18 nt, Artificial Sequence
  Description of Artificial Sequence: Synthetic oligonucleotide
aaaaaaugauagcuauca

SEQ ID NO: 48312 - RNA, 18 nt, Artificial Sequence
  Description of Artificial Sequence: Synthetic oligonucleotide
cguggaaaaaaugauagc

SEQ ID NO: 48313 - RNA, 18 nt, Artificial Sequence
  Description of Artificial Sequence: Synthetic oligonucleotide
uacaccguggaaaaaaug

SEQ ID NO: 48314 - RNA, 18 nt, Artificial Sequence
  Description of Artificial Sequence: Synthetic oligonucleotide
gcagauacaccguggaaa

SEQ ID NO: 48315 - RNA, 18 nt, Artificial Sequence
  Description of Artificial Sequence: Synthetic oligonucleotide
gauuugcagauacaccgu

SEQ ID NO: 48316 - RNA, 18 nt, Artificial Sequence
  Description of Artificial Sequence: Synthetic oligonucleotide
ggguggauuugcagauac

SEQ ID NO: 48317 - RNA, 18 nt, Artificial Sequence
  Description of Artificial Sequence: Synthetic oligonucleotide
acaguggguggauuugca

SEQ ID NO: 48318 - RNA, 18 nt, Artificial Sequence
  Description of Artificial Sequence: Synthetic oligonucleotide
ccgggacaguggguggau

SEQ ID NO: 48319 - RNA, 18 nt, Artificial Sequence
  Description of Artificial Sequence: Synthetic oligonucleotide
ccaccccgggacaguggg

SEQ ID NO: 48320 - RNA, 18 nt, Artificial Sequence
  Description of Artificial Sequence: Synthetic oligonucleotide
cccagccaccccgggaca

SEQ ID NO: 48321 - RNA, 18 nt, Artificial Sequence
  Description of Artificial Sequence: Synthetic oligonucleotide
aagcucccagccaccccg

SEQ ID NO: 48322 - RNA, 18 nt, Artificial Sequence
  Description of Artificial Sequence: Synthetic oligonucleotide
uuaaaaagcucccagcca

SEQ ID NO: 48323 - RNA, 18 nt, Artificial Sequence
  Description of Artificial Sequence: Synthetic oligonucleotide
acccguuaaaaagcuccc

SEQ ID NO: 48324 - RNA, 18 nt, Artificial Sequence
  Description of Artificial Sequence: Synthetic oligonucleotide
ucucaacccguuaaaaag

SEQ ID NO: 48325 - RNA, 18 nt, Artificial Sequence
  Description of Artificial Sequence: Synthetic oligonucleotide
gcaacucucaacccguua

SEQ ID NO: 48326 - RNA, 18 nt, Artificial Sequence
  Description of Artificial Sequence: Synthetic oligonucleotide
aaaaagcaacucucaacc

SEQ ID NO: 48327 - RNA, 18 nt, Artificial Sequence
  Description of Artificial Sequence: Synthetic oligonucleotide
accuuaaaaagcaacucu

SEQ ID NO: 48328 - RNA, 18 nt, Artificial Sequence
  Description of Artificial Sequence: Synthetic oligonucleotide
ccacaaccuuaaaaagca

SEQ ID NO: 48329 - RNA, 18 nt, Artificial Sequence
  Description of Artificial Sequence: Synthetic oligonucleotide
cucacccacaaccuuaaa

SEQ ID NO: 48330 - RNA, 18 nt, Artificial Sequence
  Description of Artificial Sequence: Synthetic oligonucleotide
cucagcucacccacaacc

SEQ ID NO: 48331 - RNA, 18 nt, Artificial Sequence
  Description of Artificial Sequence: Synthetic oligonucleotide
cccaucucagcucaccca

SEQ ID NO: 48332 - RNA, 18 nt, Artificial Sequence
  Description of Artificial Sequence: Synthetic oligonucleotide
agucacccaucucagcuc

SEQ ID NO: 48333 - RNA, 18 nt, Artificial Sequence
  Description of Artificial Sequence: Synthetic oligonucleotide
gacacagucacccaucuc

SEQ ID NO: 48334 - RNA, 18 nt, Artificial Sequence
  Description of Artificial Sequence: Synthetic oligonucleotide
cugaagacacagucaccc

SEQ ID NO: 48335 - RNA, 18 nt, Artificial Sequence
  Description of Artificial Sequence: Synthetic oligonucleotide
gucuccugaagacacagu

SEQ ID NO: 48336 - RNA, 18 nt, Artificial Sequence
  Description of Artificial Sequence: Synthetic oligonucleotide
guagugucuccugaagac

SEQ ID NO: 48337 - RNA, 18 nt, Artificial Sequence
  Description of Artificial Sequence: Synthetic oligonucleotide
aaaugguagugucuccug

SEQ ID NO: 48338 - RNA, 18 nt, Artificial Sequence
  Description of Artificial Sequence: Synthetic oligonucleotide
aaaccaaaugguaguguc

SEQ ID NO: 48339 - RNA, 18 nt, Artificial Sequence
  Description of Artificial Sequence: Synthetic oligonucleotide
aaaucaaaccaaauggua

SEQ ID NO: 48340 - RNA, 18 nt, Artificial Sequence
  Description of Artificial Sequence: Synthetic oligonucleotide
cucuguuuauugaugaca

SEQ ID NO: 48341 - RNA, 18 nt, Artificial Sequence
  Description of Artificial Sequence: Synthetic oligonucleotide
aagaacucuguuuauuga

SEQ ID NO: 48342 - RNA, 18 nt, Artificial Sequence
  Description of Artificial Sequence: Synthetic oligonucleotide
uugcgaagaacucuguuu

SEQ ID NO: 48343 - RNA, 18 nt, Artificial Sequence
  Description of Artificial Sequence: Synthetic oligonucleotide
ccagguugcgaagaacuc

SEQ ID NO: 48344 - RNA, 18 nt, Artificial Sequence
  Description of Artificial Sequence: Synthetic oligonucleotide
gcuagccagguugcgaag

SEQ ID NO: 48345 - RNA, 18 nt, Artificial Sequence
  Description of Artificial Sequence: Synthetic oligonucleotide
uuuucgcuagccagguug

SEQ ID NO: 48346 - RNA, 18 nt, Artificial Sequence
  Description of Artificial Sequence: Synthetic oligonucleotide
guugcuuuucgcuagcca

SEQ ID NO: 48347 - RNA, 18 nt, Artificial Sequence
  Description of Artificial Sequence: Synthetic oligonucleotide
caucuguugcuuuucgcu

SEQ ID NO: 48348 - RNA, 18 nt, Artificial Sequence
  Description of Artificial Sequence: Synthetic oligonucleotide
gcgcccaucuguugcuuu

SEQ ID NO: 48349 - RNA, 18 nt, Artificial Sequence
  Description of Artificial Sequence: Synthetic oligonucleotide
cgucugcgcccaucuguu

SEQ ID NO: 48350 - RNA, 18 nt, Artificial Sequence
  Description of Artificial Sequence: Synthetic oligonucleotide
caugccgucugcgcccau

SEQ ID NO: 48351 - RNA, 18 nt, Artificial Sequence
  Description of Artificial Sequence: Synthetic oligonucleotide
ucauacaugccgucugcg

SEQ ID NO: 48352 - RNA, 18 nt, Artificial Sequence
  Description of Artificial Sequence: Synthetic oligonucleotide
guuuaucauacaugccgu

SEQ ID NO: 48353 - RNA, 18 nt, Artificial Sequence
  Description of Artificial Sequence: Synthetic oligonucleotide
ccuuaguuuaucauacau

SEQ ID NO: 48354 - RNA, 18 nt, Artificial Sequence
  Description of Artificial Sequence: Synthetic oligonucleotide
aacauccuuaguuuauca

SEQ ID NO: 48355 - RNA, 18 nt, Artificial Sequence
  Description of Artificial Sequence: Synthetic oligonucleotide
cguucaacauccuuaguu

SEQ ID NO: 48356 - RNA, 18 nt, Artificial Sequence
  Description of Artificial Sequence: Synthetic oligonucleotide
cugcccguucaacauccu

SEQ ID NO: 48357 - RNA, 18 nt, Artificial Sequence
  Description of Artificial Sequence: Synthetic oligonucleotide
ccggucugcccguucaac

SEQ ID NO: 48358 - RNA, 18 nt, Artificial Sequence
  Description of Artificial Sequence: Synthetic oligonucleotide
agcuuccggucugcccgu

SEQ ID NO: 48359 - RNA, 18 nt, Artificial Sequence
  Description of Artificial Sequence: Synthetic oligonucleotide
gccccagcuuccggucug

SEQ ID NO: 48360 - RNA, 18 nt, Artificial Sequence
  Description of Artificial Sequence: Synthetic oligonucleotide
cgggugccccagcuuccg

SEQ ID NO: 48361 - RNA, 18 nt, Artificial Sequence
  Description of Artificial Sequence: Synthetic oligonucleotide
cagggcgggugccccagc

SEQ ID NO: 48362 - RNA, 18 nt, Artificial Sequence
  Description of Artificial Sequence: Synthetic oligonucleotide
ccaaccagggcgggugcc

SEQ ID NO: 48363 - RNA, 18 nt, Artificial Sequence
  Description of Artificial Sequence: Synthetic oligonucleotide
ggauaccaaccagggcgg

SEQ ID NO: 48364 - RNA, 18 nt, Artificial Sequence
  Description of Artificial Sequence: Synthetic oligonucleotide
uccccggauaccaaccag

SEQ ID NO: 48365 - RNA, 18 nt, Artificial Sequence
  Description of Artificial Sequence: Synthetic oligonucleotide
cgaaguccccggauacca

SEQ ID NO: 48366 - RNA, 18 nt, Artificial Sequence
  Description of Artificial Sequence: Synthetic oligonucleotide
ggcaccgaaguccccgga

SEQ ID NO: 48367 - RNA, 18 nt, Artificial Sequence
  Description of Artificial Sequence: Synthetic oligonucleotide
gcccuggcaccgaagucc

SEQ ID NO: 48368 - RNA, 18 nt, Artificial Sequence
  Description of Artificial Sequence: Synthetic oligonucleotide
agguugcccuggcaccga

SEQ ID NO: 48369 - RNA, 18 nt, Artificial Sequence
  Description of Artificial Sequence: Synthetic oligonucleotide
ugcguagguugcccuggc

SEQ ID NO: 48370 - RNA, 18 nt, Artificial Sequence
  Description of Artificial Sequence: Synthetic oligonucleotide
gccgcgggauuccacggg

SEQ ID NO: 48371 - RNA, 18 nt, Artificial Sequence
  Description of Artificial Sequence: Synthetic oligonucleotide
augcuggcucuggcuggg

SEQ ID NO: 48372 - RNA, 18 nt, Artificial Sequence
  Description of Artificial Sequence: Synthetic oligonucleotide
ucugcaugcuggcucugg

SEQ ID NO: 48373 - RNA, 18 nt, Artificial Sequence
  Description of Artificial Sequence: Synthetic oligonucleotide
ccagaaagaccagaggca

SEQ ID NO: 48374 - RNA, 18 nt, Artificial Sequence
  Description of Artificial Sequence: Synthetic oligonucleotide
aagucccagaaagaccag

SEQ ID NO: 48375 - RNA, 18 nt, Artificial Sequence
  Description of Artificial Sequence: Synthetic oligonucleotide
gcccgaagucccagaaag

SEQ ID NO: 48376 - RNA, 18 nt, Artificial Sequence
  Description of Artificial Sequence: Synthetic oligonucleotide
cccgagcccgaaguccca

SEQ ID NO: 48377 - RNA, 18 nt, Artificial Sequence
  Description of Artificial Sequence: Synthetic oligonucleotide
cgcaccccgagcccgaag

SEQ ID NO: 48378 - RNA, 18 nt, Artificial Sequence
  Description of Artificial Sequence: Synthetic oligonucleotide
guccgcgcaccccgagcc

SEQ ID NO: 48379 - RNA, 18 nt, Artificial Sequence
  Description of Artificial Sequence: Synthetic oligonucleotide
cucggguccgcgcacccc

SEQ ID NO: 48380 - RNA, 18 nt, Artificial Sequence
  Description of Artificial Sequence: Synthetic oligonucleotide
ugacccucggguccgcgc

SEQ ID NO: 48381 - RNA, 18 nt, Artificial Sequence
  Description of Artificial Sequence: Synthetic oligonucleotide
uccccugacccucggguc

SEQ ID NO: 48382 - RNA, 18 nt, Artificial Sequence
  Description of Artificial Sequence: Synthetic oligonucleotide
uguccuccccugacccuc

SEQ ID NO: 48383 - RNA, 18 nt, Artificial Sequence
  Description of Artificial Sequence: Synthetic oligonucleotide
cccuguguccuccccuga

SEQ ID NO: 48384 - RNA, 18 nt, Artificial Sequence
  Description of Artificial Sequence: Synthetic oligonucleotide
cgagucccuguguccucc

SEQ ID NO: 48385 - RNA, 18 nt, Artificial Sequence
  Description of Artificial Sequence: Synthetic oligonucleotide
cgucgcgagucccugugu

SEQ ID NO: 48386 - RNA, 18 nt, Artificial Sequence
  Description of Artificial Sequence: Synthetic oligonucleotide
gcgggcgucgcgaguccc

SEQ ID NO: 48387 - RNA, 18 nt, Artificial Sequence
  Description of Artificial Sequence: Synthetic oligonucleotide
ccagcgcgggcgucgcga

SEQ ID NO: 48388 - RNA, 18 nt, Artificial Sequence
  Description of Artificial Sequence: Synthetic oligonucleotide
ccgggccagcgcgggcgu

SEQ ID NO: 48389 - RNA, 18 nt, Artificial Sequence
  Description of Artificial Sequence: Synthetic oligonucleotide
ggcggccgggccagcgcg

SEQ ID NO: 48390 - RNA, 18 nt, Artificial Sequence
  Description of Artificial Sequence: Synthetic oligonucleotide
cggucggcggccgggcca

SEQ ID NO: 48391 - RNA, 18 nt, Artificial Sequence
  Description of Artificial Sequence: Synthetic oligonucleotide
ucagucggucggcggccg

SEQ ID NO: 48392 - RNA, 18 nt, Artificial Sequence
  Description of Artificial Sequence: Synthetic oligonucleotide
gggccucagucggucggc

SEQ ID NO: 48393 - RNA, 18 nt, Artificial Sequence
  Description of Artificial Sequence: Synthetic oligonucleotide
uccccgggccucagucgg

SEQ ID NO: 48394 - RNA, 18 nt, Artificial Sequence
  Description of Artificial Sequence: Synthetic oligonucleotide
gcagguccccgggccuca

SEQ ID NO: 48395 - RNA, 18 nt, Artificial Sequence
  Description of Artificial Sequence: Synthetic oligonucleotide
ccgccgcagguccccggg

SEQ ID NO: 48396 - RNA, 18 nt, Artificial Sequence
  Description of Artificial Sequence: Synthetic oligonucleotide
agcagccgccgcaggucc

SEQ ID NO: 48397 - RNA, 18 nt, Artificial Sequence
  Description of Artificial Sequence: Synthetic oligonucleotide
gggagcagccgccgcagg

SEQ ID NO: 48398 - RNA, 18 nt, Artificial Sequence
  Description of Artificial Sequence: Synthetic oligonucleotide
ugccgggcgcggagcggg

SEQ ID NO: 48399 - RNA, 18 nt, Artificial Sequence
  Description of Artificial Sequence: Synthetic oligonucleotide
cgggcugccgggcgcgga

SEQ ID NO: 48400 - RNA, 18 nt, Artificial Sequence
  Description of Artificial Sequence: Synthetic oligonucleotide
ccucccgggcugccgggc

SEQ ID NO: 48401 - RNA, 18 nt, Artificial Sequence
  Description of Artificial Sequence: Synthetic oligonucleotide
ccuccccucccgggcugc

SEQ ID NO: 48402 - RNA, 18 nt, Artificial Sequence
  Description of Artificial Sequence: Synthetic oligonucleotide
aacgcccuccccucccgg

SEQ ID NO: 48403 - RNA, 18 nt, Artificial Sequence
  Description of Artificial Sequence: Synthetic oligonucleotide
aagcaaacgcccuccccu

SEQ ID NO: 48404 - RNA, 18 nt, Artificial Sequence
  Description of Artificial Sequence: Synthetic oligonucleotide
gagccaagcaaacgcccu

SEQ ID NO: 48405 - RNA, 18 nt, Artificial Sequence
  Description of Artificial Sequence: Synthetic oligonucleotide
gagaagagccaagcaaac

SEQ ID NO: 48406 - RNA, 18 nt, Artificial Sequence
  Description of Artificial Sequence: Synthetic oligonucleotide
guaucgagaagagccaag

SEQ ID NO: 48407 - RNA, 18 nt, Artificial Sequence
  Description of Artificial Sequence: Synthetic oligonucleotide
cuccaguaucgagaagag

SEQ ID NO: 48408 - RNA, 18 nt, Artificial Sequence
  Description of Artificial Sequence: Synthetic oligonucleotide
ugcuucuccaguaucgag

SEQ ID NO: 48409 - RNA, 18 nt, Artificial Sequence
  Description of Artificial Sequence: Synthetic oligonucleotide
gccccugcuucuccagua

SEQ ID NO: 48410 - RNA, 18 nt, Artificial Sequence
  Description of Artificial Sequence: Synthetic oligonucleotide
gcccagccccugcuucuc

SEQ ID NO: 48411 - RNA, 18 nt, Artificial Sequence
  Description of Artificial Sequence: Synthetic oligonucleotide
uaagggcccagccccugc

SEQ ID NO: 48412 - RNA, 18 nt, Artificial Sequence
  Description of Artificial Sequence: Synthetic oligonucleotide
guucuuaagggcccagcc

SEQ ID NO: 48413 - RNA, 18 nt, Artificial Sequence
  Description of Artificial Sequence: Synthetic oligonucleotide
gggcuguucuuaagggcc

SEQ ID NO: 48414 - RNA, 18 nt, Artificial Sequence
  Description of Artificial Sequence: Synthetic oligonucleotide
cgggcgggcuguucuuaa

SEQ ID NO: 48415 - RNA, 18 nt, Artificial Sequence
  Description of Artificial Sequence: Synthetic oligonucleotide
aaacucgggcgggcuguu

SEQ ID NO: 48416 - RNA, 18 nt, Artificial Sequence
  Description of Artificial Sequence: Synthetic oligonucleotide
uucgaaaacucgggcggg

SEQ ID NO: 48417 - RNA, 18 nt, Artificial Sequence
  Description of Artificial Sequence: Synthetic oligonucleotide
gcagcuucgaaaacucgg

SEQ ID NO: 48418 - RNA, 18 nt, Artificial Sequence
  Description of Artificial Sequence: Synthetic oligonucleotide
cuaccgcagcuucgaaaa

SEQ ID NO: 48419 - RNA, 18 nt, Artificial Sequence
  Description of Artificial Sequence: Synthetic oligonucleotide
uuucucuaccgcagcuuc

SEQ ID NO: 48420 - RNA, 18 nt, Artificial Sequence
  Description of Artificial Sequence: Synthetic oligonucleotide
ggguuucucuaccgcagc

SEQ ID NO: 48421 - RNA, 18 nt, Artificial Sequence
  Description of Artificial Sequence: Synthetic oligonucleotide
ugaguuacaggauuuggg

SEQ ID NO: 48422 - RNA, 18 nt, Artificial Sequence
  Description of Artificial Sequence: Synthetic oligonucleotide
gggugugaguuacaggau

SEQ ID NO: 48423 - RNA, 18 nt, Artificial Sequence
  Description of Artificial Sequence: Synthetic oligonucleotide
gggucagagcccgggcag

SEQ ID NO: 48424 - RNA, 18 nt, Artificial Sequence
  Description of Artificial Sequence: Synthetic oligonucleotide
ccagccccucucuccggg

SEQ ID NO: 48425 - RNA, 18 nt, Artificial Sequence
  Description of Artificial Sequence: Synthetic oligonucleotide
ucagcccagccccucucu

SEQ ID NO: 48426 - RNA, 18 nt, Artificial Sequence
  Description of Artificial Sequence: Synthetic oligonucleotide
ccugaucagcccagcccc

SEQ ID NO: 48427 - RNA, 18 nt, Artificial Sequence
  Description of Artificial Sequence: Synthetic oligonucleotide
cccgcccugaucagccca

SEQ ID NO: 48428 - RNA, 18 nt, Artificial Sequence
  Description of Artificial Sequence: Synthetic oligonucleotide
uucgccccgcccugauca

SEQ ID NO: 48429 - RNA, 18 nt, Artificial Sequence
  Description of Artificial Sequence: Synthetic oligonucleotide
aagacuucgccccgcccu

SEQ ID NO: 48430 - RNA, 18 nt, Artificial Sequence
  Description of Artificial Sequence: Synthetic oligonucleotide
aggagaagacuucgcccc

SEQ ID NO: 48431 - RNA, 18 nt, Artificial Sequence
  Description of Artificial Sequence: Synthetic oligonucleotide
caacuaggagaagacuuc

SEQ ID NO: 48432 - RNA, 18 nt, Artificial Sequence
  Description of Artificial Sequence: Synthetic oligonucleotide
ucgcucaacuaggagaag

SEQ ID NO: 48433 - RNA, 18 nt, Artificial Sequence
  Description of Artificial Sequence: Synthetic oligonucleotide
ccuucucgcucaacuagg

SEQ ID NO: 48434 - RNA, 18 nt, Artificial Sequence
  Description of Artificial Sequence: Synthetic oligonucleotide
ggccuccuucucgcucaa

SEQ ID NO: 48435 - RNA, 18 nt, Artificial Sequence
  Description of Artificial Sequence: Synthetic oligonucleotide
gggccuccuucucgcuca

SEQ ID NO: 48436 - RNA, 18 nt, Artificial Sequence
  Description of Artificial Sequence: Synthetic oligonucleotide
uuggcuaagcccaaaggg

SEQ ID NO: 48437 - RNA, 18 nt, Artificial Sequence
  Description of Artificial Sequence: Synthetic oligonucleotide
cagucuuggcuaagccca

SEQ ID NO: 48438 - RNA, 18 nt, Artificial Sequence
  Description of Artificial Sequence: Synthetic oligonucleotide
acuuucagucuuggcuaa

SEQ ID NO: 48439 - RNA, 18 nt, Artificial Sequence
  Description of Artificial Sequence: Synthetic oligonucleotide
uggagacuuucagucuug

SEQ ID NO: 48440 - RNA, 18 nt, Artificial Sequence
  Description of Artificial Sequence: Synthetic oligonucleotide
guugguggagacuuucag

SEQ ID NO: 48441 - RNA, 18 nt, Artificial Sequence
  Description of Artificial Sequence: Synthetic oligonucleotide
gccggguugguggagacu

SEQ ID NO: 48442 - RNA, 18 nt, Artificial Sequence
  Description of Artificial Sequence: Synthetic oligonucleotide
accccgccggguuggugg

SEQ ID NO: 48443 - RNA, 18 nt, Artificial Sequence
  Description of Artificial Sequence: Synthetic oligonucleotide
ccccaaccccgccggguu

SEQ ID NO: 48444 - RNA, 18 nt, Artificial Sequence
  Description of Artificial Sequence: Synthetic oligonucleotide
gaagcccccaaccccgcc

SEQ ID NO: 48445 - RNA, 18 nt, Artificial Sequence
  Description of Artificial Sequence: Synthetic oligonucleotide
ggagagaagcccccaacc

SEQ ID NO: 48446 - RNA, 18 nt, Artificial Sequence
  Description of Artificial Sequence: Synthetic oligonucleotide
gggagagaagcccccaac

SEQ ID NO: 48447 - RNA, 18 nt, Artificial Sequence
  Description of Artificial Sequence: Synthetic oligonucleotide
cccugagagugacuuggg

SEQ ID NO: 48448 - RNA, 18 nt, Artificial Sequence
  Description of Artificial Sequence: Synthetic oligonucleotide
agcugcccugagagugac

SEQ ID NO: 48449 - RNA, 18 nt, Artificial Sequence
  Description of Artificial Sequence: Synthetic oligonucleotide
ggaggagcugcccugaga

SEQ ID NO: 48450 - RNA, 18 nt, Artificial Sequence
  Description of Artificial Sequence: Synthetic oligonucleotide
gggaggagcugcccugag

SEQ ID NO: 48451 - RNA, 18 nt, Artificial Sequence
  Description of Artificial Sequence: Synthetic oligonucleotide
uucuaggcccguaguggg

SEQ ID NO: 48452 - RNA, 18 nt, Artificial Sequence
  Description of Artificial Sequence: Synthetic oligonucleotide
aucccuucuaggcccgua

SEQ ID NO: 48453 - RNA, 18 nt, Artificial Sequence
  Description of Artificial Sequence: Synthetic oligonucleotide
uccccaucccuucuaggc

SEQ ID NO: 48454 - RNA, 18 nt, Artificial Sequence
  Description of Artificial Sequence: Synthetic oligonucleotide
uggguucuacagauccca

SEQ ID NO: 48455 - RNA, 18 nt, Artificial Sequence
  Description of Artificial Sequence: Synthetic oligonucleotide
aaccauggguucuacaga

SEQ ID NO: 48456 - RNA, 18 nt, Artificial Sequence
  Description of Artificial Sequence: Synthetic oligonucleotide
ccgcaaaccauggguucu

SEQ ID NO: 48457 - RNA, 18 nt, Artificial Sequence
  Description of Artificial Sequence: Synthetic oligonucleotide
ugucaccgcaaaccaugg

SEQ ID NO: 48458 - RNA, 18 nt, Artificial Sequence
  Description of Artificial Sequence: Synthetic oligonucleotide
cugagugucaccgcaaac

SEQ ID NO: 48459 - RNA, 18 nt, Artificial Sequence
  Description of Artificial Sequence: Synthetic oligonucleotide
ccccucugagugucaccg

SEQ ID NO: 48460 - RNA, 18 nt, Artificial Sequence
  Description of Artificial Sequence: Synthetic oligonucleotide
aagauccccucugagugu

SEQ ID NO: 48461 - RNA, 18 nt, Artificial Sequence
  Description of Artificial Sequence: Synthetic oligonucleotide
ucccaaagauccccucug

SEQ ID NO: 48462 - RNA, 18 nt, Artificial Sequence
  Description of Artificial Sequence: Synthetic oligonucleotide
aaaucucccaaagauccc

SEQ ID NO: 48463 - RNA, 18 nt, Artificial Sequence
  Description of Artificial Sequence: Synthetic oligonucleotide
ucuauaaaucucccaaag

SEQ ID NO: 48464 - RNA, 18 nt, Artificial Sequence
  Description of Artificial Sequence: Synthetic oligonucleotide
ccggcucuauaaaucucc

SEQ ID NO: 48465 - RNA, 18 nt, Artificial Sequence
  Description of Artificial Sequence: Synthetic oligonucleotide
aagaaccggcucuauaaa

SEQ ID NO: 48466 - RNA, 18 nt, Artificial Sequence
  Description of Artificial Sequence: Synthetic oligonucleotide
gcgcuaagaaccggcucu

SEQ ID NO: 48467 - RNA, 18 nt, Artificial Sequence
  Description of Artificial Sequence: Synthetic oligonucleotide
acaaagcgcuaagaaccg

SEQ ID NO: 48468 - RNA, 18 nt, Artificial Sequence
  Description of Artificial Sequence: Synthetic oligonucleotide
aacccacaaagcgcuaag

SEQ ID NO: 48469 - RNA, 18 nt, Artificial Sequence
  Description of Artificial Sequence: Synthetic oligonucleotide
cucugaacccacaaagcg

SEQ ID NO: 48470 - RNA, 18 nt, Artificial Sequence
  Description of Artificial Sequence: Synthetic oligonucleotide
ccagccucugaacccaca

SEQ ID NO: 48471 - RNA, 18 nt, Artificial Sequence
  Description of Artificial Sequence: Synthetic oligonucleotide
ugcagccagccucugaac

SEQ ID NO: 48472 - RNA, 18 nt, Artificial Sequence
  Description of Artificial Sequence: Synthetic oligonucleotide
aacacugcagccagccuc

SEQ ID NO: 48473 - RNA, 18 nt, Artificial Sequence
  Description of Artificial Sequence: Synthetic oligonucleotide
ucauaaacacugcagcca

SEQ ID NO: 48474 - RNA, 18 nt, Artificial Sequence
  Description of Artificial Sequence: Synthetic oligonucleotide
ccucuucauaaacacugc

SEQ ID NO: 48475 - RNA, 18 nt, Artificial Sequence
  Description of Artificial Sequence: Synthetic oligonucleotide
cugccccucuucauaaac

SEQ ID NO: 48476 - RNA, 18 nt, Artificial Sequence
  Description of Artificial Sequence: Synthetic oligonucleotide
gcccacugccccucuuca

SEQ ID NO: 48477 - RNA, 18 nt, Artificial Sequence
  Description of Artificial Sequence: Synthetic oligonucleotide
ccccagcccacugccccu

SEQ ID NO: 48478 - RNA, 18 nt, Artificial Sequence
  Description of Artificial Sequence: Synthetic oligonucleotide
aguguccccagcccacug

SEQ ID NO: 48479 - RNA, 18 nt, Artificial Sequence
  Description of Artificial Sequence: Synthetic oligonucleotide
ccagcaguguccccagcc

SEQ ID NO: 48480 - RNA, 18 nt, Artificial Sequence
  Description of Artificial Sequence: Synthetic oligonucleotide
uaaccccagcaguguccc

SEQ ID NO: 48481 - RNA, 18 nt, Artificial Sequence
  Description of Artificial Sequence: Synthetic oligonucleotide
agccauaaccccagcagu

SEQ ID NO: 48482 - RNA, 18 nt, Artificial Sequence
  Description of Artificial Sequence: Synthetic oligonucleotide
acuacagccauaacccca

SEQ ID NO: 48483 - RNA, 18 nt, Artificial Sequence
  Description of Artificial Sequence: Synthetic oligonucleotide
accucacuacagccauaa

SEQ ID NO: 48484 - RNA, 18 nt, Artificial Sequence
  Description of Artificial Sequence: Synthetic oligonucleotide
cauggaccucacuacagc

SEQ ID NO: 48485 - RNA, 18 nt, Artificial Sequence
  Description of Artificial Sequence: Synthetic oligonucleotide
guacacauggaccucacu

SEQ ID NO: 48486 - RNA, 18 nt, Artificial Sequence
  Description of Artificial Sequence: Synthetic oligonucleotide
aacaaguacacauggacc

SEQ ID NO: 48487 - RNA, 18 nt, Artificial Sequence
  Description of Artificial Sequence: Synthetic oligonucleotide
caaggaacaaguacacau

SEQ ID NO: 48488 - RNA, 18 nt, Artificial Sequence
  Description of Artificial Sequence: Synthetic oligonucleotide
caugccaaggaacaagua

SEQ ID NO: 48489 - RNA, 18 nt, Artificial Sequence
  Description of Artificial Sequence: Synthetic oligonucleotide
agacacaugccaaggaac

SEQ ID NO: 48490 - RNA, 18 nt, Artificial Sequence
  Description of Artificial Sequence: Synthetic oligonucleotide
gagucagacacaugccaa

SEQ ID NO: 48491 - RNA, 18 nt, Artificial Sequence
  Description of Artificial Sequence: Synthetic oligonucleotide
acacagagucagacacau

SEQ ID NO: 48492 - RNA, 18 nt, Artificial Sequence
  Description of Artificial Sequence: Synthetic oligonucleotide
cagcaacacagagucaga

SEQ ID NO: 48493 - RNA, 18 nt, Artificial Sequence
  Description of Artificial Sequence: Synthetic oligonucleotide
ugcagcagcaacacagag

SEQ ID NO: 48494 - RNA, 18 nt, Artificial Sequence
  Description of Artificial Sequence: Synthetic oligonucleotide
uguacugcagcagcaaca

SEQ ID NO: 48495 - RNA, 18 nt, Artificial Sequence
  Description of Artificial Sequence: Synthetic oligonucleotide
cccacuguacugcagcag

SEQ ID NO: 48496 - RNA, 18 nt, Artificial Sequence
  Description of Artificial Sequence: Synthetic oligonucleotide
cccugcccacuguacugc

SEQ ID NO: 48497 - RNA, 18 nt, Artificial Sequence
  Description of Artificial Sequence: Synthetic oligonucleotide
cgugccccugcccacugu

SEQ ID NO: 48498 - RNA, 18 nt, Artificial Sequence
  Description of Artificial Sequence: Synthetic oligonucleotide
gcaaccgugccccugccc

SEQ ID NO: 48499 - RNA, 18 nt, Artificial Sequence
  Description of Artificial Sequence: Synthetic oligonucleotide
uccaagcaaccgugcccc

SEQ ID NO: 48500 - RNA, 18 nt, Artificial Sequence
  Description of Artificial Sequence: Synthetic oligonucleotide
cccaguccaagcaaccgu

SEQ ID NO: 48501 - RNA, 18 nt, Artificial Sequence
  Description of Artificial Sequence: Synthetic oligonucleotide
ggcagcccaguccaagca

SEQ ID NO: 48502 - RNA, 18 nt, Artificial Sequence
  Description of Artificial Sequence: Synthetic oligonucleotide
caucgggcagcccagucc

SEQ ID NO: 48503 - RNA, 18 nt, Artificial Sequence
  Description of Artificial Sequence: Synthetic oligonucleotide
ccagacaucgggcagccc

SEQ ID NO: 48504 - RNA, 18 nt, Artificial Sequence
  Description of Artificial Sequence: Synthetic oligonucleotide
ccaugccagacaucgggc

SEQ ID NO: 48505 - RNA, 18 nt, Artificial Sequence
  Description of Artificial Sequence: Synthetic oligonucleotide
accagccaugccagacau

SEQ ID NO: 48506 - RNA, 18 nt, Artificial Sequence
  Description of Artificial Sequence: Synthetic oligonucleotide
ggaccaccagccaugcca

SEQ ID NO: 48507 - RNA, 18 nt, Artificial Sequence
  Description of Artificial Sequence: Synthetic oligonucleotide
caacaggaccaccagcca

SEQ ID NO: 48508 - RNA, 18 nt, Artificial Sequence
  Description of Artificial Sequence: Synthetic oligonucleotide
aaggacaacaggaccacc

SEQ ID NO: 48509 - RNA, 18 nt, Artificial Sequence
  Description of Artificial Sequence: Synthetic oligonucleotide
aaauaaaggacaacagga

SEQ ID NO: 48510 - RNA, 18 nt, Artificial Sequence
  Description of Artificial Sequence: Synthetic oligonucleotide
cgaucaaauaaaggacaa

SEQ ID NO: 48511 - RNA, 18 nt, Artificial Sequence
  Description of Artificial Sequence: Synthetic oligonucleotide
gcuaucgaucaaauaaag

SEQ ID NO: 48512 - RNA, 18 nt, Artificial Sequence
  Description of Artificial Sequence: Synthetic oligonucleotide
ucccugcuaucgaucaaa

SEQ ID NO: 48513 - RNA, 18 nt, Artificial Sequence
  Description of Artificial Sequence: Synthetic oligonucleotide
ucaguucccugcuaucga

SEQ ID NO: 48514 - RNA, 18 nt, Artificial Sequence
  Description of Artificial Sequence: Synthetic oligonucleotide
ggcggucaguucccugcu

SEQ ID NO: 48515 - RNA, 18 nt, Artificial Sequence
  Description of Artificial Sequence: Synthetic oligonucleotide
accucggcggucaguucc

SEQ ID NO: 48516 - RNA, 18 nt, Artificial Sequence
  Description of Artificial Sequence: Synthetic oligonucleotide
ugccaaccucggcgguca

SEQ ID NO: 48517 - RNA, 18 nt, Artificial Sequence
  Description of Artificial Sequence: Synthetic oligonucleotide
accugugccaaccucggc

SEQ ID NO: 48518 - RNA, 18 nt, Artificial Sequence
  Description of Artificial Sequence: Synthetic oligonucleotide
ugccaaccugugccaacc

SEQ ID NO: 48519 - RNA, 18 nt, Artificial Sequence
  Description of Artificial Sequence: Synthetic oligonucleotide
cccccugccaaccugugc

SEQ ID NO: 48520 - RNA, 18 nt, Artificial Sequence
  Description of Artificial Sequence: Synthetic oligonucleotide
cucaucccccugccaacc

SEQ ID NO: 48521 - RNA, 18 nt, Artificial Sequence
  Description of Artificial Sequence: Synthetic oligonucleotide
gcauccucaucccccugc

SEQ ID NO: 48522 - RNA, 18 nt, Artificial Sequence
  Description of Artificial Sequence: Synthetic oligonucleotide
acaaugcauccucauccc

SEQ ID NO: 48523 - RNA, 18 nt, Artificial Sequence
  Description of Artificial Sequence: Synthetic oligonucleotide
caaccacaaugcauccuc

SEQ ID NO: 48524 - RNA, 18 nt, Artificial Sequence
  Description of Artificial Sequence: Synthetic oligonucleotide
ggagacaaccacaaugca

SEQ ID NO: 48525 - RNA, 18 nt, Artificial Sequence
  Description of Artificial Sequence: Synthetic oligonucleotide
gaggaggagacaaccaca

SEQ ID NO: 48526 - RNA, 18 nt, Artificial Sequence
  Description of Artificial Sequence: Synthetic oligonucleotide
gagaggaggaggagacaa

SEQ ID NO: 48527 - RNA, 18 nt, Artificial Sequence
  Description of Artificial Sequence: Synthetic oligonucleotide
agaaggagaggaggagga

SEQ ID NO: 48528 - RNA, 18 nt, Artificial Sequence
  Description of Artificial Sequence: Synthetic oligonucleotide
gaggaagaaggagaggag

SEQ ID NO: 48529 - RNA, 18 nt, Artificial Sequence
  Description of Artificial Sequence: Synthetic oligonucleotide
gggaagaggaagaaggag

SEQ ID NO: 48530 - RNA, 18 nt, Artificial Sequence
  Description of Artificial Sequence: Synthetic oligonucleotide
aaaggagaggaggaaggg

SEQ ID NO: 48531 - RNA, 18 nt, Artificial Sequence
  Description of Artificial Sequence: Synthetic oligonucleotide
agaaaggagaggaggaag

SEQ ID NO: 48532 - RNA, 18 nt, Artificial Sequence
  Description of Artificial Sequence: Synthetic oligonucleotide
agaacagaaaggagagga

SEQ ID NO: 48533 - RNA, 18 nt, Artificial Sequence
  Description of Artificial Sequence: Synthetic oligonucleotide
gaacaagaacagaaagga

SEQ ID NO: 48534 - RNA, 18 nt, Artificial Sequence
  Description of Artificial Sequence: Synthetic oligonucleotide
agggagaacaagaacaga

SEQ ID NO: 48535 - RNA, 18 nt, Artificial Sequence
  Description of Artificial Sequence: Synthetic oligonucleotide
agaugagggagaacaaga

SEQ ID NO: 48536 - RNA, 18 nt, Artificial Sequence
  Description of Artificial Sequence: Synthetic oligonucleotide
gaggaagaugagggagaa

SEQ ID NO: 48537 - RNA, 18 nt, Artificial Sequence
  Description of Artificial Sequence: Synthetic oligonucleotide
aggaagaggaagaugagg

SEQ ID NO: 48538 - RNA, 18 nt, Artificial Sequence
  Description of Artificial Sequence: Synthetic oligonucleotide
gaagaaggaagaggaaga

SEQ ID NO: 48539 - RNA, 18 nt, Artificial Sequence
  Description of Artificial Sequence: Synthetic oligonucleotide
agggagaagaaggaagag

SEQ ID NO: 48540 - RNA, 18 nt, Artificial Sequence
  Description of Artificial Sequence: Synthetic oligonucleotide
agaagagggagaagaagg

SEQ ID NO: 48541 - RNA, 18 nt, Artificial Sequence
  Description of Artificial Sequence: Synthetic oligonucleotide
gaggaagaagagggagaa

SEQ ID NO: 48542 - RNA, 18 nt, Artificial Sequence
  Description of Artificial Sequence: Synthetic oligonucleotide
gugaagaggaagaagagg

SEQ ID NO: 48543 - RNA, 18 nt, Artificial Sequence
  Description of Artificial Sequence: Synthetic oligonucleotide
gcagagugaagaggaaga

SEQ ID NO: 48544 - RNA, 18 nt, Artificial Sequence
  Description of Artificial Sequence: Synthetic oligonucleotide
agagagcagagugaagag

SEQ ID NO: 48545 - RNA, 18 nt, Artificial Sequence
  Description of Artificial Sequence: Synthetic oligonucleotide
agagaagagagcagagug

SEQ ID NO: 48546 - RNA, 18 nt, Artificial Sequence
  Description of Artificial Sequence: Synthetic oligonucleotide
aaagaagagaagagagca

SEQ ID NO: 48547 - RNA, 18 nt, Artificial Sequence
  Description of Artificial Sequence: Synthetic oligonucleotide
ugauucacuccgcuguga

SEQ ID NO: 48548 - RNA, 18 nt, Artificial Sequence
  Description of Artificial Sequence: Synthetic oligonucleotide
cgagcugauucacuccgc

SEQ ID NO: 48549 - RNA, 18 nt, Artificial Sequence
  Description of Artificial Sequence: Synthetic oligonucleotide
accaccgagcugauucac

SEQ ID NO: 48550 - RNA, 18 nt, Artificial Sequence
  Description of Artificial Sequence: Synthetic oligonucleotide
aagacaccaccgagcuga

SEQ ID NO: 48551 - RNA, 18 nt, Artificial Sequence
  Description of Artificial Sequence: Synthetic oligonucleotide
ugacaaagacaccaccga

SEQ ID NO: 48552 - RNA, 18 nt, Artificial Sequence
  Description of Artificial Sequence: Synthetic oligonucleotide
cccguugacaaagacacc

SEQ ID NO: 48553 - RNA, 18 nt, Artificial Sequence
  Description of Artificial Sequence: Synthetic oligonucleotide
ggccgcccguugacaaag

SEQ ID NO: 48554 - RNA, 18 nt, Artificial Sequence
  Description of Artificial Sequence: Synthetic oligonucleotide
gcaguggccgcccguuga

SEQ ID NO: 48555 - RNA, 18 nt, Artificial Sequence
  Description of Artificial Sequence: Synthetic oligonucleotide
guccggcaguggccgccc

SEQ ID NO: 48556 - RNA, 18 nt, Artificial Sequence
  Description of Artificial Sequence: Synthetic oligonucleotide
guggaguccggcaguggc

SEQ ID NO: 48557 - RNA, 18 nt, Artificial Sequence
  Description of Artificial Sequence: Synthetic oligonucleotide
gccggguggaguccggca

SEQ ID NO: 48558 - RNA, 18 nt, Artificial Sequence
  Description of Artificial Sequence: Synthetic oligonucleotide
cuucugccggguggaguc

SEQ ID NO: 48559 - RNA, 18 nt, Artificial Sequence
  Description of Artificial Sequence: Synthetic oligonucleotide
acaaucuucugccgggug

SEQ ID NO: 48560 - RNA, 18 nt, Artificial Sequence
  Description of Artificial Sequence: Synthetic oligonucleotide
gcucuacaaucuucugcc

SEQ ID NO: 48561 - RNA, 18 nt, Artificial Sequence
  Description of Artificial Sequence: Synthetic oligonucleotide
agcuagcucuacaaucuu

SEQ ID NO: 48562 - RNA, 18 nt, Artificial Sequence
  Description of Artificial Sequence: Synthetic oligonucleotide
cugugagcuagcucuaca

SEQ ID NO: 48563 - RNA, 18 nt, Artificial Sequence
  Description of Artificial Sequence: Synthetic oligonucleotide
ccccgcugugagcuagcu

SEQ ID NO: 48564 - RNA, 18 nt, Artificial Sequence
  Description of Artificial Sequence: Synthetic oligonucleotide
ccgggccccgcugugagc

SEQ ID NO: 48565 - RNA, 18 nt, Artificial Sequence
  Description of Artificial Sequence: Synthetic oligonucleotide
cacggccgggccccgcug

SEQ ID NO: 48566 - RNA, 18 nt, Artificial Sequence
  Description of Artificial Sequence: Synthetic oligonucleotide
ugucgcacggccgggccc

SEQ ID NO: 48567 - RNA, 18 nt, Artificial Sequence
  Description of Artificial Sequence: Synthetic oligonucleotide
ggaaaugucgcacggccg

SEQ ID NO: 48568 - RNA, 18 nt, Artificial Sequence
  Description of Artificial Sequence: Synthetic oligonucleotide
auucgggaaaugucgcac

SEQ ID NO: 48569 - RNA, 18 nt, Artificial Sequence
  Description of Artificial Sequence: Synthetic oligonucleotide
gcagaauucgggaaaugu

SEQ ID NO: 48570 - RNA, 18 nt, Artificial Sequence
  Description of Artificial Sequence: Synthetic oligonucleotide
gauucacuccgcugugac

SEQ ID NO: 48571 - RNA, 18 nt, Artificial Sequence
  Description of Artificial Sequence: Synthetic oligonucleotide
gagcugauucacuccgcu

SEQ ID NO: 48572 - RNA, 18 nt, Artificial Sequence
  Description of Artificial Sequence: Synthetic oligonucleotide
ccaccgagcugauucacu

SEQ ID NO: 48573 - RNA, 18 nt, Artificial Sequence
  Description of Artificial Sequence: Synthetic oligonucleotide
agacaccaccgagcugau

SEQ ID NO: 48574 - RNA, 18 nt, Artificial Sequence
  Description of Artificial Sequence: Synthetic oligonucleotide
gacaaagacaccaccgag

SEQ ID NO: 48575 - RNA, 18 nt, Artificial Sequence
  Description of Artificial Sequence: Synthetic oligonucleotide
ccguugacaaagacacca

SEQ ID NO: 48576 - RNA, 18 nt, Artificial Sequence
  Description of Artificial Sequence: Synthetic oligonucleotide
gccgcccguugacaaaga

SEQ ID NO: 48577 - RNA, 18 nt, Artificial Sequence
  Description of Artificial Sequence: Synthetic oligonucleotide
caguggccgcccguugac

SEQ ID NO: 48578 - RNA, 18 nt, Artificial Sequence
  Description of Artificial Sequence: Synthetic oligonucleotide
uccggcaguggccgcccg

SEQ ID NO: 48579 - RNA, 18 nt, Artificial Sequence
  Description of Artificial Sequence: Synthetic oligonucleotide
uggaguccggcaguggcc

SEQ ID NO: 48580 - RNA, 18 nt, Artificial Sequence
  Description of Artificial Sequence: Synthetic oligonucleotide
ccggguggaguccggcag

SEQ ID NO: 48581 - RNA, 18 nt, Artificial Sequence
  Description of Artificial Sequence: Synthetic oligonucleotide
uucugccggguggagucc

SEQ ID NO: 48582 - RNA, 18 nt, Artificial Sequence
  Description of Artificial Sequence: Synthetic oligonucleotide
caaucuucugccgggugg

SEQ ID NO: 48583 - RNA, 18 nt, Artificial Sequence
  Description of Artificial Sequence: Synthetic oligonucleotide
cucuacaaucuucugccg

SEQ ID NO: 48584 - RNA, 18 nt, Artificial Sequence
  Description of Artificial Sequence: Synthetic oligonucleotide
gcuagcucuacaaucuuc

SEQ ID NO: 48585 - RNA, 18 nt, Artificial Sequence
  Description of Artificial Sequence: Synthetic oligonucleotide
ugugagcuagcucuacaa

SEQ ID NO: 48586 - RNA, 18 nt, Artificial Sequence
  Description of Artificial Sequence: Synthetic oligonucleotide
cccgcugugagcuagcuc

SEQ ID NO: 48587 - RNA, 18 nt, Artificial Sequence
  Description of Artificial Sequence: Synthetic oligonucleotide
cgggccccgcugugagcu

SEQ ID NO: 48588 - RNA, 18 nt, Artificial Sequence
  Description of Artificial Sequence: Synthetic oligonucleotide
acggccgggccccgcugu

SEQ ID NO: 48589 - RNA, 18 nt, Artificial Sequence
  Description of Artificial Sequence: Synthetic oligonucleotide
gucgcacggccgggcccc

SEQ ID NO: 48590 - RNA, 18 nt, Artificial Sequence
  Description of Artificial Sequence: Synthetic oligonucleotide
gaaaugucgcacggccgg

SEQ ID NO: 48591 - RNA, 18 nt, Artificial Sequence
  Description of Artificial Sequence: Synthetic oligonucleotide
uucgggaaaugucgcacg

SEQ ID NO: 48592 - RNA, 18 nt, Artificial Sequence
  Description of Artificial Sequence: Synthetic oligonucleotide
cagaauucgggaaauguc

SEQ ID NO: 48593 - RNA, 18 nt, Artificial Sequence
  Description of Artificial Sequence: Synthetic oligonucleotide
gggcggcgccgggaggau

SEQ ID NO: 48594 - RNA, 18 nt, Artificial Sequence
  Description of Artificial Sequence: Synthetic oligonucleotide
agaguggagggccgcggg

SEQ ID NO: 48595 - RNA, 18 nt, Artificial Sequence
  Description of Artificial Sequence: Synthetic oligonucleotide
cguugagaguggagggcc

SEQ ID NO: 48596 - RNA, 18 nt, Artificial Sequence
  Description of Artificial Sequence: Synthetic oligonucleotide
gagggcguugagagugga

SEQ ID NO: 48597 - RNA, 18 nt, Artificial Sequence
  Description of Artificial Sequence: Synthetic oligonucleotide
gaagagagggcguugaga

SEQ ID NO: 48598 - RNA, 18 nt, Artificial Sequence
  Description of Artificial Sequence: Synthetic oligonucleotide
gaaaugaagagagggcgu

SEQ ID NO: 48599 - RNA, 18 nt, Artificial Sequence
  Description of Artificial Sequence: Synthetic oligonucleotide
aguaagaaaugaagagag

SEQ ID NO: 48600 - RNA, 18 nt, Artificial Sequence
  Description of Artificial Sequence: Synthetic oligonucleotide
uuuacaguaagaaaugaa

SEQ ID NO: 48601 - RNA, 18 nt, Artificial Sequence
  Description of Artificial Sequence: Synthetic oligonucleotide
caucguuuacaguaagaa

SEQ ID NO: 48602 - RNA, 18 nt, Artificial Sequence
  Description of Artificial Sequence: Synthetic oligonucleotide
auuagcaucguuuacagu

SEQ ID NO: 48603 - RNA, 18 nt, Artificial Sequence
  Description of Artificial Sequence: Synthetic oligonucleotide
ccauaauuagcaucguuu

SEQ ID NO: 48604 - RNA, 18 nt, Artificial Sequence
  Description of Artificial Sequence: Synthetic oligonucleotide
ggguccauaauuagcauc

SEQ ID NO: 48605 - RNA, 18 nt, Artificial Sequence
  Description of Artificial Sequence: Synthetic oligonucleotide
gaaagugggaaggcaggg

SEQ ID NO: 48606 - RNA, 18 nt, Artificial Sequence
  Description of Artificial Sequence: Synthetic oligonucleotide
gggaaagugggaaggcag

SEQ ID NO: 48607 - RNA, 18 nt, Artificial Sequence
  Description of Artificial Sequence: Synthetic oligonucleotide
gaugguggaaggagaggg

SEQ ID NO: 48608 - RNA, 18 nt, Artificial Sequence
  Description of Artificial Sequence: Synthetic oligonucleotide
ggaaggaugguggaagga

SEQ ID NO: 48609 - RNA, 18 nt, Artificial Sequence
  Description of Artificial Sequence: Synthetic oligonucleotide
gauagggaaggauggugg

SEQ ID NO: 48610 - RNA, 18 nt, Artificial Sequence
  Description of Artificial Sequence: Synthetic oligonucleotide
aaagagauagggaaggau

SEQ ID NO: 48611 - RNA, 18 nt, Artificial Sequence
  Description of Artificial Sequence: Synthetic oligonucleotide
gguugaaagagauaggga

SEQ ID NO: 48612 - RNA, 18 nt, Artificial Sequence
  Description of Artificial Sequence: Synthetic oligonucleotide
acccagguugaaagagau

SEQ ID NO: 48613 - RNA, 18 nt, Artificial Sequence
  Description of Artificial Sequence: Synthetic oligonucleotide
aacugacccagguugaaa

SEQ ID NO: 48614 - RNA, 18 nt, Artificial Sequence
  Description of Artificial Sequence: Synthetic oligonucleotide
uauguaacugacccaggu

SEQ ID NO: 48615 - RNA, 18 nt, Artificial Sequence
  Description of Artificial Sequence: Synthetic oligonucleotide
uaucuuauguaacugacc

SEQ ID NO: 48616 - RNA, 18 nt, Artificial Sequence
  Description of Artificial Sequence: Synthetic oligonucleotide
ugaguuaucuuauguaac

SEQ ID NO: 48617 - RNA, 18 nt, Artificial Sequence
  Description of Artificial Sequence: Synthetic oligonucleotide
gcagaugaguuaucuuau

SEQ ID NO: 48618 - RNA, 18 nt, Artificial Sequence
  Description of Artificial Sequence: Synthetic oligonucleotide
cugaagcagaugaguuau

SEQ ID NO: 48619 - RNA, 18 nt, Artificial Sequence
  Description of Artificial Sequence: Synthetic oligonucleotide
uuuuucugaagcagauga

SEQ ID NO: 48620 - RNA, 18 nt, Artificial Sequence
  Description of Artificial Sequence: Synthetic oligonucleotide
caauauuuuucugaagca

SEQ ID NO: 48621 - RNA, 18 nt, Artificial Sequence
  Description of Artificial Sequence: Synthetic oligonucleotide
gcacacaauauuuuucug

SEQ ID NO: 48622 - RNA, 18 nt, Artificial Sequence
  Description of Artificial Sequence: Synthetic oligonucleotide
aauccgcacacaauauuu

SEQ ID NO: 48623 - RNA, 18 nt, Artificial Sequence
  Description of Artificial Sequence: Synthetic oligonucleotide
aaaaaaauccgcacacaa

SEQ ID NO: 48624 - RNA, 18 nt, Artificial Sequence
  Description of Artificial Sequence: Synthetic oligonucleotide
uuuuuaaaaaaauccgca

SEQ ID NO: 48625 - RNA, 18 nt, Artificial Sequence
  Description of Artificial Sequence: Synthetic oligonucleotide
agauuuuuuuaaaaaaau

SEQ ID NO: 48626 - RNA, 18 nt, Artificial Sequence
  Description of Artificial Sequence: Synthetic oligonucleotide
gagaaagauuuuuuuaaa

SEQ ID NO: 48627 - RNA, 18 nt, Artificial Sequence
  Description of Artificial Sequence: Synthetic oligonucleotide
aaaaagagaaagauuuuu

SEQ ID NO: 48628 - RNA, 18 nt, Artificial Sequence
  Description of Artificial Sequence: Synthetic oligonucleotide
caaauaaaaagagaaaga

SEQ ID NO: 48629 - RNA, 18 nt, Artificial Sequence
  Description of Artificial Sequence: Synthetic oligonucleotide
uuuaccaaauaaaaagag

SEQ ID NO: 48630 - RNA, 18 nt, Artificial Sequence
  Description of Artificial Sequence: Synthetic oligonucleotide
augucuuuaccaaauaaa

SEQ ID NO: 48631 - RNA, 18 nt, Artificial Sequence
  Description of Artificial Sequence: Synthetic oligonucleotide
aaugaaugucuuuaccaa

SEQ ID NO: 48632 - RNA, 18 nt, Artificial Sequence
  Description of Artificial Sequence: Synthetic oligonucleotide
cccacaaugaaugucuuu

SEQ ID NO: 48633 - RNA, 18 nt, Artificial Sequence
  Description of Artificial Sequence: Synthetic oligonucleotide
cuguucccacaaugaaug

SEQ ID NO: 48634 - RNA, 18 nt, Artificial Sequence
  Description of Artificial Sequence: Synthetic oligonucleotide
auaaacuguucccacaau

SEQ ID NO: 48635 - RNA, 18 nt, Artificial Sequence
  Description of Artificial Sequence: Synthetic oligonucleotide
gguucauaaacuguuccc

SEQ ID NO: 48636 - RNA, 18 nt, Artificial Sequence
  Description of Artificial Sequence: Synthetic oligonucleotide
auuacgguucauaaacug

SEQ ID NO: 48637 - RNA, 18 nt, Artificial Sequence
  Description of Artificial Sequence: Synthetic oligonucleotide
agcuuauuacgguucaua

SEQ ID NO: 48638 - RNA, 18 nt, Artificial Sequence
  Description of Artificial Sequence: Synthetic oligonucleotide
aacucagcuuauuacggu

SEQ ID NO: 48639 - RNA, 18 nt, Artificial Sequence
  Description of Artificial Sequence: Synthetic oligonucleotide
uauauaacucagcuuauu

SEQ ID NO: 48640 - RNA, 18 nt, Artificial Sequence
  Description of Artificial Sequence: Synthetic oligonucleotide
cgguuuauauaacucagc

SEQ ID NO: 48641 - RNA, 18 nt, Artificial Sequence
  Description of Artificial Sequence: Synthetic oligonucleotide
uaugccgguuuauauaac

SEQ ID NO: 48642 - RNA, 18 nt, Artificial Sequence
  Description of Artificial Sequence: Synthetic oligonucleotide
gaaauuaugccgguuuau

SEQ ID NO: 48643 - RNA, 18 nt, Artificial Sequence
  Description of Artificial Sequence: Synthetic oligonucleotide
agaaugaaauuaugccgg

SEQ ID NO: 48644 - RNA, 18 nt, Artificial Sequence
  Description of Artificial Sequence: Synthetic oligonucleotide
agagcagaaugaaauuau

SEQ ID NO: 48645 - RNA, 18 nt, Artificial Sequence
  Description of Artificial Sequence: Synthetic oligonucleotide
gggagagcagaaugaaau

SEQ ID NO: 48646 - RNA, 18 nt, Artificial Sequence
  Description of Artificial Sequence: Synthetic oligonucleotide
agguaagcaugggcuggg

SEQ ID NO: 48647 - RNA, 18 nt, Artificial Sequence
  Description of Artificial Sequence: Synthetic oligonucleotide
agcugagguaagcauggg

SEQ ID NO: 48648 - RNA, 18 nt, Artificial Sequence
  Description of Artificial Sequence: Synthetic oligonucleotide
ucaaaagcugagguaagc

SEQ ID NO: 48649 - RNA, 18 nt, Artificial Sequence
  Description of Artificial Sequence: Synthetic oligonucleotide
auaccucaaaagcugagg

SEQ ID NO: 48650 - RNA, 18 nt, Artificial Sequence
  Description of Artificial Sequence: Synthetic oligonucleotide
aacaaauaccucaaaagc

SEQ ID NO: 48651 - RNA, 18 nt, Artificial Sequence
  Description of Artificial Sequence: Synthetic oligonucleotide
gaauaaacaaauaccuca

SEQ ID NO: 48652 - RNA, 18 nt, Artificial Sequence
  Description of Artificial Sequence: Synthetic oligonucleotide
augaagaauaaacaaaua

SEQ ID NO: 48653 - RNA, 18 nt, Artificial Sequence
  Description of Artificial Sequence: Synthetic oligonucleotide
uaaacaugaagaauaaac

SEQ ID NO: 48654 - RNA, 18 nt, Artificial Sequence
  Description of Artificial Sequence: Synthetic oligonucleotide
auucauaaacaugaagaa

SEQ ID NO: 48655 - RNA, 18 nt, Artificial Sequence
  Description of Artificial Sequence: Synthetic oligonucleotide
auauuauucauaaacaug

SEQ ID NO: 48656 - RNA, 18 nt, Artificial Sequence
  Description of Artificial Sequence: Synthetic oligonucleotide
aauauauauuauucauaa

SEQ ID NO: 48657 - RNA, 18 nt, Artificial Sequence
  Description of Artificial Sequence: Synthetic oligonucleotide
aaaucaauauauauuauu

SEQ ID NO: 48658 - RNA, 18 nt, Artificial Sequence
  Description of Artificial Sequence: Synthetic oligonucleotide
uuuuaaaaucaauauaua

SEQ ID NO: 48659 - RNA, 18 nt, Artificial Sequence
  Description of Artificial Sequence: Synthetic oligonucleotide
uugccuuuuaaaaucaau

SEQ ID NO: 48660 - RNA, 18 nt, Artificial Sequence
  Description of Artificial Sequence: Synthetic oligonucleotide
agcauuugccuuuuaaaa

SEQ ID NO: 48661 - RNA, 18 nt, Artificial Sequence
  Description of Artificial Sequence: Synthetic oligonucleotide
uaaauagcauuugccuuu

SEQ ID NO: 48662 - RNA, 18 nt, Artificial Sequence
  Description of Artificial Sequence: Synthetic oligonucleotide
aggaguaaauagcauuug

SEQ ID NO: 48663 - RNA, 18 nt, Artificial Sequence
  Description of Artificial Sequence: Synthetic oligonucleotide
uagggaggaguaaauagc

SEQ ID NO: 48664 - RNA, 18 nt, Artificial Sequence
  Description of Artificial Sequence: Synthetic oligonucleotide
ugaguuagggaggaguaa

SEQ ID NO: 48665 - RNA, 18 nt, Artificial Sequence
  Description of Artificial Sequence: Synthetic oligonucleotide
aaaugugaguuagggagg

SEQ ID NO: 48666 - RNA, 18 nt, Artificial Sequence
  Description of Artificial Sequence: Synthetic oligonucleotide
ugaguaaaugugaguuag

SEQ ID NO: 48667 - RNA, 18 nt, Artificial Sequence
  Description of Artificial Sequence: Synthetic oligonucleotide
ucaauugaguaaauguga

SEQ ID NO: 48668 - RNA, 18 nt, Artificial Sequence
  Description of Artificial Sequence: Synthetic oligonucleotide
aauacucaauugaguaaa

SEQ ID NO: 48669 - RNA, 18 nt, Artificial Sequence
  Description of Artificial Sequence: Synthetic oligonucleotide
agcauuugccuuuuaaaa

SEQ ID NO: 48670 - RNA, 18 nt, Artificial Sequence
  Description of Artificial Sequence: Synthetic oligonucleotide
uaaauagcauuugccuuu

SEQ ID NO: 48671 - RNA, 18 nt, Artificial Sequence
  Description of Artificial Sequence: Synthetic oligonucleotide
aggaguaaauagcauuug

SEQ ID NO: 48672 - RNA, 18 nt, Artificial Sequence
  Description of Artificial Sequence: Synthetic oligonucleotide
uagggaggaguaaauagc

SEQ ID NO: 48673 - RNA, 18 nt, Artificial Sequence
  Description of Artificial Sequence: Synthetic oligonucleotide
ugaguuagggaggaguaa

SEQ ID NO: 48674 - RNA, 18 nt, Artificial Sequence
  Description of Artificial Sequence: Synthetic oligonucleotide
aaaugugaguuagggagg

SEQ ID NO: 48675 - RNA, 18 nt, Artificial Sequence
  Description of Artificial Sequence: Synthetic oligonucleotide
ugaguaaaugugaguuag

SEQ ID NO: 48676 - RNA, 18 nt, Artificial Sequence
  Description of Artificial Sequence: Synthetic oligonucleotide
ucaauugaguaaauguga

SEQ ID NO: 48677 - RNA, 18 nt, Artificial Sequence
  Description of Artificial Sequence: Synthetic oligonucleotide
aauacucaauugaguaaa

SEQ ID NO: 48678 - RNA, 18 nt, Artificial Sequence
  Description of Artificial Sequence: Synthetic oligonucleotide
uaaaaaauacucaauuga

SEQ ID NO: 48679 - RNA, 18 nt, Artificial Sequence
  Description of Artificial Sequence: Synthetic oligonucleotide
uucuuuaaaaaauacuca

SEQ ID NO: 48680 - RNA, 18 nt, Artificial Sequence
  Description of Artificial Sequence: Synthetic oligonucleotide
ucuucuucuuuaaaaaau

SEQ ID NO: 48681 - RNA, 18 nt, Artificial Sequence
  Description of Artificial Sequence: Synthetic oligonucleotide
uuacuucuucuucuuuaa

SEQ ID NO: 48682 - RNA, 18 nt, Artificial Sequence
  Description of Artificial Sequence: Synthetic oligonucleotide
uuuuuuuacuucuucuuc

SEQ ID NO: 48683 - RNA, 18 nt, Artificial Sequence
  Description of Artificial Sequence: Synthetic oligonucleotide
acugauuuuuuuacuucu

SEQ ID NO: 48684 - RNA, 18 nt, Artificial Sequence
  Description of Artificial Sequence: Synthetic oligonucleotide
aauaaacugauuuuuuua

SEQ ID NO: 48685 - RNA, 18 nt, Artificial Sequence
  Description of Artificial Sequence: Synthetic oligonucleotide
uaaaaaauaaacugauuu

SEQ ID NO: 48686 - RNA, 18 nt, Artificial Sequence
  Description of Artificial Sequence: Synthetic oligonucleotide
aaagguaaaaaauaaacu

SEQ ID NO: 48687 - RNA, 18 nt, Artificial Sequence
  Description of Artificial Sequence: Synthetic oligonucleotide
agaacaaagguaaaaaau

SEQ ID NO: 48688 - RNA, 18 nt, Artificial Sequence
  Description of Artificial Sequence: Synthetic oligonucleotide
uuuaaagaacaaagguaa

SEQ ID NO: 48689 - RNA, 18 nt, Artificial Sequence
  Description of Artificial Sequence: Synthetic oligonucleotide
uauguuuuaaagaacaaa

SEQ ID NO: 48690 - RNA, 18 nt, Artificial Sequence
  Description of Artificial Sequence: Synthetic oligonucleotide
ggcguuauguuuuaaaga

SEQ ID NO: 48691 - RNA, 18 nt, Artificial Sequence
  Description of Artificial Sequence: Synthetic oligonucleotide
aaaguggcguuauguuuu

SEQ ID NO: 48692 - RNA, 18 nt, Artificial Sequence
  Description of Artificial Sequence: Synthetic oligonucleotide
ugcuuaaaguggcguuau

SEQ ID NO: 48693 - RNA, 18 nt, Artificial Sequence
  Description of Artificial Sequence: Synthetic oligonucleotide
gaccuugcuuaaaguggc

SEQ ID NO: 48694 - RNA, 18 nt, Artificial Sequence
  Description of Artificial Sequence: Synthetic oligonucleotide
gugcugaccuugcuuaaa

SEQ ID NO: 48695 - RNA, 18 nt, Artificial Sequence
  Description of Artificial Sequence: Synthetic oligonucleotide
uuuuugugcugaccuugc

SEQ ID NO: 48696 - RNA, 18 nt, Artificial Sequence
  Description of Artificial Sequence: Synthetic oligonucleotide
auuuauuuuugugcugac

SEQ ID NO: 48697 - RNA, 18 nt, Artificial Sequence
  Description of Artificial Sequence: Synthetic oligonucleotide
gauaaauuuauuuuugug

SEQ ID NO: 48698 - RNA, 18 nt, Artificial Sequence
  Description of Artificial Sequence: Synthetic oligonucleotide
aaguagauaaauuuauuu

SEQ ID NO: 48699 - RNA, 18 nt, Artificial Sequence
  Description of Artificial Sequence: Synthetic oligonucleotide
aaacgaaguagauaaauu

SEQ ID NO: 48700 - RNA, 18 nt, Artificial Sequence
  Description of Artificial Sequence: Synthetic oligonucleotide
caucaaaacgaaguagau

SEQ ID NO: 48701 - RNA, 18 nt, Artificial Sequence
  Description of Artificial Sequence: Synthetic oligonucleotide
agaugcaucaaaacgaag

SEQ ID NO: 48702 - RNA, 18 nt, Artificial Sequence
  Description of Artificial Sequence: Synthetic oligonucleotide
ccugaagaugcaucaaaa

SEQ ID NO: 48703 - RNA, 18 nt, Artificial Sequence
  Description of Artificial Sequence: Synthetic oligonucleotide
cacugccugaagaugcau

SEQ ID NO: 48704 - RNA, 18 nt, Artificial Sequence
  Description of Artificial Sequence: Synthetic oligonucleotide
uuaaacacugccugaaga

SEQ ID NO: 48705 - RNA, 18 nt, Artificial Sequence
  Description of Artificial Sequence: Synthetic oligonucleotide
uuuucuuaaacacugccu

SEQ ID NO: 48706 - RNA, 18 nt, Artificial Sequence
  Description of Artificial Sequence: Synthetic oligonucleotide
aaaacuuuucuuaaacac

SEQ ID NO: 48707 - RNA, 18 nt, Artificial Sequence
  Description of Artificial Sequence: Synthetic oligonucleotide
aaaaaaaaacuuuucuua

SEQ ID NO: 48708 - RNA, 18 nt, Artificial Sequence
  Description of Artificial Sequence: Synthetic oligonucleotide
uuuuaaaaaaaaaacuuu

SEQ ID NO: 48709 - RNA, 18 nt, Artificial Sequence
  Description of Artificial Sequence: Synthetic oligonucleotide
gcuuuuuuuaaaaaaaaa

SEQ ID NO: 48710 - RNA, 18 nt, Artificial Sequence
  Description of Artificial Sequence: Synthetic oligonucleotide
uaaaagcuuuuuuuaaaa

SEQ ID NO: 48711 - RNA, 18 nt, Artificial Sequence
  Description of Artificial Sequence: Synthetic oligonucleotide
gaauuuaaaagcuuuuuu

SEQ ID NO: 48712 - RNA, 18 nt, Artificial Sequence
  Description of Artificial Sequence: Synthetic oligonucleotide
aaaacgaauuuaaaagcu

SEQ ID NO: 48713 - RNA, 18 nt, Artificial Sequence
  Description of Artificial Sequence: Synthetic oligonucleotide
acuaaaaaacgaauuuaa

SEQ ID NO: 48714 - RNA, 18 nt, Artificial Sequence
  Description of Artificial Sequence: Synthetic oligonucleotide
uuugaacuaaaaaacgaa

SEQ ID NO: 48715 - RNA, 18 nt, Artificial Sequence
  Description of Artificial Sequence: Synthetic oligonucleotide
aacaauuugaacuaaaaa

SEQ ID NO: 48716 - RNA, 18 nt, Artificial Sequence
  Description of Artificial Sequence: Synthetic oligonucleotide
uuucaaacaauuugaacu

SEQ ID NO: 48717 - RNA, 18 nt, Artificial Sequence
  Description of Artificial Sequence: Synthetic oligonucleotide
gauacuuucaaacaauuu

SEQ ID NO: 48718 - RNA, 18 nt, Artificial Sequence
  Description of Artificial Sequence: Synthetic oligonucleotide
augaugauacuuucaaac

SEQ ID NO: 48719 - RNA, 18 nt, Artificial Sequence
  Description of Artificial Sequence: Synthetic oligonucleotide
caaauaugaugauacuuu

SEQ ID NO: 48720 - RNA, 18 nt, Artificial Sequence
  Description of Artificial Sequence: Synthetic oligonucleotide
aacuacaaauaugaugau

SEQ ID NO: 48721 - RNA, 18 nt, Artificial Sequence
  Description of Artificial Sequence: Synthetic oligonucleotide
cuaaaaacuacaaauaug

SEQ ID NO: 48722 - RNA, 18 nt, Artificial Sequence
  Description of Artificial Sequence: Synthetic oligonucleotide
uagcccuaaaaacuacaa

SEQ ID NO: 48723 - RNA, 18 nt, Artificial Sequence
  Description of Artificial Sequence: Synthetic oligonucleotide
auuuguagcccuaaaaac

SEQ ID NO: 48724 - RNA, 18 nt, Artificial Sequence
  Description of Artificial Sequence: Synthetic oligonucleotide
auuacauuuguagcccua

SEQ ID NO: 48725 - RNA, 18 nt, Artificial Sequence
  Description of Artificial Sequence: Synthetic oligonucleotide
uuaaaauuacauuuguag

SEQ ID NO: 48726 - RNA, 18 nt, Artificial Sequence
  Description of Artificial Sequence: Synthetic oligonucleotide
uuuucuuaaaauuacauu

SEQ ID NO: 48727 - RNA, 18 nt, Artificial Sequence
  Description of Artificial Sequence: Synthetic oligonucleotide
gcuuuuuuucuuaaaauu

SEQ ID NO: 48728 - RNA, 18 nt, Artificial Sequence
  Description of Artificial Sequence: Synthetic oligonucleotide
agagagcuuuuuuucuua

SEQ ID NO: 48729 - RNA, 18 nt, Artificial Sequence
  Description of Artificial Sequence: Synthetic oligonucleotide
acuguagagagcuuuuuu

SEQ ID NO: 48730 - RNA, 18 nt, Artificial Sequence
  Description of Artificial Sequence: Synthetic oligonucleotide
aacuuacuguagagagcu

SEQ ID NO: 48731 - RNA, 18 nt, Artificial Sequence
  Description of Artificial Sequence: Synthetic oligonucleotide
augagaacuuacuguaga

SEQ ID NO: 48732 - RNA, 18 nt, Artificial Sequence
  Description of Artificial Sequence: Synthetic oligonucleotide
augguaugagaacuuacu

SEQ ID NO: 48733 - RNA, 18 nt, Artificial Sequence
  Description of Artificial Sequence: Synthetic oligonucleotide
cuucaaugguaugagaac

SEQ ID NO: 48734 - RNA, 18 nt, Artificial Sequence
  Description of Artificial Sequence: Synthetic oligonucleotide
uauaccuucaaugguaug

SEQ ID NO: 48735 - RNA, 18 nt, Artificial Sequence
  Description of Artificial Sequence: Synthetic oligonucleotide
aaaaauauaccuucaaug

SEQ ID NO: 48736 - RNA, 18 nt, Artificial Sequence
  Description of Artificial Sequence: Synthetic oligonucleotide
aacacaaaaauauaccuu

SEQ ID NO: 48737 - RNA, 18 nt, Artificial Sequence
  Description of Artificial Sequence: Synthetic oligonucleotide
ucuauaacacaaaaauau

SEQ ID NO: 48738 - RNA, 18 nt, Artificial Sequence
  Description of Artificial Sequence: Synthetic oligonucleotide
augggucuauaacacaaa

SEQ ID NO: 48739 - RNA, 18 nt, Artificial Sequence
  Description of Artificial Sequence: Synthetic oligonucleotide
ucugcaugggucuauaac

SEQ ID NO: 48740 - RNA, 18 nt, Artificial Sequence
  Description of Artificial Sequence: Synthetic oligonucleotide
uugcaucugcaugggucu

SEQ ID NO: 48741 - RNA, 18 nt, Artificial Sequence
  Description of Artificial Sequence: Synthetic oligonucleotide
gacuuuugcaucugcaug

SEQ ID NO: 48742 - RNA, 18 nt, Artificial Sequence
  Description of Artificial Sequence: Synthetic oligonucleotide
acuuggacuuuugcaucu

SEQ ID NO: 48743 - RNA, 18 nt, Artificial Sequence
  Description of Artificial Sequence: Synthetic oligonucleotide
ccagcacuuggacuuuug

SEQ ID NO: 48744 - RNA, 18 nt, Artificial Sequence
  Description of Artificial Sequence: Synthetic oligonucleotide
auuguccagcacuuggac

SEQ ID NO: 48745 - RNA, 18 nt, Artificial Sequence
  Description of Artificial Sequence: Synthetic oligonucleotide
uuuugauuguccagcacu

SEQ ID NO: 48746 - RNA, 18 nt, Artificial Sequence
  Description of Artificial Sequence: Synthetic oligonucleotide
uuacguuuugauugucca

SEQ ID NO: 48747 - RNA, 18 nt, Artificial Sequence
  Description of Artificial Sequence: Synthetic oligonucleotide
caagcuuacguuuugauu

SEQ ID NO: 48748 - RNA, 18 nt, Artificial Sequence
  Description of Artificial Sequence: Synthetic oligonucleotide
aaugacaagcuuacguuu

SEQ ID NO: 48749 - RNA, 18 nt, Artificial Sequence
  Description of Artificial Sequence: Synthetic oligonucleotide
uaaacaaugacaagcuua

SEQ ID NO: 48750 - RNA, 18 nt, Artificial Sequence
  Description of Artificial Sequence: Synthetic oligonucleotide
ugcauuaaacaaugacaa

SEQ ID NO: 48751 - RNA, 18 nt, Artificial Sequence
  Description of Artificial Sequence: Synthetic oligonucleotide
aaguaugcauuaaacaau

SEQ ID NO: 48752 - RNA, 18 nt, Artificial Sequence
  Description of Artificial Sequence: Synthetic oligonucleotide
uguuuaaguaugcauuaa

SEQ ID NO: 48753 - RNA, 18 nt, Artificial Sequence
  Description of Artificial Sequence: Synthetic oligonucleotide
aaaauuguuuaaguaugc

SEQ ID NO: 48754 - RNA, 18 nt, Artificial Sequence
  Description of Artificial Sequence: Synthetic oligonucleotide
aaaauaaaauuguuuaag

SEQ ID NO: 48755 - RNA, 18 nt, Artificial Sequence
  Description of Artificial Sequence: Synthetic oligonucleotide
agacaaaaauaaaauugu

SEQ ID NO: 48756 - RNA, 18 nt, Artificial Sequence
  Description of Artificial Sequence: Synthetic oligonucleotide
uuucaagacaaaaauaaa

SEQ ID NO: 48757 - RNA, 18 nt, Artificial Sequence
  Description of Artificial Sequence: Synthetic oligonucleotide
aauaauuucaagacaaaa

SEQ ID NO: 48758 - RNA, 18 nt, Artificial Sequence
  Description of Artificial Sequence: Synthetic oligonucleotide
uuauuaauaauuucaaga

SEQ ID NO: 48759 - RNA, 18 nt, Artificial Sequence
  Description of Artificial Sequence: Synthetic oligonucleotide
ccacauuauuaauaauuu

SEQ ID NO: 48760 - RNA, 18 nt, Artificial Sequence
  Description of Artificial Sequence: Synthetic oligonucleotide
gaaaaccacauuauuaau

SEQ ID NO: 48761 - RNA, 18 nt, Artificial Sequence
  Description of Artificial Sequence: Synthetic oligonucleotide
ggacagaaaaccacauua

SEQ ID NO: 48762 - RNA, 18 nt, Artificial Sequence
  Description of Artificial Sequence: Synthetic oligonucleotide
ucacacauccguuggaca

SEQ ID NO: 48763 - RNA, 18 nt, Artificial Sequence
  Description of Artificial Sequence: Synthetic oligonucleotide
uuuacucacacauccguu

SEQ ID NO: 48764 - RNA, 18 nt, Artificial Sequence
  Description of Artificial Sequence: Synthetic oligonucleotide
agaauuuuacucacacau

SEQ ID NO: 48765 - RNA, 18 nt, Artificial Sequence
  Description of Artificial Sequence: Synthetic oligonucleotide
ugcccagaauuuuacuca

SEQ ID NO: 48766 - RNA, 18 nt, Artificial Sequence
  Description of Artificial Sequence: Synthetic oligonucleotide
auaccugcccagaauuuu

SEQ ID NO: 48767 - RNA, 18 nt, Artificial Sequence
  Description of Artificial Sequence: Synthetic oligonucleotide
ucguaauaccugcccaga

SEQ ID NO: 48768 - RNA, 18 nt, Artificial Sequence
  Description of Artificial Sequence: Synthetic oligonucleotide
cagucucguaauaccugc

SEQ ID NO: 48769 - RNA, 18 nt, Artificial Sequence
  Description of Artificial Sequence: Synthetic oligonucleotide
ggagccagucucguaaua

SEQ ID NO: 48770 - RNA, 18 nt, Artificial Sequence
  Description of Artificial Sequence: Synthetic oligonucleotide
cugauggagccagucucg

SEQ ID NO: 48771 - RNA, 18 nt, Artificial Sequence
  Description of Artificial Sequence: Synthetic oligonucleotide
ugggucugauggagccag

SEQ ID NO: 48772 - RNA, 18 nt, Artificial Sequence
  Description of Artificial Sequence: Synthetic oligonucleotide
ugcccugggucugaugga

SEQ ID NO: 48773 - RNA, 18 nt, Artificial Sequence
  Description of Artificial Sequence: Synthetic oligonucleotide
ccgauugcccugggucug

SEQ ID NO: 48774 - RNA, 18 nt, Artificial Sequence
  Description of Artificial Sequence: Synthetic oligonucleotide
uaccaccgauugcccugg

SEQ ID NO: 48775 - RNA, 18 nt, Artificial Sequence
  Description of Artificial Sequence: Synthetic oligonucleotide
uuuacuaccaccgauugc

SEQ ID NO: 48776 - RNA, 18 nt, Artificial Sequence
  Description of Artificial Sequence: Synthetic oligonucleotide
cucgguuuacuaccaccg

SEQ ID NO: 48777 - RNA, 18 nt, Artificial Sequence
  Description of Artificial Sequence: Synthetic oligonucleotide
cuacucucgguuuacuac

SEQ ID NO: 48778 - RNA, 18 nt, Artificial Sequence
  Description of Artificial Sequence: Synthetic oligonucleotide
agucgcuacucucgguuu

SEQ ID NO: 48779 - RNA, 18 nt, Artificial Sequence
  Description of Artificial Sequence: Synthetic oligonucleotide
ucuggagucgcuacucuc

SEQ ID NO: 48780 - RNA, 18 nt, Artificial Sequence
  Description of Artificial Sequence: Synthetic oligonucleotide
caacuucuggagucgcua

SEQ ID NO: 48781 - RNA, 18 nt, Artificial Sequence
  Description of Artificial Sequence: Synthetic oligonucleotide
gcuuacaacuucuggagu

SEQ ID NO: 48782 - RNA, 18 nt, Artificial Sequence
  Description of Artificial Sequence: Synthetic oligonucleotide
auuuugcuuacaacuucu

SEQ ID NO: 48783 - RNA, 18 nt, Artificial Sequence
  Description of Artificial Sequence: Synthetic oligonucleotide
gggcuauuuugcuuacaa

SEQ ID NO: 48784 - RNA, 18 nt, Artificial Sequence
  Description of Artificial Sequence: Synthetic oligonucleotide
auacugggcuauuuugcu

SEQ ID NO: 48785 - RNA, 18 nt, Artificial Sequence
  Description of Artificial Sequence: Synthetic oligonucleotide
cgcuuauacugggcuauu

SEQ ID NO: 48786 - RNA, 18 nt, Artificial Sequence
  Description of Artificial Sequence: Synthetic oligonucleotide
acucccgcuuauacuggg

SEQ ID NO: 48787 - RNA, 18 nt, Artificial Sequence
  Description of Artificial Sequence: Synthetic oligonucleotide
cgggcacucccgcuuaua

SEQ ID NO: 48788 - RNA, 18 nt, Artificial Sequence
  Description of Artificial Sequence: Synthetic oligonucleotide
auggacgggcacucccgc

SEQ ID NO: 48789 - RNA, 18 nt, Artificial Sequence
  Description of Artificial Sequence: Synthetic oligonucleotide
caaagauggacgggcacu

SEQ ID NO: 48790 - RNA, 18 nt, Artificial Sequence
  Description of Artificial Sequence: Synthetic oligonucleotide
ccaagcaaagauggacgg

SEQ ID NO: 48791 - RNA, 18 nt, Artificial Sequence
  Description of Artificial Sequence: Synthetic oligonucleotide
auuucccaagcaaagaug

SEQ ID NO: 48792 - RNA, 18 nt, Artificial Sequence
  Description of Artificial Sequence: Synthetic oligonucleotide
cucggauuucccaagcaa

SEQ ID NO: 48793 - RNA, 18 nt, Artificial Sequence
  Description of Artificial Sequence: Synthetic oligonucleotide
ucugucucggauuuccca

SEQ ID NO: 48794 - RNA, 18 nt, Artificial Sequence
  Description of Artificial Sequence: Synthetic oligonucleotide
aguaaucugucucggauu

SEQ ID NO: 48795 - RNA, 18 nt, Artificial Sequence
  Description of Artificial Sequence: Synthetic oligonucleotide
cggacaguaaucugucuc

SEQ ID NO: 48796 - RNA, 18 nt, Artificial Sequence
  Description of Artificial Sequence: Synthetic oligonucleotide
ccccucggacaguaaucu

SEQ ID NO: 48797 - RNA, 18 nt, Artificial Sequence
  Description of Artificial Sequence: Synthetic oligonucleotide
cagacccccucggacagu

SEQ ID NO: 48798 - RNA, 18 nt, Artificial Sequence
  Description of Artificial Sequence: Synthetic oligonucleotide
ugguacagacccccucgg

SEQ ID NO: 48799 - RNA, 18 nt, Artificial Sequence
  Description of Artificial Sequence: Synthetic oligonucleotide
aucguugguacagacccc

SEQ ID NO: 48800 - RNA, 18 nt, Artificial Sequence
  Description of Artificial Sequence: Synthetic oligonucleotide
auguuaucguugguacag

SEQ ID NO: 48801 - RNA, 18 nt, Artificial Sequence
  Description of Artificial Sequence: Synthetic oligonucleotide
uugguauguuaucguugg

SEQ ID NO: 48802 - RNA, 18 nt, Artificial Sequence
  Description of Artificial Sequence: Synthetic oligonucleotide
cacacauccguuggacac

SEQ ID NO: 48803 - RNA, 18 nt, Artificial Sequence
  Description of Artificial Sequence: Synthetic oligonucleotide
uuacucacacauccguug

SEQ ID NO: 48804 - RNA, 18 nt, Artificial Sequence
  Description of Artificial Sequence: Synthetic oligonucleotide
gaauuuuacucacacauc

SEQ ID NO: 48805 - RNA, 18 nt, Artificial Sequence
  Description of Artificial Sequence: Synthetic oligonucleotide
gcccagaauuuuacucac

SEQ ID NO: 48806 - RNA, 18 nt, Artificial Sequence
  Description of Artificial Sequence: Synthetic oligonucleotide
uaccugcccagaauuuua

SEQ ID NO: 48807 - RNA, 18 nt, Artificial Sequence
  Description of Artificial Sequence: Synthetic oligonucleotide
cguaauaccugcccagaa

SEQ ID NO: 48808 - RNA, 18 nt, Artificial Sequence
  Description of Artificial Sequence: Synthetic oligonucleotide
agucucguaauaccugcc

SEQ ID NO: 48809 - RNA, 18 nt, Artificial Sequence
  Description of Artificial Sequence: Synthetic oligonucleotide
gagccagucucguaauac

SEQ ID NO: 48810 - RNA, 18 nt, Artificial Sequence
  Description of Artificial Sequence: Synthetic oligonucleotide
ugauggagccagucucgu

SEQ ID NO: 48811 - RNA, 18 nt, Artificial Sequence
  Description of Artificial Sequence: Synthetic oligonucleotide
gggucugauggagccagu

SEQ ID NO: 48812 - RNA, 18 nt, Artificial Sequence
  Description of Artificial Sequence: Synthetic oligonucleotide
gcccugggucugauggag

SEQ ID NO: 48813 - RNA, 18 nt, Artificial Sequence
  Description of Artificial Sequence: Synthetic oligonucleotide
cgauugcccugggucuga

SEQ ID NO: 48814 - RNA, 18 nt, Artificial Sequence
  Description of Artificial Sequence: Synthetic oligonucleotide
accaccgauugcccuggg

SEQ ID NO: 48815 - RNA, 18 nt, Artificial Sequence
  Description of Artificial Sequence: Synthetic oligonucleotide
uuacuaccaccgauugcc

SEQ ID NO: 48816 - RNA, 18 nt, Artificial Sequence
  Description of Artificial Sequence: Synthetic oligonucleotide
ucgguuuacuaccaccga

SEQ ID NO: 48817 - RNA, 18 nt, Artificial Sequence
  Description of Artificial Sequence: Synthetic oligonucleotide
uacucucgguuuacuacc

SEQ ID NO: 48818 - RNA, 18 nt, Artificial Sequence
  Description of Artificial Sequence: Synthetic oligonucleotide
gucgcuacucucgguuua

SEQ ID NO: 48819 - RNA, 18 nt, Artificial Sequence
  Description of Artificial Sequence: Synthetic oligonucleotide
cuggagucgcuacucucg

SEQ ID NO: 48820 - RNA, 18 nt, Artificial Sequence
  Description of Artificial Sequence: Synthetic oligonucleotide
aacuucuggagucgcuac

SEQ ID NO: 48821 - RNA, 18 nt, Artificial Sequence
  Description of Artificial Sequence: Synthetic oligonucleotide
cuuacaacuucuggaguc

SEQ ID NO: 48822 - RNA, 18 nt, Artificial Sequence
  Description of Artificial Sequence: Synthetic oligonucleotide
uuuugcuuacaacuucug

SEQ ID NO: 48823 - RNA, 18 nt, Artificial Sequence
  Description of Artificial Sequence: Synthetic oligonucleotide
ggcuauuuugcuuacaac

SEQ ID NO: 48824 - RNA, 18 nt, Artificial Sequence
  Description of Artificial Sequence: Synthetic oligonucleotide
uacugggcuauuuugcuu

SEQ ID NO: 48825 - RNA, 18 nt, Artificial Sequence
  Description of Artificial Sequence: Synthetic oligonucleotide
gcuuauacugggcuauuu

SEQ ID NO: 48826 - RNA, 18 nt, Artificial Sequence
  Description of Artificial Sequence: Synthetic oligonucleotide
cucccgcuuauacugggc

SEQ ID NO: 48827 - RNA, 18 nt, Artificial Sequence
  Description of Artificial Sequence: Synthetic oligonucleotide
gggcacucccgcuuauac

SEQ ID NO: 48828 - RNA, 18 nt, Artificial Sequence
  Description of Artificial Sequence: Synthetic oligonucleotide
uggacgggcacucccgcu

SEQ ID NO: 48829 - RNA, 18 nt, Artificial Sequence
  Description of Artificial Sequence: Synthetic oligonucleotide
aaagauggacgggcacuc

SEQ ID NO: 48830 - RNA, 18 nt, Artificial Sequence
  Description of Artificial Sequence: Synthetic oligonucleotide
caagcaaagauggacggg

SEQ ID NO: 48831 - RNA, 18 nt, Artificial Sequence
  Description of Artificial Sequence: Synthetic oligonucleotide
uuucccaagcaaagaugg

SEQ ID NO: 48832 - RNA, 18 nt, Artificial Sequence
  Description of Artificial Sequence: Synthetic oligonucleotide
ucggauuucccaagcaaa

SEQ ID NO: 48833 - RNA, 18 nt, Artificial Sequence
  Description of Artificial Sequence: Synthetic oligonucleotide
cugucucggauuucccaa

SEQ ID NO: 48834 - RNA, 18 nt, Artificial Sequence
  Description of Artificial Sequence: Synthetic oligonucleotide
guaaucugucucggauuu

SEQ ID NO: 48835 - RNA, 18 nt, Artificial Sequence
  Description of Artificial Sequence: Synthetic oligonucleotide
ggacaguaaucugucucg

SEQ ID NO: 48836 - RNA, 18 nt, Artificial Sequence
  Description of Artificial Sequence: Synthetic oligonucleotide
cccucggacaguaaucug

SEQ ID NO: 48837 - RNA, 18 nt, Artificial Sequence
  Description of Artificial Sequence: Synthetic oligonucleotide
agacccccucggacagua

SEQ ID NO: 48838 - RNA, 18 nt, Artificial Sequence
  Description of Artificial Sequence: Synthetic oligonucleotide
gguacagacccccucgga

SEQ ID NO: 48839 - RNA, 18 nt, Artificial Sequence
  Description of Artificial Sequence: Synthetic oligonucleotide
ucguugguacagaccccc

SEQ ID NO: 48840 - RNA, 18 nt, Artificial Sequence
  Description of Artificial Sequence: Synthetic oligonucleotide
uguuaucguugguacaga

SEQ ID NO: 48841 - RNA, 18 nt, Artificial Sequence
  Description of Artificial Sequence: Synthetic oligonucleotide
ugguauguuaucguuggu

SEQ ID NO: 48842 - RNA, 18 nt, Artificial Sequence
  Description of Artificial Sequence: Synthetic oligonucleotide
gcagauguucucaaugaa

SEQ ID NO: 48843 - RNA, 18 nt, Artificial Sequence
  Description of Artificial Sequence: Synthetic oligonucleotide
ggagggcagauguucuca

SEQ ID NO: 48844 - RNA, 18 nt, Artificial Sequence
  Description of Artificial Sequence: Synthetic oligonucleotide
ggcagggagggcagaugu

SEQ ID NO: 48845 - RNA, 18 nt, Artificial Sequence
  Description of Artificial Sequence: Synthetic oligonucleotide
cuuagggcagggagggca

SEQ ID NO: 48846 - RNA, 18 nt, Artificial Sequence
  Description of Artificial Sequence: Synthetic oligonucleotide
uugggcuuagggcaggga

SEQ ID NO: 48847 - RNA, 18 nt, Artificial Sequence
  Description of Artificial Sequence: Synthetic oligonucleotide
gagcauugggcuuagggc

SEQ ID NO: 48848 - RNA, 18 nt, Artificial Sequence
  Description of Artificial Sequence: Synthetic oligonucleotide
ggagagagcauugggcuu

SEQ ID NO: 48849 - RNA, 18 nt, Artificial Sequence
  Description of Artificial Sequence: Synthetic oligonucleotide
aaagaggagagagcauug

SEQ ID NO: 48850 - RNA, 18 nt, Artificial Sequence
  Description of Artificial Sequence: Synthetic oligonucleotide
gagguaaagaggagagag

SEQ ID NO: 48851 - RNA, 18 nt, Artificial Sequence
  Description of Artificial Sequence: Synthetic oligonucleotide
gggaggagguaaagagga

SEQ ID NO: 48852 - RNA, 18 nt, Artificial Sequence
  Description of Artificial Sequence: Synthetic oligonucleotide
agggugggaggagguaaa

SEQ ID NO: 48853 - RNA, 18 nt, Artificial Sequence
  Description of Artificial Sequence: Synthetic oligonucleotide
gagagagggugggaggag

SEQ ID NO: 48854 - RNA, 18 nt, Artificial Sequence
  Description of Artificial Sequence: Synthetic oligonucleotide
guggagagagaggguggg

SEQ ID NO: 48855 - RNA, 18 nt, Artificial Sequence
  Description of Artificial Sequence: Synthetic oligonucleotide
agacaguggagagagagg

SEQ ID NO: 48856 - RNA, 18 nt, Artificial Sequence
  Description of Artificial Sequence: Synthetic oligonucleotide
cuaagagacaguggagag

SEQ ID NO: 48857 - RNA, 18 nt, Artificial Sequence
  Description of Artificial Sequence: Synthetic oligonucleotide
acagacuaagagacagug

SEQ ID NO: 48858 - RNA, 18 nt, Artificial Sequence
  Description of Artificial Sequence: Synthetic oligonucleotide
aggacacagacuaagaga

SEQ ID NO: 48859 - RNA, 18 nt, Artificial Sequence
  Description of Artificial Sequence: Synthetic oligonucleotide
gggagaggacacagacua

SEQ ID NO: 48860 - RNA, 18 nt, Artificial Sequence
  Description of Artificial Sequence: Synthetic oligonucleotide
gagcagggagaggacaca

SEQ ID NO: 48861 - RNA, 18 nt, Artificial Sequence
  Description of Artificial Sequence: Synthetic oligonucleotide
auguggagcagggagagg

SEQ ID NO: 48862 - RNA, 18 nt, Artificial Sequence
  Description of Artificial Sequence: Synthetic oligonucleotide
gacaaauguggagcaggg

SEQ ID NO: 48863 - RNA, 18 nt, Artificial Sequence
  Description of Artificial Sequence: Synthetic oligonucleotide
aaggagacaaauguggag

SEQ ID NO: 48864 - RNA, 18 nt, Artificial Sequence
  Description of Artificial Sequence: Synthetic oligonucleotide
guacaaaggagacaaaug

SEQ ID NO: 48865 - RNA, 18 nt, Artificial Sequence
  Description of Artificial Sequence: Synthetic oligonucleotide
cccagguacaaaggagac

SEQ ID NO: 48866 - RNA, 18 nt, Artificial Sequence
  Description of Artificial Sequence: Synthetic oligonucleotide
guucccccagguacaaag

SEQ ID NO: 48867 - RNA, 18 nt, Artificial Sequence
  Description of Artificial Sequence: Synthetic oligonucleotide
ucucuguucccccaggua

SEQ ID NO: 48868 - RNA, 18 nt, Artificial Sequence
  Description of Artificial Sequence: Synthetic oligonucleotide
auuccucucuguuccccc

SEQ ID NO: 48869 - RNA, 18 nt, Artificial Sequence
  Description of Artificial Sequence: Synthetic oligonucleotide
agggcauuccucucuguu

SEQ ID NO: 48870 - RNA, 18 nt, Artificial Sequence
  Description of Artificial Sequence: Synthetic oligonucleotide
aagucagggcauuccucu

SEQ ID NO: 48871 - RNA, 18 nt, Artificial Sequence
  Description of Artificial Sequence: Synthetic oligonucleotide
aagaaaagucagggcauu

SEQ ID NO: 48872 - RNA, 18 nt, Artificial Sequence
  Description of Artificial Sequence: Synthetic oligonucleotide
agucaaagaaaagucagg

SEQ ID NO: 48873 - RNA, 18 nt, Artificial Sequence
  Description of Artificial Sequence: Synthetic oligonucleotide
cagacagucaaagaaaag

SEQ ID NO: 48874 - RNA, 18 nt, Artificial Sequence
  Description of Artificial Sequence: Synthetic oligonucleotide
uuuuccagacagucaaag

SEQ ID NO: 48875 - RNA, 18 nt, Artificial Sequence
  Description of Artificial Sequence: Synthetic oligonucleotide
ucccauuuuccagacagu

SEQ ID NO: 48876 - RNA, 18 nt, Artificial Sequence
  Description of Artificial Sequence: Synthetic oligonucleotide
uugacucccauuuuccag

SEQ ID NO: 48877 - RNA, 18 nt, Artificial Sequence
  Description of Artificial Sequence: Synthetic oligonucleotide
cacacuugacucccauuu

SEQ ID NO: 48878 - RNA, 18 nt, Artificial Sequence
  Description of Artificial Sequence: Synthetic oligonucleotide
cuccccacacuugacucc

SEQ ID NO: 48879 - RNA, 18 nt, Artificial Sequence
  Description of Artificial Sequence: Synthetic oligonucleotide
aaugacuccccacacuug

SEQ ID NO: 48880 - RNA, 18 nt, Artificial Sequence
  Description of Artificial Sequence: Synthetic oligonucleotide
aagugaaugacuccccac

SEQ ID NO: 48881 - RNA, 18 nt, Artificial Sequence
  Description of Artificial Sequence: Synthetic oligonucleotide
aaaugaagugaaugacuc

SEQ ID NO: 48882 - RNA, 18 nt, Artificial Sequence
  Description of Artificial Sequence: Synthetic oligonucleotide
caugcaaaugaagugaau

SEQ ID NO: 48883 - RNA, 18 nt, Artificial Sequence
  Description of Artificial Sequence: Synthetic oligonucleotide
ugcagcaugcaaaugaag

SEQ ID NO: 48884 - RNA, 18 nt, Artificial Sequence
  Description of Artificial Sequence: Synthetic oligonucleotide
uguuuugcagcaugcaaa

SEQ ID NO: 48885 - RNA, 18 nt, Artificial Sequence
  Description of Artificial Sequence: Synthetic oligonucleotide
cccucuguuuugcagcau

SEQ ID NO: 48886 - RNA, 18 nt, Artificial Sequence
  Description of Artificial Sequence: Synthetic oligonucleotide
cuccgcccucuguuuugc

SEQ ID NO: 48887 - RNA, 18 nt, Artificial Sequence
  Description of Artificial Sequence: Synthetic oligonucleotide
ggugccuccgcccucugu

SEQ ID NO: 48888 - RNA, 18 nt, Artificial Sequence
  Description of Artificial Sequence: Synthetic oligonucleotide
ucccuggugccuccgccc

SEQ ID NO: 48889 - RNA, 18 nt, Artificial Sequence
  Description of Artificial Sequence: Synthetic oligonucleotide
gccuuucccuggugccuc

SEQ ID NO: 48890 - RNA, 18 nt, Artificial Sequence
  Description of Artificial Sequence: Synthetic oligonucleotide
caagugccuuucccuggu

SEQ ID NO: 48891 - RNA, 18 nt, Artificial Sequence
  Description of Artificial Sequence: Synthetic oligonucleotide
ucauucaagugccuuucc

SEQ ID NO: 48892 - RNA, 18 nt, Artificial Sequence
  Description of Artificial Sequence: Synthetic oligonucleotide
cuucuucauucaagugcc

SEQ ID NO: 48893 - RNA, 18 nt, Artificial Sequence
  Description of Artificial Sequence: Synthetic oligonucleotide
uuuuccuucuucauucaa

SEQ ID NO: 48894 - RNA, 18 nt, Artificial Sequence
  Description of Artificial Sequence: Synthetic oligonucleotide
ucucauuuuccuucuuca

SEQ ID NO: 48895 - RNA, 18 nt, Artificial Sequence
  Description of Artificial Sequence: Synthetic oligonucleotide
cugguucucauuuuccuu

SEQ ID NO: 48896 - RNA, 18 nt, Artificial Sequence
  Description of Artificial Sequence: Synthetic oligonucleotide
acaaucugguucucauuu

SEQ ID NO: 48897 - RNA, 18 nt, Artificial Sequence
  Description of Artificial Sequence: Synthetic oligonucleotide
aaguuacaaucugguucu

SEQ ID NO: 48898 - RNA, 18 nt, Artificial Sequence
  Description of Artificial Sequence: Synthetic oligonucleotide
ggacgaaguuacaaucug

SEQ ID NO: 48899 - RNA, 18 nt, Artificial Sequence
  Description of Artificial Sequence: Synthetic oligonucleotide
gauuaggacgaaguuaca

SEQ ID NO: 48900 - RNA, 18 nt, Artificial Sequence
  Description of Artificial Sequence: Synthetic oligonucleotide
agguggauuaggacgaag

SEQ ID NO: 48901 - RNA, 18 nt, Artificial Sequence
  Description of Artificial Sequence: Synthetic oligonucleotide
cuggcagguggauuagga

SEQ ID NO: 48902 - RNA, 18 nt, Artificial Sequence
  Description of Artificial Sequence: Synthetic oligonucleotide
aaguucuggcagguggau

SEQ ID NO: 48903 - RNA, 18 nt, Artificial Sequence
  Description of Artificial Sequence: Synthetic oligonucleotide
aaggaaaguucuggcagg

SEQ ID NO: 48904 - RNA, 18 nt, Artificial Sequence
  Description of Artificial Sequence: Synthetic oligonucleotide
accugaaggaaaguucug

SEQ ID NO: 48905 - RNA, 18 nt, Artificial Sequence
  Description of Artificial Sequence: Synthetic oligonucleotide
gugacaccugaaggaaag

SEQ ID NO: 48906 - RNA, 18 nt, Artificial Sequence
  Description of Artificial Sequence: Synthetic oligonucleotide
gaugugugacaccugaag

SEQ ID NO: 48907 - RNA, 18 nt, Artificial Sequence
  Description of Artificial Sequence: Synthetic oligonucleotide
aaauggaugugugacacc

SEQ ID NO: 48908 - RNA, 18 nt, Artificial Sequence
  Description of Artificial Sequence: Synthetic oligonucleotide
gauggaaauggaugugug

SEQ ID NO: 48909 - RNA, 18 nt, Artificial Sequence
  Description of Artificial Sequence: Synthetic oligonucleotide
auuaggauggaaauggau

SEQ ID NO: 48910 - RNA, 18 nt, Artificial Sequence
  Description of Artificial Sequence: Synthetic oligonucleotide
uuaauauuaggauggaaa

SEQ ID NO: 48911 - RNA, 18 nt, Artificial Sequence
  Description of Artificial Sequence: Synthetic oligonucleotide
auuguuuaauauuaggau

SEQ ID NO: 48912 - RNA, 18 nt, Artificial Sequence
  Description of Artificial Sequence: Synthetic oligonucleotide
auuauauuguuuaauauu

SEQ ID NO: 48913 - RNA, 18 nt, Artificial Sequence
  Description of Artificial Sequence: Synthetic oligonucleotide
cuuucauuauauuguuua

SEQ ID NO: 48914 - RNA, 18 nt, Artificial Sequence
  Description of Artificial Sequence: Synthetic oligonucleotide
gcuuucuuucauuauauu

SEQ ID NO: 48915 - RNA, 18 nt, Artificial Sequence
  Description of Artificial Sequence: Synthetic oligonucleotide
gaugugugacaccugaag

SEQ ID NO: 48916 - RNA, 18 nt, Artificial Sequence
  Description of Artificial Sequence: Synthetic oligonucleotide
aaauggaugugugacacc

SEQ ID NO: 48917 - RNA, 18 nt, Artificial Sequence
  Description of Artificial Sequence: Synthetic oligonucleotide
gauggaaauggaugugug

SEQ ID NO: 48918 - RNA, 18 nt, Artificial Sequence
  Description of Artificial Sequence: Synthetic oligonucleotide
auuaggauggaaauggau

SEQ ID NO: 48919 - RNA, 18 nt, Artificial Sequence
  Description of Artificial Sequence: Synthetic oligonucleotide
uuaauauuaggauggaaa

SEQ ID NO: 48920 - RNA, 18 nt, Artificial Sequence
  Description of Artificial Sequence: Synthetic oligonucleotide
auuguuuaauauuaggau

SEQ ID NO: 48921 - RNA, 18 nt, Artificial Sequence
  Description of Artificial Sequence: Synthetic oligonucleotide
auuauauuguuuaauauu

SEQ ID NO: 48922 - RNA, 18 nt, Artificial Sequence
  Description of Artificial Sequence: Synthetic oligonucleotide
cuuucauuauauuguuua

SEQ ID NO: 48923 - RNA, 18 nt, Artificial Sequence
  Description of Artificial Sequence: Synthetic oligonucleotide
gcuuucuuucauuauauu

SEQ ID NO: 48924 - RNA, 18 nt, Artificial Sequence
  Description of Artificial Sequence: Synthetic oligonucleotide
guaaagcuuucuuucauu

SEQ ID NO: 48925 - RNA, 18 nt, Artificial Sequence
  Description of Artificial Sequence: Synthetic oligonucleotide
uuguuguaaagcuuucuu

SEQ ID NO: 48926 - RNA, 18 nt, Artificial Sequence
  Description of Artificial Sequence: Synthetic oligonucleotide
uagacuuguuguaaagcu

SEQ ID NO: 48927 - RNA, 18 nt, Artificial Sequence
  Description of Artificial Sequence: Synthetic oligonucleotide
cuauuuagacuuguugua

SEQ ID NO: 48928 - RNA, 18 nt, Artificial Sequence
  Description of Artificial Sequence: Synthetic oligonucleotide
aaaaacuauuuagacuug

SEQ ID NO: 48929 - RNA, 18 nt, Artificial Sequence
  Description of Artificial Sequence: Synthetic oligonucleotide
aaaauaaaaacuauuuag

SEQ ID NO: 48930 - RNA, 18 nt, Artificial Sequence
  Description of Artificial Sequence: Synthetic oligonucleotide
gcccgaaaauaaaaacua

SEQ ID NO: 48931 - RNA, 18 nt, Artificial Sequence
  Description of Artificial Sequence: Synthetic oligonucleotide
agacugcccgaaaauaaa

SEQ ID NO: 48932 - RNA, 18 nt, Artificial Sequence
  Description of Artificial Sequence: Synthetic oligonucleotide
uuaaaagacugcccgaaa

SEQ ID NO: 48933 - RNA, 18 nt, Artificial Sequence
  Description of Artificial Sequence: Synthetic oligonucleotide
cuuuguuaaaagacugcc

SEQ ID NO: 48934 - RNA, 18 nt, Artificial Sequence
  Description of Artificial Sequence: Synthetic oligonucleotide
cuuugcuuuguuaaaaga

SEQ ID NO: 48935 - RNA, 18 nt, Artificial Sequence
  Description of Artificial Sequence: Synthetic oligonucleotide
gguugcuuugcuuuguua

SEQ ID NO: 48936 - RNA, 18 nt, Artificial Sequence
  Description of Artificial Sequence: Synthetic oligonucleotide
cacacgguugcuuugcuu

SEQ ID NO: 48937 - RNA, 18 nt, Artificial Sequence
  Description of Artificial Sequence: Synthetic oligonucleotide
uaacucacacgguugcuu

SEQ ID NO: 48938 - RNA, 18 nt, Artificial Sequence
  Description of Artificial Sequence: Synthetic oligonucleotide
ugaccuaacucacacggu

SEQ ID NO: 48939 - RNA, 18 nt, Artificial Sequence
  Description of Artificial Sequence: Synthetic oligonucleotide
ucuggugaccuaacucac

SEQ ID NO: 48940 - RNA, 18 nt, Artificial Sequence
  Description of Artificial Sequence: Synthetic oligonucleotide
gugucucuggugaccuaa

SEQ ID NO: 48941 - RNA, 18 nt, Artificial Sequence
  Description of Artificial Sequence: Synthetic oligonucleotide
gcuuggugucucugguga

SEQ ID NO: 48942 - RNA, 18 nt, Artificial Sequence
  Description of Artificial Sequence: Synthetic oligonucleotide
ccauugcuuggugucucu

SEQ ID NO: 48943 - RNA, 18 nt, Artificial Sequence
  Description of Artificial Sequence: Synthetic oligonucleotide
cuucaccauugcuuggug

SEQ ID NO: 48944 - RNA, 18 nt, Artificial Sequence
  Description of Artificial Sequence: Synthetic oligonucleotide
ggguccuucaccauugcu

SEQ ID NO: 48945 - RNA, 18 nt, Artificial Sequence
  Description of Artificial Sequence: Synthetic oligonucleotide
agagaauugggcggaggg

SEQ ID NO: 48946 - RNA, 18 nt, Artificial Sequence
  Description of Artificial Sequence: Synthetic oligonucleotide
ggauagagaauugggcgg

SEQ ID NO: 48947 - RNA, 18 nt, Artificial Sequence
  Description of Artificial Sequence: Synthetic oligonucleotide
uaguuggauagagaauug

SEQ ID NO: 48948 - RNA, 18 nt, Artificial Sequence
  Description of Artificial Sequence: Synthetic oligonucleotide
aaauuuaguuggauagag

SEQ ID NO: 48949 - RNA, 18 nt, Artificial Sequence
  Description of Artificial Sequence: Synthetic oligonucleotide
cauggaaauuuaguugga

SEQ ID NO: 48950 - RNA, 18 nt, Artificial Sequence
  Description of Artificial Sequence: Synthetic oligonucleotide
uugggcauggaaauuuag

SEQ ID NO: 48951 - RNA, 18 nt, Artificial Sequence
  Description of Artificial Sequence: Synthetic oligonucleotide
ucacuuugggcauggaaa

SEQ ID NO: 48952 - RNA, 18 nt, Artificial Sequence
  Description of Artificial Sequence: Synthetic oligonucleotide
agcuaucacuuugggcau

SEQ ID NO: 48953 - RNA, 18 nt, Artificial Sequence
  Description of Artificial Sequence: Synthetic oligonucleotide
augauagcuaucacuuug

SEQ ID NO: 48954 - RNA, 18 nt, Artificial Sequence
  Description of Artificial Sequence: Synthetic oligonucleotide
aaaaaaugauagcuauca

SEQ ID NO: 48955 - RNA, 18 nt, Artificial Sequence
  Description of Artificial Sequence: Synthetic oligonucleotide
cguggaaaaaaugauagc

SEQ ID NO: 48956 - RNA, 18 nt, Artificial Sequence
  Description of Artificial Sequence: Synthetic oligonucleotide
uacaccguggaaaaaaug

SEQ ID NO: 48957 - RNA, 18 nt, Artificial Sequence
  Description of Artificial Sequence: Synthetic oligonucleotide
gcagauacaccguggaaa

SEQ ID NO: 48958 - RNA, 18 nt, Artificial Sequence
  Description of Artificial Sequence: Synthetic oligonucleotide
gauuugcagauacaccgu

SEQ ID NO: 48959 - RNA, 18 nt, Artificial Sequence
  Description of Artificial Sequence: Synthetic oligonucleotide
ggguggauuugcagauac

SEQ ID NO: 48960 - RNA, 18 nt, Artificial Sequence
  Description of Artificial Sequence: Synthetic oligonucleotide
acaguggguggauuugca

SEQ ID NO: 48961 - RNA, 18 nt, Artificial Sequence
  Description of Artificial Sequence: Synthetic oligonucleotide
ccgggacaguggguggau

SEQ ID NO: 48962 - RNA, 18 nt, Artificial Sequence
  Description of Artificial Sequence: Synthetic oligonucleotide
ccaccccgggacaguggg

SEQ ID NO: 48963 - RNA, 18 nt, Artificial Sequence
  Description of Artificial Sequence: Synthetic oligonucleotide
cccagccaccccgggaca

SEQ ID NO: 48964 - RNA, 18 nt, Artificial Sequence
  Description of Artificial Sequence: Synthetic oligonucleotide
aagcucccagccaccccg

SEQ ID NO: 48965 - RNA, 18 nt, Artificial Sequence
  Description of Artificial Sequence: Synthetic oligonucleotide
uuaaaaagcucccagcca

SEQ ID NO: 48966 - RNA, 18 nt, Artificial Sequence
  Description of Artificial Sequence: Synthetic oligonucleotide
acccguuaaaaagcuccc

SEQ ID NO: 48967 - RNA, 18 nt, Artificial Sequence
  Description of Artificial Sequence: Synthetic oligonucleotide
ucucaacccguuaaaaag

SEQ ID NO: 48968 - RNA, 18 nt, Artificial Sequence
  Description of Artificial Sequence: Synthetic oligonucleotide
gcaacucucaacccguua

SEQ ID NO: 48969 - RNA, 18 nt, Artificial Sequence
  Description of Artificial Sequence: Synthetic oligonucleotide
aaaaagcaacucucaacc

SEQ ID NO: 48970 - RNA, 18 nt, Artificial Sequence
  Description of Artificial Sequence: Synthetic oligonucleotide
accuuaaaaagcaacucu

SEQ ID NO: 48971 - RNA, 18 nt, Artificial Sequence
  Description of Artificial Sequence: Synthetic oligonucleotide
ccacaaccuuaaaaagca

SEQ ID NO: 48972 - RNA, 18 nt, Artificial Sequence
  Description of Artificial Sequence: Synthetic oligonucleotide
cucacccacaaccuuaaa

SEQ ID NO: 48973 - RNA, 18 nt, Artificial Sequence
  Description of Artificial Sequence: Synthetic oligonucleotide
cucagcucacccacaacc

SEQ ID NO: 48974 - RNA, 18 nt, Artificial Sequence
  Description of Artificial Sequence: Synthetic oligonucleotide
cccaucucagcucaccca

SEQ ID NO: 48975 - RNA, 18 nt, Artificial Sequence
  Description of Artificial Sequence: Synthetic oligonucleotide
agucacccaucucagcuc

SEQ ID NO: 48976 - RNA, 18 nt, Artificial Sequence
  Description of Artificial Sequence: Synthetic oligonucleotide
gacacagucacccaucuc

SEQ ID NO: 48977 - RNA, 18 nt, Artificial Sequence
  Description of Artificial Sequence: Synthetic oligonucleotide
cugaagacacagucaccc

SEQ ID NO: 48978 - RNA, 18 nt, Artificial Sequence
  Description of Artificial Sequence: Synthetic oligonucleotide
gucuccugaagacacagu

SEQ ID NO: 48979 - RNA, 18 nt, Artificial Sequence
  Description of Artificial Sequence: Synthetic oligonucleotide
guagugucuccugaagac

SEQ ID NO: 48980 - RNA, 18 nt, Artificial Sequence
  Description of Artificial Sequence: Synthetic oligonucleotide
aaaugguagugucuccug

SEQ ID NO: 48981 - RNA, 18 nt, Artificial Sequence
  Description of Artificial Sequence: Synthetic oligonucleotide
aaaccaaaugguaguguc

SEQ ID NO: 48982 - RNA, 18 nt, Artificial Sequence
  Description of Artificial Sequence: Synthetic oligonucleotide
aaaucaaaccaaauggua

SEQ ID NO: 48983 - RNA, 18 nt, Artificial Sequence
  Description of Artificial Sequence: Synthetic oligonucleotide
cucuguuuauugaugaca

SEQ ID NO: 48984 - RNA, 18 nt, Artificial Sequence
  Description of Artificial Sequence: Synthetic oligonucleotide
aagaacucuguuuauuga

SEQ ID NO: 48985 - RNA, 18 nt, Artificial Sequence
  Description of Artificial Sequence: Synthetic oligonucleotide
uugcgaagaacucuguuu

SEQ ID NO: 48986 - RNA, 18 nt, Artificial Sequence
  Description of Artificial Sequence: Synthetic oligonucleotide
ccagguugcgaagaacuc

SEQ ID NO: 48987 - RNA, 18 nt, Artificial Sequence
  Description of Artificial Sequence: Synthetic oligonucleotide
gcuagccagguugcgaag

SEQ ID NO: 48988 - RNA, 18 nt, Artificial Sequence
  Description of Artificial Sequence: Synthetic oligonucleotide
uuuucgcuagccagguug

SEQ ID NO: 48989 - RNA, 18 nt, Artificial Sequence
  Description of Artificial Sequence: Synthetic oligonucleotide
guugcuuuucgcuagcca

SEQ ID NO: 48990 - RNA, 18 nt, Artificial Sequence
  Description of Artificial Sequence: Synthetic oligonucleotide
caucuguugcuuuucgcu

SEQ ID NO: 48991 - RNA, 18 nt, Artificial Sequence
  Description of Artificial Sequence: Synthetic oligonucleotide
gcgcccaucuguugcuuu

SEQ ID NO: 48992 - RNA, 18 nt, Artificial Sequence
  Description of Artificial Sequence: Synthetic oligonucleotide
cgucugcgcccaucuguu

SEQ ID NO: 48993 - RNA, 18 nt, Artificial Sequence
  Description of Artificial Sequence: Synthetic oligonucleotide
caugccgucugcgcccau

SEQ ID NO: 48994 - RNA, 18 nt, Artificial Sequence
  Description of Artificial Sequence: Synthetic oligonucleotide
ucauacaugccgucugcg

SEQ ID NO: 48995 - RNA, 18 nt, Artificial Sequence
  Description of Artificial Sequence: Synthetic oligonucleotide
guuuaucauacaugccgu

SEQ ID NO: 48996 - RNA, 18 nt, Artificial Sequence
  Description of Artificial Sequence: Synthetic oligonucleotide
ccuuaguuuaucauacau

SEQ ID NO: 48997 - RNA, 18 nt, Artificial Sequence
  Description of Artificial Sequence: Synthetic oligonucleotide
aacauccuuaguuuauca

SEQ ID NO: 48998 - RNA, 18 nt, Artificial Sequence
  Description of Artificial Sequence: Synthetic oligonucleotide
cguucaacauccuuaguu

SEQ ID NO: 48999 - RNA, 18 nt, Artificial Sequence
  Description of Artificial Sequence: Synthetic oligonucleotide
cugcccguucaacauccu

SEQ ID NO: 49000 - RNA, 18 nt, Artificial Sequence
  Description of Artificial Sequence: Synthetic oligonucleotide
ccggucugcccguucaac

SEQ ID NO: 49001 - RNA, 18 nt, Artificial Sequence
  Description of Artificial Sequence: Synthetic oligonucleotide
agcuuccggucugcccgu

SEQ ID NO: 49002 - RNA, 18 nt, Artificial Sequence
  Description of Artificial Sequence: Synthetic oligonucleotide
gccccagcuuccggucug

SEQ ID NO: 49003 - RNA, 18 nt, Artificial Sequence
  Description of Artificial Sequence: Synthetic oligonucleotide
cgggugccccagcuuccg

SEQ ID NO: 49004 - RNA, 18 nt, Artificial Sequence
  Description of Artificial Sequence: Synthetic oligonucleotide
cagggcgggugccccagc

SEQ ID NO: 49005 - RNA, 18 nt, Artificial Sequence
  Description of Artificial Sequence: Synthetic oligonucleotide
ccaaccagggcgggugcc

SEQ ID NO: 49006 - RNA, 18 nt, Artificial Sequence
  Description of Artificial Sequence: Synthetic oligonucleotide
ggauaccaaccagggcgg

SEQ ID NO: 49007 - RNA, 18 nt, Artificial Sequence
  Description of Artificial Sequence: Synthetic oligonucleotide
uccccggauaccaaccag

SEQ ID NO: 49008 - RNA, 18 nt, Artificial Sequence
  Description of Artificial Sequence: Synthetic oligonucleotide
cgaaguccccggauacca

SEQ ID NO: 49009 - RNA, 18 nt, Artificial Sequence
  Description of Artificial Sequence: Synthetic oligonucleotide
ggcaccgaaguccccgga

SEQ ID NO: 49010 - RNA, 18 nt, Artificial Sequence
  Description of Artificial Sequence: Synthetic oligonucleotide
gcccuggcaccgaagucc

SEQ ID NO: 49011 - RNA, 18 nt, Artificial Sequence
  Description of Artificial Sequence: Synthetic oligonucleotide
agguugcccuggcaccga

SEQ ID NO: 49012 - RNA, 18 nt, Artificial Sequence
  Description of Artificial Sequence: Synthetic oligonucleotide
ugcguagguugcccuggc

SEQ ID NO: 49013 - RNA, 18 nt, Artificial Sequence
  Description of Artificial Sequence: Synthetic oligonucleotide
gccgcgggauuccacggg

SEQ ID NO: 49014 - RNA, 18 nt, Artificial Sequence
  Description of Artificial Sequence: Synthetic oligonucleotide
augcuggcucuggcuggg

SEQ ID NO: 49015 - RNA, 18 nt, Artificial Sequence
  Description of Artificial Sequence: Synthetic oligonucleotide
ucugcaugcuggcucugg

SEQ ID NO: 49016 - RNA, 18 nt, Artificial Sequence
  Description of Artificial Sequence: Synthetic oligonucleotide
ccagaaagaccagaggca

SEQ ID NO: 49017 - RNA, 18 nt, Artificial Sequence
  Description of Artificial Sequence: Synthetic oligonucleotide
aagucccagaaagaccag

SEQ ID NO: 49018 - RNA, 18 nt, Artificial Sequence
  Description of Artificial Sequence: Synthetic oligonucleotide
gcccgaagucccagaaag

SEQ ID NO: 49019 - RNA, 18 nt, Artificial Sequence
  Description of Artificial Sequence: Synthetic oligonucleotide
cccgagcccgaaguccca

SEQ ID NO: 49020 - RNA, 18 nt, Artificial Sequence
  Description of Artificial Sequence: Synthetic oligonucleotide
cgcaccccgagcccgaag

SEQ ID NO: 49021 - RNA, 18 nt, Artificial Sequence
  Description of Artificial Sequence: Synthetic oligonucleotide
guccgcgcaccccgagcc

SEQ ID NO: 49022 - RNA, 18 nt, Artificial Sequence
  Description of Artificial Sequence: Synthetic oligonucleotide
cucggguccgcgcacccc

SEQ ID NO: 49023 - RNA, 18 nt, Artificial Sequence
  Description of Artificial Sequence: Synthetic oligonucleotide
ugacccucggguccgcgc

SEQ ID NO: 49024 - RNA, 18 nt, Artificial Sequence
  Description of Artificial Sequence: Synthetic oligonucleotide
uccccugacccucggguc

SEQ ID NO: 49025 - RNA, 18 nt, Artificial Sequence
  Description of Artificial Sequence: Synthetic oligonucleotide
uguccuccccugacccuc

SEQ ID NO: 49026 - RNA, 18 nt, Artificial Sequence
  Description of Artificial Sequence: Synthetic oligonucleotide
cccuguguccuccccuga

SEQ ID NO: 49027 - RNA, 18 nt, Artificial Sequence
  Description of Artificial Sequence: Synthetic oligonucleotide
cgagucccuguguccucc

SEQ ID NO: 49028 - RNA, 18 nt, Artificial Sequence
  Description of Artificial Sequence: Synthetic oligonucleotide
cgucgcgagucccugugu

SEQ ID NO: 49029 - RNA, 18 nt, Artificial Sequence
  Description of Artificial Sequence: Synthetic oligonucleotide
gcgggcgucgcgaguccc

SEQ ID NO: 49030 - RNA, 18 nt, Artificial Sequence
  Description of Artificial Sequence: Synthetic oligonucleotide
ccagcgcgggcgucgcga

SEQ ID NO: 49031 - RNA, 18 nt, Artificial Sequence
  Description of Artificial Sequence: Synthetic oligonucleotide
ccgggccagcgcgggcgu

SEQ ID NO: 49032 - RNA, 18 nt, Artificial Sequence
  Description of Artificial Sequence: Synthetic oligonucleotide
ggcggccgggccagcgcg

SEQ ID NO: 49033 - RNA, 18 nt, Artificial Sequence
  Description of Artificial Sequence: Synthetic oligonucleotide
cggucggcggccgggcca

SEQ ID NO: 49034 - RNA, 18 nt, Artificial Sequence
  Description of Artificial Sequence: Synthetic oligonucleotide
ucagucggucggcggccg

SEQ ID NO: 49035 - RNA, 18 nt, Artificial Sequence
  Description of Artificial Sequence: Synthetic oligonucleotide
gggccucagucggucggc

SEQ ID NO: 49036 - RNA, 18 nt, Artificial Sequence
  Description of Artificial Sequence: Synthetic oligonucleotide
uccccgggccucagucgg

SEQ ID NO: 49037 - RNA, 18 nt, Artificial Sequence
  Description of Artificial Sequence: Synthetic oligonucleotide
gcagguccccgggccuca

SEQ ID NO: 49038 - RNA, 18 nt, Artificial Sequence
  Description of Artificial Sequence: Synthetic oligonucleotide
ccgccgcagguccccggg

SEQ ID NO: 49039 - RNA, 18 nt, Artificial Sequence
  Description of Artificial Sequence: Synthetic oligonucleotide
agcagccgccgcaggucc

SEQ ID NO: 49040 - RNA, 18 nt, Artificial Sequence
  Description of Artificial Sequence: Synthetic oligonucleotide
gggagcagccgccgcagg

SEQ ID NO: 49041 - RNA, 18 nt, Artificial Sequence
  Description of Artificial Sequence: Synthetic oligonucleotide
ugccgggcgcggagcggg

SEQ ID NO: 49042 - RNA, 18 nt, Artificial Sequence
  Description of Artificial Sequence: Synthetic oligonucleotide
cgggcugccgggcgcgga

SEQ ID NO: 49043 - RNA, 18 nt, Artificial Sequence
  Description of Artificial Sequence: Synthetic oligonucleotide
ccucccgggcugccgggc

SEQ ID NO: 49044 - RNA, 18 nt, Artificial Sequence
  Description of Artificial Sequence: Synthetic oligonucleotide
ccuccccucccgggcugc

SEQ ID NO: 49045 - RNA, 18 nt, Artificial Sequence
  Description of Artificial Sequence: Synthetic oligonucleotide
aacgcccuccccucccgg

SEQ ID NO: 49046 - RNA, 18 nt, Artificial Sequence
  Description of Artificial Sequence: Synthetic oligonucleotide
aagcaaacgcccuccccu

SEQ ID NO: 49047 - RNA, 18 nt, Artificial Sequence
  Description of Artificial Sequence: Synthetic oligonucleotide
gagccaagcaaacgcccu

SEQ ID NO: 49048 - RNA, 18 nt, Artificial Sequence
  Description of Artificial Sequence: Synthetic oligonucleotide
gagaagagccaagcaaac

SEQ ID NO: 49049 - RNA, 18 nt, Artificial Sequence
  Description of Artificial Sequence: Synthetic oligonucleotide
guaucgagaagagccaag

SEQ ID NO: 49050 - RNA, 18 nt, Artificial Sequence
  Description of Artificial Sequence: Synthetic oligonucleotide
cuccaguaucgagaagag

SEQ ID NO: 49051 - RNA, 18 nt, Artificial Sequence
  Description of Artificial Sequence: Synthetic oligonucleotide
ugcuucuccaguaucgag

SEQ ID NO: 49052 - RNA, 18 nt, Artificial Sequence
  Description of Artificial Sequence: Synthetic oligonucleotide
gccccugcuucuccagua

SEQ ID NO: 49053 - RNA, 18 nt, Artificial Sequence
  Description of Artificial Sequence: Synthetic oligonucleotide
gcccagccccugcuucuc

SEQ ID NO: 49054 - RNA, 18 nt, Artificial Sequence
  Description of Artificial Sequence: Synthetic oligonucleotide
uaagggcccagccccugc

SEQ ID NO: 49055 - RNA, 18 nt, Artificial Sequence
  Description of Artificial Sequence: Synthetic oligonucleotide
guucuuaagggcccagcc

SEQ ID NO: 49056 - RNA, 18 nt, Artificial Sequence
  Description of Artificial Sequence: Synthetic oligonucleotide
gggcuguucuuaagggcc

SEQ ID NO: 49057 - RNA, 18 nt, Artificial Sequence
  Description of Artificial Sequence: Synthetic oligonucleotide
cgggcgggcuguucuuaa

SEQ ID NO: 49058 - RNA, 18 nt, Artificial Sequence
  Description of Artificial Sequence: Synthetic oligonucleotide
aaacucgggcgggcuguu

SEQ ID NO: 49059 - RNA, 18 nt, Artificial Sequence
  Description of Artificial Sequence: Synthetic oligonucleotide
uucgaaaacucgggcggg

SEQ ID NO: 49060 - RNA, 18 nt, Artificial Sequence
  Description of Artificial Sequence: Synthetic oligonucleotide
gcagcuucgaaaacucgg

SEQ ID NO: 49061 - RNA, 18 nt, Artificial Sequence
  Description of Artificial Sequence: Synthetic oligonucleotide
cuaccgcagcuucgaaaa

SEQ ID NO: 49062 - RNA, 18 nt, Artificial Sequence
  Description of Artificial Sequence: Synthetic oligonucleotide
uuucucuaccgcagcuuc

SEQ ID NO: 49063 - RNA, 18 nt, Artificial Sequence
  Description of Artificial Sequence: Synthetic oligonucleotide
ggguuucucuaccgcagc

SEQ ID NO: 49064 - RNA, 18 nt, Artificial Sequence
  Description of Artificial Sequence: Synthetic oligonucleotide
ugaguuacaggauuuggg

SEQ ID NO: 49065 - RNA, 18 nt, Artificial Sequence
  Description of Artificial Sequence: Synthetic oligonucleotide
gggugugaguuacaggau

SEQ ID NO: 49066 - RNA, 18 nt, Artificial Sequence
  Description of Artificial Sequence: Synthetic oligonucleotide
gggucagagcccgggcag

SEQ ID NO: 49067 - RNA, 18 nt, Artificial Sequence
  Description of Artificial Sequence: Synthetic oligonucleotide
ccagccccucucuccggg

SEQ ID NO: 49068 - RNA, 18 nt, Artificial Sequence
  Description of Artificial Sequence: Synthetic oligonucleotide
ucagcccagccccucucu

SEQ ID NO: 49069 - RNA, 18 nt, Artificial Sequence
  Description of Artificial Sequence: Synthetic oligonucleotide
ccugaucagcccagcccc

SEQ ID NO: 49070 - RNA, 18 nt, Artificial Sequence
  Description of Artificial Sequence: Synthetic oligonucleotide
cccgcccugaucagccca

SEQ ID NO: 49071 - RNA, 18 nt, Artificial Sequence
  Description of Artificial Sequence: Synthetic oligonucleotide
uucgccccgcccugauca

SEQ ID NO: 49072 - RNA, 18 nt, Artificial Sequence
  Description of Artificial Sequence: Synthetic oligonucleotide
aagacuucgccccgcccu

SEQ ID NO: 49073 - RNA, 18 nt, Artificial Sequence
  Description of Artificial Sequence: Synthetic oligonucleotide
aggagaagacuucgcccc

SEQ ID NO: 49074 - RNA, 18 nt, Artificial Sequence
  Description of Artificial Sequence: Synthetic oligonucleotide
caacuaggagaagacuuc

SEQ ID NO: 49075 - RNA, 18 nt, Artificial Sequence
  Description of Artificial Sequence: Synthetic oligonucleotide
ucgcucaacuaggagaag

SEQ ID NO: 49076 - RNA, 18 nt, Artificial Sequence
  Description of Artificial Sequence: Synthetic oligonucleotide
ccuucucgcucaacuagg

SEQ ID NO: 49077 - RNA, 18 nt, Artificial Sequence
  Description of Artificial Sequence: Synthetic oligonucleotide
ggccuccuucucgcucaa

SEQ ID NO: 49078 - RNA, 18 nt, Artificial Sequence
  Description of Artificial Sequence: Synthetic oligonucleotide
gggccuccuucucgcuca

SEQ ID NO: 49079 - RNA, 18 nt, Artificial Sequence
  Description of Artificial Sequence: Synthetic oligonucleotide
uuggcuaagcccaaaggg

SEQ ID NO: 49080 - RNA, 18 nt, Artificial Sequence
  Description of Artificial Sequence: Synthetic oligonucleotide
cagucuuggcuaagccca

SEQ ID NO: 49081 - RNA, 18 nt, Artificial Sequence
  Description of Artificial Sequence: Synthetic oligonucleotide
acuuucagucuuggcuaa

SEQ ID NO: 49082 - RNA, 18 nt, Artificial Sequence
  Description of Artificial Sequence: Synthetic oligonucleotide
uggagacuuucagucuug

SEQ ID NO: 49083 - RNA, 18 nt, Artificial Sequence
  Description of Artificial Sequence: Synthetic oligonucleotide
guugguggagacuuucag

SEQ ID NO: 49084 - RNA, 18 nt, Artificial Sequence
  Description of Artificial Sequence: Synthetic oligonucleotide
gccggguugguggagacu

SEQ ID NO: 49085 - RNA, 18 nt, Artificial Sequence
  Description of Artificial Sequence: Synthetic oligonucleotide
accccgccggguuggugg

SEQ ID NO: 49086 - RNA, 18 nt, Artificial Sequence
  Description of Artificial Sequence: Synthetic oligonucleotide
ccccaaccccgccggguu

SEQ ID NO: 49087 - RNA, 18 nt, Artificial Sequence
  Description of Artificial Sequence: Synthetic oligonucleotide
gaagcccccaaccccgcc

SEQ ID NO: 49088 - RNA, 18 nt, Artificial Sequence
  Description of Artificial Sequence: Synthetic oligonucleotide
ggagagaagcccccaacc

SEQ ID NO: 49089 - RNA, 18 nt, Artificial Sequence
  Description of Artificial Sequence: Synthetic oligonucleotide
gggagagaagcccccaac

SEQ ID NO: 49090 - RNA, 18 nt, Artificial Sequence
  Description of Artificial Sequence: Synthetic oligonucleotide
cccugagagugacuuggg

SEQ ID NO: 49091 - RNA, 18 nt, Artificial Sequence
  Description of Artificial Sequence: Synthetic oligonucleotide
agcugcccugagagugac

SEQ ID NO: 49092 - RNA, 18 nt, Artificial Sequence
  Description of Artificial Sequence: Synthetic oligonucleotide
ggaggagcugcccugaga

SEQ ID NO: 49093 - RNA, 18 nt, Artificial Sequence
  Description of Artificial Sequence: Synthetic oligonucleotide
gggaggagcugcccugag

SEQ ID NO: 49094 - RNA, 18 nt, Artificial Sequence
  Description of Artificial Sequence: Synthetic oligonucleotide
uucuaggcccguaguggg

SEQ ID NO: 49095 - RNA, 18 nt, Artificial Sequence
  Description of Artificial Sequence: Synthetic oligonucleotide
aucccuucuaggcccgua

SEQ ID NO: 49096 - RNA, 18 nt, Artificial Sequence
  Description of Artificial Sequence: Synthetic oligonucleotide
uccccaucccuucuaggc

SEQ ID NO: 49097 - RNA, 18 nt, Artificial Sequence
  Description of Artificial Sequence: Synthetic oligonucleotide
uggguucuacagauccca

SEQ ID NO: 49098 - RNA, 18 nt, Artificial Sequence
  Description of Artificial Sequence: Synthetic oligonucleotide
aaccauggguucuacaga

SEQ ID NO: 49099 - RNA, 18 nt, Artificial Sequence
  Description of Artificial Sequence: Synthetic oligonucleotide
ccgcaaaccauggguucu

SEQ ID NO: 49100 - RNA, 18 nt, Artificial Sequence
  Description of Artificial Sequence: Synthetic oligonucleotide
ugucaccgcaaaccaugg

SEQ ID NO: 49101 - RNA, 18 nt, Artificial Sequence
  Description of Artificial Sequence: Synthetic oligonucleotide
cugagugucaccgcaaac

SEQ ID NO: 49102 - RNA, 18 nt, Artificial Sequence
  Description of Artificial Sequence: Synthetic oligonucleotide
ccccucugagugucaccg

SEQ ID NO: 49103 - RNA, 18 nt, Artificial Sequence
  Description of Artificial Sequence: Synthetic oligonucleotide
aagauccccucugagugu

SEQ ID NO: 49104 - RNA, 18 nt, Artificial Sequence
  Description of Artificial Sequence: Synthetic oligonucleotide
ucccaaagauccccucug

SEQ ID NO: 49105 - RNA, 18 nt, Artificial Sequence
  Description of Artificial Sequence: Synthetic oligonucleotide
aaaucucccaaagauccc

SEQ ID NO: 49106 - RNA, 18 nt, Artificial Sequence
  Description of Artificial Sequence: Synthetic oligonucleotide
ucuauaaaucucccaaag

SEQ ID NO: 49107 - RNA, 18 nt, Artificial Sequence
  Description of Artificial Sequence: Synthetic oligonucleotide
ccggcucuauaaaucucc

SEQ ID NO: 49108 - RNA, 18 nt, Artificial Sequence
  Description of Artificial Sequence: Synthetic oligonucleotide
aagaaccggcucuauaaa

SEQ ID NO: 49109 - RNA, 18 nt, Artificial Sequence
  Description of Artificial Sequence: Synthetic oligonucleotide
gcgcuaagaaccggcucu

SEQ ID NO: 49110 - RNA, 18 nt, Artificial Sequence
  Description of Artificial Sequence: Synthetic oligonucleotide
acaaagcgcuaagaaccg

SEQ ID NO: 49111 - RNA, 18 nt, Artificial Sequence
  Description of Artificial Sequence: Synthetic oligonucleotide
aacccacaaagcgcuaag

SEQ ID NO: 49112 - RNA, 18 nt, Artificial Sequence
  Description of Artificial Sequence: Synthetic oligonucleotide
cucugaacccacaaagcg

SEQ ID NO: 49113 - RNA, 18 nt, Artificial Sequence
  Description of Artificial Sequence: Synthetic oligonucleotide
ccagccucugaacccaca

SEQ ID NO: 49114 - RNA, 18 nt, Artificial Sequence
  Description of Artificial Sequence: Synthetic oligonucleotide
ugcagccagccucugaac

SEQ ID NO: 49115 - RNA, 18 nt, Artificial Sequence
  Description of Artificial Sequence: Synthetic oligonucleotide
aacacugcagccagccuc

SEQ ID NO: 49116 - RNA, 18 nt, Artificial Sequence
  Description of Artificial Sequence: Synthetic oligonucleotide
ucauaaacacugcagcca

SEQ ID NO: 49117 - RNA, 18 nt, Artificial Sequence
  Description of Artificial Sequence: Synthetic oligonucleotide
ccucuucauaaacacugc

SEQ ID NO: 49118 - RNA, 18 nt, Artificial Sequence
  Description of Artificial Sequence: Synthetic oligonucleotide
cugccccucuucauaaac

SEQ ID NO: 49119 - RNA, 18 nt, Artificial Sequence
  Description of Artificial Sequence: Synthetic oligonucleotide
gcccacugccccucuuca

SEQ ID NO: 49120 - RNA, 18 nt, Artificial Sequence
  Description of Artificial Sequence: Synthetic oligonucleotide
ccccagcccacugccccu

SEQ ID NO: 49121 - RNA, 18 nt, Artificial Sequence
  Description of Artificial Sequence: Synthetic oligonucleotide
aguguccccagcccacug

SEQ ID NO: 49122 - RNA, 18 nt, Artificial Sequence
  Description of Artificial Sequence: Synthetic oligonucleotide
ccagcaguguccccagcc

SEQ ID NO: 49123 - RNA, 18 nt, Artificial Sequence
  Description of Artificial Sequence: Synthetic oligonucleotide
uaaccccagcaguguccc

SEQ ID NO: 49124 - RNA, 18 nt, Artificial Sequence
  Description of Artificial Sequence: Synthetic oligonucleotide
agccauaaccccagcagu

SEQ ID NO: 49125 - RNA, 18 nt, Artificial Sequence
  Description of Artificial Sequence: Synthetic oligonucleotide
acuacagccauaacccca

SEQ ID NO: 49126 - RNA, 18 nt, Artificial Sequence
  Description of Artificial Sequence: Synthetic oligonucleotide
accucacuacagccauaa

SEQ ID NO: 49127 - RNA, 18 nt, Artificial Sequence
  Description of Artificial Sequence: Synthetic oligonucleotide
cauggaccucacuacagc

SEQ ID NO: 49128 - RNA, 18 nt, Artificial Sequence
  Description of Artificial Sequence: Synthetic oligonucleotide
guacacauggaccucacu

SEQ ID NO: 49129 - RNA, 18 nt, Artificial Sequence
  Description of Artificial Sequence: Synthetic oligonucleotide
aacaaguacacauggacc

SEQ ID NO: 49130 - RNA, 18 nt, Artificial Sequence
  Description of Artificial Sequence: Synthetic oligonucleotide
caaggaacaaguacacau

SEQ ID NO: 49131 - RNA, 18 nt, Artificial Sequence
  Description of Artificial Sequence: Synthetic oligonucleotide
caugccaaggaacaagua

SEQ ID NO: 49132 - RNA, 18 nt, Artificial Sequence
  Description of Artificial Sequence: Synthetic oligonucleotide
agacacaugccaaggaac

SEQ ID NO: 49133 - RNA, 18 nt, Artificial Sequence
  Description of Artificial Sequence: Synthetic oligonucleotide
gagucagacacaugccaa

SEQ ID NO: 49134 - RNA, 18 nt, Artificial Sequence
  Description of Artificial Sequence: Synthetic oligonucleotide
acacagagucagacacau

SEQ ID NO: 49135 - RNA, 18 nt, Artificial Sequence
  Description of Artificial Sequence: Synthetic oligonucleotide
cagcaacacagagucaga

SEQ ID NO: 49136 - RNA, 18 nt, Artificial Sequence
  Description of Artificial Sequence: Synthetic oligonucleotide
ugcagcagcaacacagag

SEQ ID NO: 49137 - RNA, 18 nt, Artificial Sequence
  Description of Artificial Sequence: Synthetic oligonucleotide
uguacugcagcagcaaca

SEQ ID NO: 49138 - RNA, 18 nt, Artificial Sequence
  Description of Artificial Sequence: Synthetic oligonucleotide
cccacuguacugcagcag

SEQ ID NO: 49139 - RNA, 18 nt, Artificial Sequence
  Description of Artificial Sequence: Synthetic oligonucleotide
cccugcccacuguacugc

SEQ ID NO: 49140 - RNA, 18 nt, Artificial Sequence
  Description of Artificial Sequence: Synthetic oligonucleotide
cgugccccugcccacugu

SEQ ID NO: 49141 - RNA, 18 nt, Artificial Sequence
  Description of Artificial Sequence: Synthetic oligonucleotide
gcaaccgugccccugccc

SEQ ID NO: 49142 - RNA, 18 nt, Artificial Sequence
  Description of Artificial Sequence: Synthetic oligonucleotide
uccaagcaaccgugcccc

SEQ ID NO: 49143 - RNA, 18 nt, Artificial Sequence
  Description of Artificial Sequence: Synthetic oligonucleotide
cccaguccaagcaaccgu

SEQ ID NO: 49144 - RNA, 18 nt, Artificial Sequence
  Description of Artificial Sequence: Synthetic oligonucleotide
ggcagcccaguccaagca

SEQ ID NO: 49145 - RNA, 18 nt, Artificial Sequence
  Description of Artificial Sequence: Synthetic oligonucleotide
caucgggcagcccagucc

SEQ ID NO: 49146 - RNA, 18 nt, Artificial Sequence
  Description of Artificial Sequence: Synthetic oligonucleotide
ccagacaucgggcagccc

SEQ ID NO: 49147 - RNA, 18 nt, Artificial Sequence
  Description of Artificial Sequence: Synthetic oligonucleotide
ccaugccagacaucgggc

SEQ ID NO: 49148 - RNA, 18 nt, Artificial Sequence
  Description of Artificial Sequence: Synthetic oligonucleotide
accagccaugccagacau

SEQ ID NO: 49149 - RNA, 18 nt, Artificial Sequence
  Description of Artificial Sequence: Synthetic oligonucleotide
ggaccaccagccaugcca

SEQ ID NO: 49150 - RNA, 18 nt, Artificial Sequence
  Description of Artificial Sequence: Synthetic oligonucleotide
caacaggaccaccagcca

SEQ ID NO: 49151 - RNA, 18 nt, Artificial Sequence
  Description of Artificial Sequence: Synthetic oligonucleotide
aaggacaacaggaccacc

SEQ ID NO: 49152 - RNA, 18 nt, Artificial Sequence
  Description of Artificial Sequence: Synthetic oligonucleotide
aaauaaaggacaacagga

SEQ ID NO: 49153 - RNA, 18 nt, Artificial Sequence
  Description of Artificial Sequence: Synthetic oligonucleotide
cgaucaaauaaaggacaa

SEQ ID NO: 49154 - RNA, 18 nt, Artificial Sequence
  Description of Artificial Sequence: Synthetic oligonucleotide
gcuaucgaucaaauaaag

SEQ ID NO: 49155 - RNA, 18 nt, Artificial Sequence
  Description of Artificial Sequence: Synthetic oligonucleotide
ucccugcuaucgaucaaa

SEQ ID NO: 49156 - RNA, 18 nt, Artificial Sequence
  Description of Artificial Sequence: Synthetic oligonucleotide
ucaguucccugcuaucga

SEQ ID NO: 49157 - RNA, 18 nt, Artificial Sequence
  Description of Artificial Sequence: Synthetic oligonucleotide
ggcggucaguucccugcu

SEQ ID NO: 49158 - RNA, 18 nt, Artificial Sequence
  Description of Artificial Sequence: Synthetic oligonucleotide
accucggcggucaguucc

SEQ ID NO: 49159 - RNA, 18 nt, Artificial Sequence
  Description of Artificial Sequence: Synthetic oligonucleotide
ugccaaccucggcgguca

SEQ ID NO: 49160 - RNA, 18 nt, Artificial Sequence
  Description of Artificial Sequence: Synthetic oligonucleotide
accugugccaaccucggc

SEQ ID NO: 49161 - RNA, 18 nt, Artificial Sequence
  Description of Artificial Sequence: Synthetic oligonucleotide
ugccaaccugugccaacc

SEQ ID NO: 49162 - RNA, 18 nt, Artificial Sequence
  Description of Artificial Sequence: Synthetic oligonucleotide
cccccugccaaccugugc

SEQ ID NO: 49163 - RNA, 18 nt, Artificial Sequence
  Description of Artificial Sequence: Synthetic oligonucleotide
cucaucccccugccaacc

SEQ ID NO: 49164 - RNA, 18 nt, Artificial Sequence
  Description of Artificial Sequence: Synthetic oligonucleotide
gcauccucaucccccugc

SEQ ID NO: 49165 - RNA, 18 nt, Artificial Sequence
  Description of Artificial Sequence: Synthetic oligonucleotide
acaaugcauccucauccc

SEQ ID NO: 49166 - RNA, 18 nt, Artificial Sequence
  Description of Artificial Sequence: Synthetic oligonucleotide
caaccacaaugcauccuc

SEQ ID NO: 49167 - RNA, 18 nt, Artificial Sequence
  Description of Artificial Sequence: Synthetic oligonucleotide
ggagacaaccacaaugca

SEQ ID NO: 49168 - RNA, 18 nt, Artificial Sequence
  Description of Artificial Sequence: Synthetic oligonucleotide
gaggaggagacaaccaca

SEQ ID NO: 49169 - RNA, 18 nt, Artificial Sequence
  Description of Artificial Sequence: Synthetic oligonucleotide
gagaggaggaggagacaa

SEQ ID NO: 49170 - RNA, 18 nt, Artificial Sequence
  Description of Artificial Sequence: Synthetic oligonucleotide
agaaggagaggaggagga

SEQ ID NO: 49171 - RNA, 18 nt, Artificial Sequence
  Description of Artificial Sequence: Synthetic oligonucleotide
gaggaagaaggagaggag

SEQ ID NO: 49172 - RNA, 18 nt, Artificial Sequence
  Description of Artificial Sequence: Synthetic oligonucleotide
gggaagaggaagaaggag

SEQ ID NO: 49173 - RNA, 18 nt, Artificial Sequence
  Description of Artificial Sequence: Synthetic oligonucleotide
aaaggagaggaggaaggg

SEQ ID NO: 49174 - RNA, 18 nt, Artificial Sequence
  Description of Artificial Sequence: Synthetic oligonucleotide
agaaaggagaggaggaag

SEQ ID NO: 49175 - RNA, 18 nt, Artificial Sequence
  Description of Artificial Sequence: Synthetic oligonucleotide
agaacagaaaggagagga

SEQ ID NO: 49176 - RNA, 18 nt, Artificial Sequence
  Description of Artificial Sequence: Synthetic oligonucleotide
gaacaagaacagaaagga

SEQ ID NO: 49177 - RNA, 18 nt, Artificial Sequence
  Description of Artificial Sequence: Synthetic oligonucleotide
agggagaacaagaacaga

SEQ ID NO: 49178 - RNA, 18 nt, Artificial Sequence
  Description of Artificial Sequence: Synthetic oligonucleotide
agaugagggagaacaaga

SEQ ID NO: 49179 - RNA, 18 nt, Artificial Sequence
  Description of Artificial Sequence: Synthetic oligonucleotide
gaggaagaugagggagaa

SEQ ID NO: 49180 - RNA, 18 nt, Artificial Sequence
  Description of Artificial Sequence: Synthetic oligonucleotide
aggaagaggaagaugagg

SEQ ID NO: 49181 - RNA, 18 nt, Artificial Sequence
  Description of Artificial Sequence: Synthetic oligonucleotide
gaagaaggaagaggaaga

SEQ ID NO: 49182 - RNA, 18 nt, Artificial Sequence
  Description of Artificial Sequence: Synthetic oligonucleotide
agggagaagaaggaagag

SEQ ID NO: 49183 - RNA, 18 nt, Artificial Sequence
  Description of Artificial Sequence: Synthetic oligonucleotide
agaagagggagaagaagg

SEQ ID NO: 49184 - RNA, 18 nt, Artificial Sequence
  Description of Artificial Sequence: Synthetic oligonucleotide
gaggaagaagagggagaa

SEQ ID NO: 49185 - RNA, 18 nt, Artificial Sequence
  Description of Artificial Sequence: Synthetic oligonucleotide
gugaagaggaagaagagg

SEQ ID NO: 49186 - RNA, 18 nt, Artificial Sequence
  Description of Artificial Sequence: Synthetic oligonucleotide
gcagagugaagaggaaga

SEQ ID NO: 49187 - RNA, 18 nt, Artificial Sequence
  Description of Artificial Sequence: Synthetic oligonucleotide
agagagcagagugaagag

SEQ ID NO: 49188 - RNA, 18 nt, Artificial Sequence
  Description of Artificial Sequence: Synthetic oligonucleotide
agagaagagagcagagug

SEQ ID NO: 49189 - RNA, 18 nt, Artificial Sequence
  Description of Artificial Sequence: Synthetic oligonucleotide
aaagaagagaagagagca

SEQ ID NO: 49190 - RNA, 18 nt, Artificial Sequence
  Description of Artificial Sequence: Synthetic oligonucleotide
ugauucacuccgcuguga

SEQ ID NO: 49191 - RNA, 18 nt, Artificial Sequence
  Description of Artificial Sequence: Synthetic oligonucleotide
cgagcugauucacuccgc

SEQ ID NO: 49192 - RNA, 18 nt, Artificial Sequence
  Description of Artificial Sequence: Synthetic oligonucleotide
accaccgagcugauucac

SEQ ID NO: 49193 - RNA, 18 nt, Artificial Sequence
  Description of Artificial Sequence: Synthetic oligonucleotide
aagacaccaccgagcuga

SEQ ID NO: 49194 - RNA, 18 nt, Artificial Sequence
  Description of Artificial Sequence: Synthetic oligonucleotide
ugacaaagacaccaccga

SEQ ID NO: 49195 - RNA, 18 nt, Artificial Sequence
  Description of Artificial Sequence: Synthetic oligonucleotide
cccguugacaaagacacc

SEQ ID NO: 49196 - RNA, 18 nt, Artificial Sequence
  Description of Artificial Sequence: Synthetic oligonucleotide
ggccgcccguugacaaag

SEQ ID NO: 49197 - RNA, 18 nt, Artificial Sequence
  Description of Artificial Sequence: Synthetic oligonucleotide
gcaguggccgcccguuga

SEQ ID NO: 49198 - RNA, 18 nt, Artificial Sequence
  Description of Artificial Sequence: Synthetic oligonucleotide
guccggcaguggccgccc

SEQ ID NO: 49199 - RNA, 18 nt, Artificial Sequence
  Description of Artificial Sequence: Synthetic oligonucleotide
guggaguccggcaguggc

SEQ ID NO: 49200 - RNA, 18 nt, Artificial Sequence
  Description of Artificial Sequence: Synthetic oligonucleotide
gccggguggaguccggca

SEQ ID NO: 49201 - RNA, 18 nt, Artificial Sequence
  Description of Artificial Sequence: Synthetic oligonucleotide
cuucugccggguggaguc

SEQ ID NO: 49202 - RNA, 18 nt, Artificial Sequence
  Description of Artificial Sequence: Synthetic oligonucleotide
acaaucuucugccgggug

SEQ ID NO: 49203 - RNA, 18 nt, Artificial Sequence
  Description of Artificial Sequence: Synthetic oligonucleotide
gcucuacaaucuucugcc

SEQ ID NO: 49204 - RNA, 18 nt, Artificial Sequence
  Description of Artificial Sequence: Synthetic oligonucleotide
agcuagcucuacaaucuu

SEQ ID NO: 49205 - RNA, 18 nt, Artificial Sequence
  Description of Artificial Sequence: Synthetic oligonucleotide
cugugagcuagcucuaca

SEQ ID NO: 49206 - RNA, 18 nt, Artificial Sequence
  Description of Artificial Sequence: Synthetic oligonucleotide
ccccgcugugagcuagcu

SEQ ID NO: 49207 - RNA, 18 nt, Artificial Sequence
  Description of Artificial Sequence: Synthetic oligonucleotide
ccgggccccgcugugagc

SEQ ID NO: 49208 - RNA, 18 nt, Artificial Sequence
  Description of Artificial Sequence: Synthetic oligonucleotide
cacggccgggccccgcug

SEQ ID NO: 49209 - RNA, 18 nt, Artificial Sequence
  Description of Artificial Sequence: Synthetic oligonucleotide
ugucgcacggccgggccc

SEQ ID NO: 49210 - RNA, 18 nt, Artificial Sequence
  Description of Artificial Sequence: Synthetic oligonucleotide
ggaaaugucgcacggccg

SEQ ID NO: 49211 - RNA, 18 nt, Artificial Sequence
  Description of Artificial Sequence: Synthetic oligonucleotide
auucgggaaaugucgcac

SEQ ID NO: 49212 - RNA, 18 nt, Artificial Sequence
  Description of Artificial Sequence: Synthetic oligonucleotide
gcagaauucgggaaaugu

SEQ ID NO: 49213 - RNA, 18 nt, Artificial Sequence
  Description of Artificial Sequence: Synthetic oligonucleotide
cuuuugcaucugcauggg

SEQ ID NO: 49214 - RNA, 18 nt, Artificial Sequence
  Description of Artificial Sequence: Synthetic oligonucleotide
uuggacuuuugcaucugc

SEQ ID NO: 49215 - RNA, 18 nt, Artificial Sequence
  Description of Artificial Sequence: Synthetic oligonucleotide
agcacuuggacuuuugca

SEQ ID NO: 49216 - RNA, 18 nt, Artificial Sequence
  Description of Artificial Sequence: Synthetic oligonucleotide
uguccagcacuuggacuu

SEQ ID NO: 49217 - RNA, 18 nt, Artificial Sequence
  Description of Artificial Sequence: Synthetic oligonucleotide
uugauuguccagcacuug

SEQ ID NO: 49218 - RNA, 18 nt, Artificial Sequence
  Description of Artificial Sequence: Synthetic oligonucleotide
gcauuaaacaaugacaag

SEQ ID NO: 49219 - RNA, 18 nt, Artificial Sequence
  Description of Artificial Sequence: Synthetic oligonucleotide
aguaugcauuaaacaaug

SEQ ID NO: 49220 - RNA, 18 nt, Artificial Sequence
  Description of Artificial Sequence: Synthetic oligonucleotide
guuuaaguaugcauuaaa

SEQ ID NO: 49221 - RNA, 18 nt, Artificial Sequence
  Description of Artificial Sequence: Synthetic oligonucleotide
aaauuguuuaaguaugca

SEQ ID NO: 49222 - RNA, 18 nt, Artificial Sequence
  Description of Artificial Sequence: Synthetic oligonucleotide
aaauaaaauuguuuaagu

SEQ ID NO: 49223 - RNA, 18 nt, Artificial Sequence
  Description of Artificial Sequence: Synthetic oligonucleotide
gacaaaaauaaaauuguu

SEQ ID NO: 49224 - RNA, 18 nt, Artificial Sequence
  Description of Artificial Sequence: Synthetic oligonucleotide
uucaagacaaaaauaaaa

SEQ ID NO: 49225 - RNA, 18 nt, Artificial Sequence
  Description of Artificial Sequence: Synthetic oligonucleotide
auaauuucaagacaaaaa

SEQ ID NO: 49226 - RNA, 18 nt, Artificial Sequence
  Description of Artificial Sequence: Synthetic oligonucleotide
uauuaauaauuucaagac

SEQ ID NO: 49227 - RNA, 18 nt, Artificial Sequence
  Description of Artificial Sequence: Synthetic oligonucleotide
cacauuauuaauaauuuc

SEQ ID NO: 49228 - RNA, 18 nt, Artificial Sequence
  Description of Artificial Sequence: Synthetic oligonucleotide
aaaaccacauuauuaaua

SEQ ID NO: 49229 - RNA, 18 nt, Artificial Sequence
  Description of Artificial Sequence: Synthetic oligonucleotide
gacagaaaaccacauuau

SEQ ID NO: 49230 - RNA, 18 nt, Artificial Sequence
  Description of Artificial Sequence: Synthetic oligonucleotide
uguuuaaguaugcauuaa

SEQ ID NO: 49231 - RNA, 18 nt, Artificial Sequence
  Description of Artificial Sequence: Synthetic oligonucleotide
aaaauuguuuaaguaugc

SEQ ID NO: 49232 - RNA, 18 nt, Artificial Sequence
  Description of Artificial Sequence: Synthetic oligonucleotide
aaaauaaaauuguuuaag

SEQ ID NO: 49233 - RNA, 18 nt, Artificial Sequence
  Description of Artificial Sequence: Synthetic oligonucleotide
agacaaaaauaaaauugu

SEQ ID NO: 49234 - RNA, 18 nt, Artificial Sequence
  Description of Artificial Sequence: Synthetic oligonucleotide
uuucaagacaaaaauaaa

SEQ ID NO: 49235 - RNA, 18 nt, Artificial Sequence
  Description of Artificial Sequence: Synthetic oligonucleotide
aauaauuucaagacaaaa

SEQ ID NO: 49236 - RNA, 18 nt, Artificial Sequence
  Description of Artificial Sequence: Synthetic oligonucleotide
uuauuaauaauuucaaga

SEQ ID NO: 49237 - RNA, 18 nt, Artificial Sequence
  Description of Artificial Sequence: Synthetic oligonucleotide
ccacauuauuaauaauuu

SEQ ID NO: 49238 - RNA, 18 nt, Artificial Sequence
  Description of Artificial Sequence: Synthetic oligonucleotide
gaaaaccacauuauuaau

SEQ ID NO: 49239 - RNA, 18 nt, Artificial Sequence
  Description of Artificial Sequence: Synthetic oligonucleotide
ggacagaaaaccacauua

SEQ ID NO: 49240 - RNA, 18 nt, Artificial Sequence
  Description of Artificial Sequence: Synthetic oligonucleotide
ucacacauccguuggaca

SEQ ID NO: 49241 - RNA, 18 nt, Artificial Sequence
  Description of Artificial Sequence: Synthetic oligonucleotide
uuuacucacacauccguu

SEQ ID NO: 49242 - RNA, 18 nt, Artificial Sequence
  Description of Artificial Sequence: Synthetic oligonucleotide
agaauuuuacucacacau

SEQ ID NO: 49243 - RNA, 18 nt, Artificial Sequence
  Description of Artificial Sequence: Synthetic oligonucleotide
ugcccagaauuuuacuca

SEQ ID NO: 49244 - RNA, 18 nt, Artificial Sequence
  Description of Artificial Sequence: Synthetic oligonucleotide
auaccugcccagaauuuu

SEQ ID NO: 49245 - RNA, 18 nt, Artificial Sequence
  Description of Artificial Sequence: Synthetic oligonucleotide
ucguaauaccugcccaga

SEQ ID NO: 49246 - RNA, 18 nt, Artificial Sequence
  Description of Artificial Sequence: Synthetic oligonucleotide
cagucucguaauaccugc

SEQ ID NO: 49247 - RNA, 18 nt, Artificial Sequence
  Description of Artificial Sequence: Synthetic oligonucleotide
ggagccagucucguaaua

SEQ ID NO: 49248 - RNA, 18 nt, Artificial Sequence
  Description of Artificial Sequence: Synthetic oligonucleotide
cugauggagccagucucg

SEQ ID NO: 49249 - RNA, 18 nt, Artificial Sequence
  Description of Artificial Sequence: Synthetic oligonucleotide
ugggucugauggagccag

SEQ ID NO: 49250 - RNA, 18 nt, Artificial Sequence
  Description of Artificial Sequence: Synthetic oligonucleotide
ugcccugggucugaugga

SEQ ID NO: 49251 - RNA, 18 nt, Artificial Sequence
  Description of Artificial Sequence: Synthetic oligonucleotide
ccgauugcccugggucug

SEQ ID NO: 49252 - RNA, 18 nt, Artificial Sequence
  Description of Artificial Sequence: Synthetic oligonucleotide
uaccaccgauugcccugg

SEQ ID NO: 49253 - RNA, 18 nt, Artificial Sequence
  Description of Artificial Sequence: Synthetic oligonucleotide
uuuacuaccaccgauugc

SEQ ID NO: 49254 - RNA, 18 nt, Artificial Sequence
  Description of Artificial Sequence: Synthetic oligonucleotide
cucgguuuacuaccaccg

SEQ ID NO: 49255 - RNA, 18 nt, Artificial Sequence
  Description of Artificial Sequence: Synthetic oligonucleotide
cuacucucgguuuacuac

SEQ ID NO: 49256 - RNA, 18 nt, Artificial Sequence
  Description of Artificial Sequence: Synthetic oligonucleotide
agucgcuacucucgguuu

SEQ ID NO: 49257 - RNA, 18 nt, Artificial Sequence
  Description of Artificial Sequence: Synthetic oligonucleotide
ucuggagucgcuacucuc

SEQ ID NO: 49258 - RNA, 18 nt, Artificial Sequence
  Description of Artificial Sequence: Synthetic oligonucleotide
caacuucuggagucgcua

SEQ ID NO: 49259 - RNA, 18 nt, Artificial Sequence
  Description of Artificial Sequence: Synthetic oligonucleotide
gcuuacaacuucuggagu

SEQ ID NO: 49260 - RNA, 18 nt, Artificial Sequence
  Description of Artificial Sequence: Synthetic oligonucleotide
auuuugcuuacaacuucu

SEQ ID NO: 49261 - RNA, 18 nt, Artificial Sequence
  Description of Artificial Sequence: Synthetic oligonucleotide
gggcuauuuugcuuacaa

SEQ ID NO: 49262 - RNA, 18 nt, Artificial Sequence
  Description of Artificial Sequence: Synthetic oligonucleotide
auacugggcuauuuugcu

SEQ ID NO: 49263 - RNA, 18 nt, Artificial Sequence
  Description of Artificial Sequence: Synthetic oligonucleotide
cgcuuauacugggcuauu

SEQ ID NO: 49264 - RNA, 18 nt, Artificial Sequence
  Description of Artificial Sequence: Synthetic oligonucleotide
acucccgcuuauacuggg

SEQ ID NO: 49265 - RNA, 18 nt, Artificial Sequence
  Description of Artificial Sequence: Synthetic oligonucleotide
cgggcacucccgcuuaua

SEQ ID NO: 49266 - RNA, 18 nt, Artificial Sequence
  Description of Artificial Sequence: Synthetic oligonucleotide
auggacgggcacucccgc

SEQ ID NO: 49267 - RNA, 18 nt, Artificial Sequence
  Description of Artificial Sequence: Synthetic oligonucleotide
caaagauggacgggcacu

SEQ ID NO: 49268 - RNA, 18 nt, Artificial Sequence
  Description of Artificial Sequence: Synthetic oligonucleotide
ccaagcaaagauggacgg

SEQ ID NO: 49269 - RNA, 18 nt, Artificial Sequence
  Description of Artificial Sequence: Synthetic oligonucleotide
auuucccaagcaaagaug

SEQ ID NO: 49270 - RNA, 18 nt, Artificial Sequence
  Description of Artificial Sequence: Synthetic oligonucleotide
cucggauuucccaagcaa

SEQ ID NO: 49271 - RNA, 18 nt, Artificial Sequence
  Description of Artificial Sequence: Synthetic oligonucleotide
ucugucucggauuuccca

SEQ ID NO: 49272 - RNA, 18 nt, Artificial Sequence
  Description of Artificial Sequence: Synthetic oligonucleotide
aguaaucugucucggauu

SEQ ID NO: 49273 - RNA, 18 nt, Artificial Sequence
  Description of Artificial Sequence: Synthetic oligonucleotide
cggacaguaaucugucuc

SEQ ID NO: 49274 - RNA, 18 nt, Artificial Sequence
  Description of Artificial Sequence: Synthetic oligonucleotide
ccccucggacaguaaucu

SEQ ID NO: 49275 - RNA, 18 nt, Artificial Sequence
  Description of Artificial Sequence: Synthetic oligonucleotide
cagacccccucggacagu

SEQ ID NO: 49276 - RNA, 18 nt, Artificial Sequence
  Description of Artificial Sequence: Synthetic oligonucleotide
ugguacagacccccucgg

SEQ ID NO: 49277 - RNA, 18 nt, Artificial Sequence
  Description of Artificial Sequence: Synthetic oligonucleotide
aucguugguacagacccc

SEQ ID NO: 49278 - RNA, 18 nt, Artificial Sequence
  Description of Artificial Sequence: Synthetic oligonucleotide
auguuaucguugguacag

SEQ ID NO: 49279 - RNA, 18 nt, Artificial Sequence
  Description of Artificial Sequence: Synthetic oligonucleotide
uugguauguuaucguugg

SEQ ID NO: 49280 - RNA, 18 nt, Artificial Sequence
  Description of Artificial Sequence: Synthetic oligonucleotide
cacacauccguuggacac

SEQ ID NO: 49281 - RNA, 18 nt, Artificial Sequence
  Description of Artificial Sequence: Synthetic oligonucleotide
uuacucacacauccguug

SEQ ID NO: 49282 - RNA, 18 nt, Artificial Sequence
  Description of Artificial Sequence: Synthetic oligonucleotide
gaauuuuacucacacauc

SEQ ID NO: 49283 - RNA, 18 nt, Artificial Sequence
  Description of Artificial Sequence: Synthetic oligonucleotide
gcccagaauuuuacucac

SEQ ID NO: 49284 - RNA, 18 nt, Artificial Sequence
  Description of Artificial Sequence: Synthetic oligonucleotide
uaccugcccagaauuuua

SEQ ID NO: 49285 - RNA, 18 nt, Artificial Sequence
  Description of Artificial Sequence: Synthetic oligonucleotide
cguaauaccugcccagaa

SEQ ID NO: 49286 - RNA, 18 nt, Artificial Sequence
  Description of Artificial Sequence: Synthetic oligonucleotide
agucucguaauaccugcc

SEQ ID NO: 49287 - RNA, 18 nt, Artificial Sequence
  Description of Artificial Sequence: Synthetic oligonucleotide
gagccagucucguaauac

SEQ ID NO: 49288 - RNA, 18 nt, Artificial Sequence
  Description of Artificial Sequence: Synthetic oligonucleotide
ugauggagccagucucgu

SEQ ID NO: 49289 - RNA, 18 nt, Artificial Sequence
  Description of Artificial Sequence: Synthetic oligonucleotide
gggucugauggagccagu

SEQ ID NO: 49290 - RNA, 18 nt, Artificial Sequence
  Description of Artificial Sequence: Synthetic oligonucleotide
gcccugggucugauggag

SEQ ID NO: 49291 - RNA, 18 nt, Artificial Sequence
  Description of Artificial Sequence: Synthetic oligonucleotide
cgauugcccugggucuga

SEQ ID NO: 49292 - RNA, 18 nt, Artificial Sequence
  Description of Artificial Sequence: Synthetic oligonucleotide
accaccgauugcccuggg

SEQ ID NO: 49293 - RNA, 18 nt, Artificial Sequence
  Description of Artificial Sequence: Synthetic oligonucleotide
uuacuaccaccgauugcc

SEQ ID NO: 49294 - RNA, 18 nt, Artificial Sequence
  Description of Artificial Sequence: Synthetic oligonucleotide
ucgguuuacuaccaccga

SEQ ID NO: 49295 - RNA, 18 nt, Artificial Sequence
  Description of Artificial Sequence: Synthetic oligonucleotide
uacucucgguuuacuacc

SEQ ID NO: 49296 - RNA, 18 nt, Artificial Sequence
  Description of Artificial Sequence: Synthetic oligonucleotide
gucgcuacucucgguuua

SEQ ID NO: 49297 - RNA, 18 nt, Artificial Sequence
  Description of Artificial Sequence: Synthetic oligonucleotide
cuggagucgcuacucucg

SEQ ID NO: 49298 - RNA, 18 nt, Artificial Sequence
  Description of Artificial Sequence: Synthetic oligonucleotide
aacuucuggagucgcuac

SEQ ID NO: 49299 - RNA, 18 nt, Artificial Sequence
  Description of Artificial Sequence: Synthetic oligonucleotide
cuuacaacuucuggaguc

SEQ ID NO: 49300 - RNA, 18 nt, Artificial Sequence
  Description of Artificial Sequence: Synthetic oligonucleotide
uuuugcuuacaacuucug

SEQ ID NO: 49301 - RNA, 18 nt, Artificial Sequence
  Description of Artificial Sequence: Synthetic oligonucleotide
ggcuauuuugcuuacaac

SEQ ID NO: 49302 - RNA, 18 nt, Artificial Sequence
  Description of Artificial Sequence: Synthetic oligonucleotide
uacugggcuauuuugcuu

SEQ ID NO: 49303 - RNA, 18 nt, Artificial Sequence
  Description of Artificial Sequence: Synthetic oligonucleotide
gcuuauacugggcuauuu

SEQ ID NO: 49304 - RNA, 18 nt, Artificial Sequence
  Description of Artificial Sequence: Synthetic oligonucleotide
cucccgcuuauacugggc

SEQ ID NO: 49305 - RNA, 18 nt, Artificial Sequence
  Description of Artificial Sequence: Synthetic oligonucleotide
gggcacucccgcuuauac

SEQ ID NO: 49306 - RNA, 18 nt, Artificial Sequence
  Description of Artificial Sequence: Synthetic oligonucleotide
uggacgggcacucccgcu

SEQ ID NO: 49307 - RNA, 18 nt, Artificial Sequence
  Description of Artificial Sequence: Synthetic oligonucleotide
aaagauggacgggcacuc

SEQ ID NO: 49308 - RNA, 18 nt, Artificial Sequence
  Description of Artificial Sequence: Synthetic oligonucleotide
caagcaaagauggacggg

SEQ ID NO: 49309 - RNA, 18 nt, Artificial Sequence
  Description of Artificial Sequence: Synthetic oligonucleotide
uuucccaagcaaagaugg

SEQ ID NO: 49310 - RNA, 18 nt, Artificial Sequence
  Description of Artificial Sequence: Synthetic oligonucleotide
ucggauuucccaagcaaa

SEQ ID NO: 49311 - RNA, 18 nt, Artificial Sequence
  Description of Artificial Sequence: Synthetic oligonucleotide
cugucucggauuucccaa

SEQ ID NO: 49312 - RNA, 18 nt, Artificial Sequence
  Description of Artificial Sequence: Synthetic oligonucleotide
guaaucugucucggauuu

SEQ ID NO: 49313 - RNA, 18 nt, Artificial Sequence
  Description of Artificial Sequence: Synthetic oligonucleotide
ggacaguaaucugucucg

SEQ ID NO: 49314 - RNA, 18 nt, Artificial Sequence
  Description of Artificial Sequence: Synthetic oligonucleotide
cccucggacaguaaucug

SEQ ID NO: 49315 - RNA, 18 nt, Artificial Sequence
  Description of Artificial Sequence: Synthetic oligonucleotide
agacccccucggacagua

SEQ ID NO: 49316 - RNA, 18 nt, Artificial Sequence
  Description of Artificial Sequence: Synthetic oligonucleotide
gguacagacccccucgga

SEQ ID NO: 49317 - RNA, 18 nt, Artificial Sequence
  Description of Artificial Sequence: Synthetic oligonucleotide
ucguugguacagaccccc

SEQ ID NO: 49318 - RNA, 18 nt, Artificial Sequence
  Description of Artificial Sequence: Synthetic oligonucleotide
uguuaucguugguacaga

SEQ ID NO: 49319 - RNA, 18 nt, Artificial Sequence
  Description of Artificial Sequence: Synthetic oligonucleotide
ugguauguuaucguuggu

SEQ ID NO: 49320 - RNA, 18 nt, Artificial Sequence
  Description of Artificial Sequence: Synthetic oligonucleotide
gcagauguucucaaugaa

SEQ ID NO: 49321 - RNA, 18 nt, Artificial Sequence
  Description of Artificial Sequence: Synthetic oligonucleotide
ggagggcagauguucuca

SEQ ID NO: 49322 - RNA, 18 nt, Artificial Sequence
  Description of Artificial Sequence: Synthetic oligonucleotide
ggcagggagggcagaugu

SEQ ID NO: 49323 - RNA, 18 nt, Artificial Sequence
  Description of Artificial Sequence: Synthetic oligonucleotide
cuuagggcagggagggca

SEQ ID NO: 49324 - RNA, 18 nt, Artificial Sequence
  Description of Artificial Sequence: Synthetic oligonucleotide
uugggcuuagggcaggga

SEQ ID NO: 49325 - RNA, 18 nt, Artificial Sequence
  Description of Artificial Sequence: Synthetic oligonucleotide
gagcauugggcuuagggc

SEQ ID NO: 49326 - RNA, 18 nt, Artificial Sequence
  Description of Artificial Sequence: Synthetic oligonucleotide
ggagagagcauugggcuu

SEQ ID NO: 49327 - RNA, 18 nt, Artificial Sequence
  Description of Artificial Sequence: Synthetic oligonucleotide
aaagaggagagagcauug

SEQ ID NO: 49328 - RNA, 18 nt, Artificial Sequence
  Description of Artificial Sequence: Synthetic oligonucleotide
gagguaaagaggagagag

SEQ ID NO: 49329 - RNA, 18 nt, Artificial Sequence
  Description of Artificial Sequence: Synthetic oligonucleotide
gggaggagguaaagagga

SEQ ID NO: 49330 - RNA, 18 nt, Artificial Sequence
  Description of Artificial Sequence: Synthetic oligonucleotide
agggugggaggagguaaa

SEQ ID NO: 49331 - RNA, 18 nt, Artificial Sequence
  Description of Artificial Sequence: Synthetic oligonucleotide
gagagagggugggaggag

SEQ ID NO: 49332 - RNA, 18 nt, Artificial Sequence
  Description of Artificial Sequence: Synthetic oligonucleotide
guggagagagaggguggg

SEQ ID NO: 49333 - RNA, 18 nt, Artificial Sequence
  Description of Artificial Sequence: Synthetic oligonucleotide
agacaguggagagagagg

SEQ ID NO: 49334 - RNA, 18 nt, Artificial Sequence
  Description of Artificial Sequence: Synthetic oligonucleotide
cuaagagacaguggagag

SEQ ID NO: 49335 - RNA, 18 nt, Artificial Sequence
  Description of Artificial Sequence: Synthetic oligonucleotide
acagacuaagagacagug

SEQ ID NO: 49336 - RNA, 18 nt, Artificial Sequence
  Description of Artificial Sequence: Synthetic oligonucleotide
aggacacagacuaagaga

SEQ ID NO: 49337 - RNA, 18 nt, Artificial Sequence
  Description of Artificial Sequence: Synthetic oligonucleotide
gggagaggacacagacua

SEQ ID NO: 49338 - RNA, 18 nt, Artificial Sequence
  Description of Artificial Sequence: Synthetic oligonucleotide
gagcagggagaggacaca

SEQ ID NO: 49339 - RNA, 18 nt, Artificial Sequence
  Description of Artificial Sequence: Synthetic oligonucleotide
auguggagcagggagagg

SEQ ID NO: 49340 - RNA, 18 nt, Artificial Sequence
  Description of Artificial Sequence: Synthetic oligonucleotide
gacaaauguggagcaggg

SEQ ID NO: 49341 - RNA, 18 nt, Artificial Sequence
  Description of Artificial Sequence: Synthetic oligonucleotide
aaggagacaaauguggag

SEQ ID NO: 49342 - RNA, 18 nt, Artificial Sequence
  Description of Artificial Sequence: Synthetic oligonucleotide
guacaaaggagacaaaug

SEQ ID NO: 49343 - RNA, 18 nt, Artificial Sequence
  Description of Artificial Sequence: Synthetic oligonucleotide
cccagguacaaaggagac

SEQ ID NO: 49344 - RNA, 18 nt, Artificial Sequence
  Description of Artificial Sequence: Synthetic oligonucleotide
guucccccagguacaaag

SEQ ID NO: 49345 - RNA, 18 nt, Artificial Sequence
  Description of Artificial Sequence: Synthetic oligonucleotide
ucucuguucccccaggua

SEQ ID NO: 49346 - RNA, 18 nt, Artificial Sequence
  Description of Artificial Sequence: Synthetic oligonucleotide
auuccucucuguuccccc

SEQ ID NO: 49347 - RNA, 18 nt, Artificial Sequence
  Description of Artificial Sequence: Synthetic oligonucleotide
agggcauuccucucuguu

SEQ ID NO: 49348 - RNA, 18 nt, Artificial Sequence
  Description of Artificial Sequence: Synthetic oligonucleotide
aagucagggcauuccucu

SEQ ID NO: 49349 - RNA, 18 nt, Artificial Sequence
  Description of Artificial Sequence: Synthetic oligonucleotide
aagaaaagucagggcauu

SEQ ID NO: 49350 - RNA, 18 nt, Artificial Sequence
  Description of Artificial Sequence: Synthetic oligonucleotide
agucaaagaaaagucagg

SEQ ID NO: 49351 - RNA, 18 nt, Artificial Sequence
  Description of Artificial Sequence: Synthetic oligonucleotide
cagacagucaaagaaaag

SEQ ID NO: 49352 - RNA, 18 nt, Artificial Sequence
  Description of Artificial Sequence: Synthetic oligonucleotide
uuuuccagacagucaaag

SEQ ID NO: 49353 - RNA, 18 nt, Artificial Sequence
  Description of Artificial Sequence: Synthetic oligonucleotide
ucccauuuuccagacagu

SEQ ID NO: 49354 - RNA, 18 nt, Artificial Sequence
  Description of Artificial Sequence: Synthetic oligonucleotide
uugacucccauuuuccag

SEQ ID NO: 49355 - RNA, 18 nt, Artificial Sequence
  Description of Artificial Sequence: Synthetic oligonucleotide
cacacuugacucccauuu

SEQ ID NO: 49356 - RNA, 18 nt, Artificial Sequence
  Description of Artificial Sequence: Synthetic oligonucleotide
cuccccacacuugacucc

SEQ ID NO: 49357 - RNA, 18 nt, Artificial Sequence
  Description of Artificial Sequence: Synthetic oligonucleotide
aaugacuccccacacuug

SEQ ID NO: 49358 - RNA, 18 nt, Artificial Sequence
  Description of Artificial Sequence: Synthetic oligonucleotide
aagugaaugacuccccac

SEQ ID NO: 49359 - RNA, 18 nt, Artificial Sequence
  Description of Artificial Sequence: Synthetic oligonucleotide
aaaugaagugaaugacuc

SEQ ID NO: 49360 - RNA, 18 nt, Artificial Sequence
  Description of Artificial Sequence: Synthetic oligonucleotide
caugcaaaugaagugaau

SEQ ID NO: 49361 - RNA, 18 nt, Artificial Sequence
  Description of Artificial Sequence: Synthetic oligonucleotide
ugcagcaugcaaaugaag

SEQ ID NO: 49362 - RNA, 18 nt, Artificial Sequence
  Description of Artificial Sequence: Synthetic oligonucleotide
uguuuugcagcaugcaaa

SEQ ID NO: 49363 - RNA, 18 nt, Artificial Sequence
  Description of Artificial Sequence: Synthetic oligonucleotide
cccucuguuuugcagcau

SEQ ID NO: 49364 - RNA, 18 nt, Artificial Sequence
  Description of Artificial Sequence: Synthetic oligonucleotide
cuccgcccucuguuuugc

SEQ ID NO: 49365 - RNA, 18 nt, Artificial Sequence
  Description of Artificial Sequence: Synthetic oligonucleotide
ggugccuccgcccucugu

SEQ ID NO: 49366 - RNA, 18 nt, Artificial Sequence
  Description of Artificial Sequence: Synthetic oligonucleotide
ucccuggugccuccgccc

SEQ ID NO: 49367 - RNA, 18 nt, Artificial Sequence
  Description of Artificial Sequence: Synthetic oligonucleotide
gccuuucccuggugccuc

SEQ ID NO: 49368 - RNA, 18 nt, Artificial Sequence
  Description of Artificial Sequence: Synthetic oligonucleotide
caagugccuuucccuggu

SEQ ID NO: 49369 - RNA, 18 nt, Artificial Sequence
  Description of Artificial Sequence: Synthetic oligonucleotide
ucauucaagugccuuucc

SEQ ID NO: 49370 - RNA, 18 nt, Artificial Sequence
  Description of Artificial Sequence: Synthetic oligonucleotide
cuucuucauucaagugcc

SEQ ID NO: 49371 - RNA, 18 nt, Artificial Sequence
  Description of Artificial Sequence: Synthetic oligonucleotide
uuuuccuucuucauucaa

SEQ ID NO: 49372 - RNA, 18 nt, Artificial Sequence
  Description of Artificial Sequence: Synthetic oligonucleotide
ucucauuuuccuucuuca

SEQ ID NO: 49373 - RNA, 18 nt, Artificial Sequence
  Description of Artificial Sequence: Synthetic oligonucleotide
cugguucucauuuuccuu

SEQ ID NO: 49374 - RNA, 18 nt, Artificial Sequence
  Description of Artificial Sequence: Synthetic oligonucleotide
acaaucugguucucauuu

SEQ ID NO: 49375 - RNA, 18 nt, Artificial Sequence
  Description of Artificial Sequence: Synthetic oligonucleotide
aaguuacaaucugguucu

SEQ ID NO: 49376 - RNA, 18 nt, Artificial Sequence
  Description of Artificial Sequence: Synthetic oligonucleotide
ggacgaaguuacaaucug

SEQ ID NO: 49377 - RNA, 18 nt, Artificial Sequence
  Description of Artificial Sequence: Synthetic oligonucleotide
gauuaggacgaaguuaca

SEQ ID NO: 49378 - RNA, 18 nt, Artificial Sequence
  Description of Artificial Sequence: Synthetic oligonucleotide
agguggauuaggacgaag

SEQ ID NO: 49379 - RNA, 18 nt, Artificial Sequence
  Description of Artificial Sequence: Synthetic oligonucleotide
cuggcagguggauuagga

SEQ ID NO: 49380 - RNA, 18 nt, Artificial Sequence
  Description of Artificial Sequence: Synthetic oligonucleotide
aaguucuggcagguggau

SEQ ID NO: 49381 - RNA, 18 nt, Artificial Sequence
  Description of Artificial Sequence: Synthetic oligonucleotide
aaggaaaguucuggcagg

SEQ ID NO: 49382 - RNA, 18 nt, Artificial Sequence
  Description of Artificial Sequence: Synthetic oligonucleotide
accugaaggaaaguucug

SEQ ID NO: 49383 - RNA, 18 nt, Artificial Sequence
  Description of Artificial Sequence: Synthetic oligonucleotide
gugacaccugaaggaaag

SEQ ID NO: 49384 - RNA, 18 nt, Artificial Sequence
  Description of Artificial Sequence: Synthetic oligonucleotide
gaugugugacaccugaag

SEQ ID NO: 49385 - RNA, 18 nt, Artificial Sequence
  Description of Artificial Sequence: Synthetic oligonucleotide
aaauggaugugugacacc

SEQ ID NO: 49386 - RNA, 18 nt, Artificial Sequence
  Description of Artificial Sequence: Synthetic oligonucleotide
gauggaaauggaugugug

SEQ ID NO: 49387 - RNA, 18 nt, Artificial Sequence
  Description of Artificial Sequence: Synthetic oligonucleotide
auuaggauggaaauggau

SEQ ID NO: 49388 - RNA, 18 nt, Artificial Sequence
  Description of Artificial Sequence: Synthetic oligonucleotide
uuaauauuaggauggaaa

SEQ ID NO: 49389 - RNA, 18 nt, Artificial Sequence
  Description of Artificial Sequence: Synthetic oligonucleotide
auuguuuaauauuaggau

SEQ ID NO: 49390 - RNA, 18 nt, Artificial Sequence
  Description of Artificial Sequence: Synthetic oligonucleotide
auuauauuguuuaauauu

SEQ ID NO: 49391 - RNA, 18 nt, Artificial Sequence
  Description of Artificial Sequence: Synthetic oligonucleotide
cuuucauuauauuguuua

SEQ ID NO: 49392 - RNA, 18 nt, Artificial Sequence
  Description of Artificial Sequence: Synthetic oligonucleotide
gcuuucuuucauuauauu

SEQ ID NO: 49393 - RNA, 18 nt, Artificial Sequence
  Description of Artificial Sequence: Synthetic oligonucleotide
gaugugugacaccugaag

SEQ ID NO: 49394 - RNA, 18 nt, Artificial Sequence
  Description of Artificial Sequence: Synthetic oligonucleotide
aaauggaugugugacacc

SEQ ID NO: 49395 - RNA, 18 nt, Artificial Sequence
  Description of Artificial Sequence: Synthetic oligonucleotide
gauggaaauggaugugug

SEQ ID NO: 49396 - RNA, 18 nt, Artificial Sequence
  Description of Artificial Sequence: Synthetic oligonucleotide
auuaggauggaaauggau

SEQ ID NO: 49397 - RNA, 18 nt, Artificial Sequence
  Description of Artificial Sequence: Synthetic oligonucleotide
uuaauauuaggauggaaa

SEQ ID NO: 49398 - RNA, 18 nt, Artificial Sequence
  Description of Artificial Sequence: Synthetic oligonucleotide
auuguuuaauauuaggau

SEQ ID NO: 49399 - RNA, 18 nt, Artificial Sequence
  Description of Artificial Sequence: Synthetic oligonucleotide
auuauauuguuuaauauu

SEQ ID NO: 49400 - RNA, 18 nt, Artificial Sequence
  Description of Artificial Sequence: Synthetic oligonucleotide
cuuucauuauauuguuua

SEQ ID NO: 49401 - RNA, 18 nt, Artificial Sequence
  Description of Artificial Sequence: Synthetic oligonucleotide
gcuuucuuucauuauauu

SEQ ID NO: 49402 - RNA, 18 nt, Artificial Sequence
  Description of Artificial Sequence: Synthetic oligonucleotide
guaaagcuuucuuucauu

SEQ ID NO: 49403 - RNA, 18 nt, Artificial Sequence
  Description of Artificial Sequence: Synthetic oligonucleotide
uuguuguaaagcuuucuu

SEQ ID NO: 49404 - RNA, 18 nt, Artificial Sequence
  Description of Artificial Sequence: Synthetic oligonucleotide
uagacuuguuguaaagcu

SEQ ID NO: 49405 - RNA, 18 nt, Artificial Sequence
  Description of Artificial Sequence: Synthetic oligonucleotide
cuauuuagacuuguugua

SEQ ID NO: 49406 - RNA, 18 nt, Artificial Sequence
  Description of Artificial Sequence: Synthetic oligonucleotide
aaaaacuauuuagacuug

SEQ ID NO: 49407 - RNA, 18 nt, Artificial Sequence
  Description of Artificial Sequence: Synthetic oligonucleotide
aaaauaaaaacuauuuag

SEQ ID NO: 49408 - RNA, 18 nt, Artificial Sequence
  Description of Artificial Sequence: Synthetic oligonucleotide
gcccgaaaauaaaaacua

SEQ ID NO: 49409 - RNA, 18 nt, Artificial Sequence
  Description of Artificial Sequence: Synthetic oligonucleotide
agacugcccgaaaauaaa

SEQ ID NO: 49410 - RNA, 18 nt, Artificial Sequence
  Description of Artificial Sequence: Synthetic oligonucleotide
uuaaaagacugcccgaaa

SEQ ID NO: 49411 - RNA, 18 nt, Artificial Sequence
  Description of Artificial Sequence: Synthetic oligonucleotide
cuuuguuaaaagacugcc

SEQ ID NO: 49412 - RNA, 18 nt, Artificial Sequence
  Description of Artificial Sequence: Synthetic oligonucleotide
cuuugcuuuguuaaaaga

SEQ ID NO: 49413 - RNA, 18 nt, Artificial Sequence
  Description of Artificial Sequence: Synthetic oligonucleotide
gguugcuuugcuuuguua

SEQ ID NO: 49414 - RNA, 18 nt, Artificial Sequence
  Description of Artificial Sequence: Synthetic oligonucleotide
cacacgguugcuuugcuu

SEQ ID NO: 49415 - RNA, 18 nt, Artificial Sequence
  Description of Artificial Sequence: Synthetic oligonucleotide
uaacucacacgguugcuu

SEQ ID NO: 49416 - RNA, 18 nt, Artificial Sequence
  Description of Artificial Sequence: Synthetic oligonucleotide
ugaccuaacucacacggu

SEQ ID NO: 49417 - RNA, 18 nt, Artificial Sequence
  Description of Artificial Sequence: Synthetic oligonucleotide
ucuggugaccuaacucac

SEQ ID NO: 49418 - RNA, 18 nt, Artificial Sequence
  Description of Artificial Sequence: Synthetic oligonucleotide
gugucucuggugaccuaa

SEQ ID NO: 49419 - RNA, 18 nt, Artificial Sequence
  Description of Artificial Sequence: Synthetic oligonucleotide
gcuuggugucucugguga

SEQ ID NO: 49420 - RNA, 18 nt, Artificial Sequence
  Description of Artificial Sequence: Synthetic oligonucleotide
ccauugcuuggugucucu

SEQ ID NO: 49421 - RNA, 18 nt, Artificial Sequence
  Description of Artificial Sequence: Synthetic oligonucleotide
cuucaccauugcuuggug

SEQ ID NO: 49422 - RNA, 18 nt, Artificial Sequence
  Description of Artificial Sequence: Synthetic oligonucleotide
ggguccuucaccauugcu

SEQ ID NO: 49423 - RNA, 18 nt, Artificial Sequence
  Description of Artificial Sequence: Synthetic oligonucleotide
agagaauugggcggaggg

SEQ ID NO: 49424 - RNA, 18 nt, Artificial Sequence
  Description of Artificial Sequence: Synthetic oligonucleotide
ggauagagaauugggcgg

SEQ ID NO: 49425 - RNA, 18 nt, Artificial Sequence
  Description of Artificial Sequence: Synthetic oligonucleotide
uaguuggauagagaauug

SEQ ID NO: 49426 - RNA, 18 nt, Artificial Sequence
  Description of Artificial Sequence: Synthetic oligonucleotide
aaauuuaguuggauagag

SEQ ID NO: 49427 - RNA, 18 nt, Artificial Sequence
  Description of Artificial Sequence: Synthetic oligonucleotide
cauggaaauuuaguugga

SEQ ID NO: 49428 - RNA, 18 nt, Artificial Sequence
  Description of Artificial Sequence: Synthetic oligonucleotide
uugggcauggaaauuuag

SEQ ID NO: 49429 - RNA, 18 nt, Artificial Sequence
  Description of Artificial Sequence: Synthetic oligonucleotide
ucacuuugggcauggaaa

SEQ ID NO: 49430 - RNA, 18 nt, Artificial Sequence
  Description of Artificial Sequence: Synthetic oligonucleotide
agcuaucacuuugggcau

SEQ ID NO: 49431 - RNA, 18 nt, Artificial Sequence
  Description of Artificial Sequence: Synthetic oligonucleotide
augauagcuaucacuuug

SEQ ID NO: 49432 - RNA, 18 nt, Artificial Sequence
  Description of Artificial Sequence: Synthetic oligonucleotide
aaaaaaugauagcuauca

SEQ ID NO: 49433 - RNA, 18 nt, Artificial Sequence
  Description of Artificial Sequence: Synthetic oligonucleotide
cguggaaaaaaugauagc

SEQ ID NO: 49434 - RNA, 18 nt, Artificial Sequence
  Description of Artificial Sequence: Synthetic oligonucleotide
uacaccguggaaaaaaug

SEQ ID NO: 49435 - RNA, 18 nt, Artificial Sequence
  Description of Artificial Sequence: Synthetic oligonucleotide
gcagauacaccguggaaa

SEQ ID NO: 49436 - RNA, 18 nt, Artificial Sequence
  Description of Artificial Sequence: Synthetic oligonucleotide
gauuugcagauacaccgu

SEQ ID NO: 49437 - RNA, 18 nt, Artificial Sequence
  Description of Artificial Sequence: Synthetic oligonucleotide
ggguggauuugcagauac

SEQ ID NO: 49438 - RNA, 18 nt, Artificial Sequence
  Description of Artificial Sequence: Synthetic oligonucleotide
acaguggguggauuugca

SEQ ID NO: 49439 - RNA, 18 nt, Artificial Sequence
  Description of Artificial Sequence: Synthetic oligonucleotide
ccgggacaguggguggau

SEQ ID NO: 49440 - RNA, 18 nt, Artificial Sequence
  Description of Artificial Sequence: Synthetic oligonucleotide
ccaccccgggacaguggg

SEQ ID NO: 49441 - RNA, 18 nt, Artificial Sequence
  Description of Artificial Sequence: Synthetic oligonucleotide
cccagccaccccgggaca

SEQ ID NO: 49442 - RNA, 18 nt, Artificial Sequence
  Description of Artificial Sequence: Synthetic oligonucleotide
aagcucccagccaccccg

SEQ ID NO: 49443 - RNA, 18 nt, Artificial Sequence
  Description of Artificial Sequence: Synthetic oligonucleotide
uuaaaaagcucccagcca

SEQ ID NO: 49444 - RNA, 18 nt, Artificial Sequence
  Description of Artificial Sequence: Synthetic oligonucleotide
acccguuaaaaagcuccc

SEQ ID NO: 49445 - RNA, 18 nt, Artificial Sequence
  Description of Artificial Sequence: Synthetic oligonucleotide
ucucaacccguuaaaaag

SEQ ID NO: 49446 - RNA, 18 nt, Artificial Sequence
  Description of Artificial Sequence: Synthetic oligonucleotide
gcaacucucaacccguua

SEQ ID NO: 49447 - RNA, 18 nt, Artificial Sequence
  Description of Artificial Sequence: Synthetic oligonucleotide
aaaaagcaacucucaacc

SEQ ID NO: 49448 - RNA, 18 nt, Artificial Sequence
  Description of Artificial Sequence: Synthetic oligonucleotide
accuuaaaaagcaacucu

SEQ ID NO: 49449 - RNA, 18 nt, Artificial Sequence
  Description of Artificial Sequence: Synthetic oligonucleotide
ccacaaccuuaaaaagca

SEQ ID NO: 49450 - RNA, 18 nt, Artificial Sequence
  Description of Artificial Sequence: Synthetic oligonucleotide
cucacccacaaccuuaaa

SEQ ID NO: 49451 - RNA, 18 nt, Artificial Sequence
  Description of Artificial Sequence: Synthetic oligonucleotide
cucagcucacccacaacc

SEQ ID NO: 49452 - RNA, 18 nt, Artificial Sequence
  Description of Artificial Sequence: Synthetic oligonucleotide
cccaucucagcucaccca

SEQ ID NO: 49453 - RNA, 18 nt, Artificial Sequence
  Description of Artificial Sequence: Synthetic oligonucleotide
agucacccaucucagcuc

SEQ ID NO: 49454 - RNA, 18 nt, Artificial Sequence
  Description of Artificial Sequence: Synthetic oligonucleotide
gacacagucacccaucuc

SEQ ID NO: 49455 - RNA, 18 nt, Artificial Sequence
  Description of Artificial Sequence: Synthetic oligonucleotide
cugaagacacagucaccc

SEQ ID NO: 49456 - RNA, 18 nt, Artificial Sequence
  Description of Artificial Sequence: Synthetic oligonucleotide
gucuccugaagacacagu

SEQ ID NO: 49457 - RNA, 18 nt, Artificial Sequence
  Description of Artificial Sequence: Synthetic oligonucleotide
guagugucuccugaagac

SEQ ID NO: 49458 - RNA, 18 nt, Artificial Sequence
  Description of Artificial Sequence: Synthetic oligonucleotide
aaaugguagugucuccug

SEQ ID NO: 49459 - RNA, 18 nt, Artificial Sequence
  Description of Artificial Sequence: Synthetic oligonucleotide
aaaccaaaugguaguguc

SEQ ID NO: 49460 - RNA, 18 nt, Artificial Sequence
  Description of Artificial Sequence: Synthetic oligonucleotide
aaaucaaaccaaauggua

SEQ ID NO: 49461 - RNA, 18 nt, Artificial Sequence
  Description of Artificial Sequence: Synthetic oligonucleotide
cucuguuuauugaugaca

SEQ ID NO: 49462 - RNA, 18 nt, Artificial Sequence
  Description of Artificial Sequence: Synthetic oligonucleotide
aagaacucuguuuauuga

SEQ ID NO: 49463 - RNA, 18 nt, Artificial Sequence
  Description of Artificial Sequence: Synthetic oligonucleotide
uugcgaagaacucuguuu

SEQ ID NO: 49464 - RNA, 18 nt, Artificial Sequence
  Description of Artificial Sequence: Synthetic oligonucleotide
ccagguugcgaagaacuc

SEQ ID NO: 49465 - RNA, 18 nt, Artificial Sequence
  Description of Artificial Sequence: Synthetic oligonucleotide
gcuagccagguugcgaag

SEQ ID NO: 49466 - RNA, 18 nt, Artificial Sequence
  Description of Artificial Sequence: Synthetic oligonucleotide
uuuucgcuagccagguug

SEQ ID NO: 49467 - RNA, 18 nt, Artificial Sequence
  Description of Artificial Sequence: Synthetic oligonucleotide
guugcuuuucgcuagcca

SEQ ID NO: 49468 - RNA, 18 nt, Artificial Sequence
  Description of Artificial Sequence: Synthetic oligonucleotide
caucuguugcuuuucgcu

SEQ ID NO: 49469 - RNA, 18 nt, Artificial Sequence
  Description of Artificial Sequence: Synthetic oligonucleotide
gcgcccaucuguugcuuu

SEQ ID NO: 49470 - RNA, 18 nt, Artificial Sequence
  Description of Artificial Sequence: Synthetic oligonucleotide
cgucugcgcccaucuguu

SEQ ID NO: 49471 - RNA, 18 nt, Artificial Sequence
  Description of Artificial Sequence: Synthetic oligonucleotide
caugccgucugcgcccau

SEQ ID NO: 49472 - RNA, 18 nt, Artificial Sequence
  Description of Artificial Sequence: Synthetic oligonucleotide
ucauacaugccgucugcg

SEQ ID NO: 49473 - RNA, 18 nt, Artificial Sequence
  Description of Artificial Sequence: Synthetic oligonucleotide
guuuaucauacaugccgu

SEQ ID NO: 49474 - RNA, 18 nt, Artificial Sequence
  Description of Artificial Sequence: Synthetic oligonucleotide
ccuuaguuuaucauacau

SEQ ID NO: 49475 - RNA, 18 nt, Artificial Sequence
  Description of Artificial Sequence: Synthetic oligonucleotide
aacauccuuaguuuauca

SEQ ID NO: 49476 - RNA, 18 nt, Artificial Sequence
  Description of Artificial Sequence: Synthetic oligonucleotide
cguucaacauccuuaguu

SEQ ID NO: 49477 - RNA, 18 nt, Artificial Sequence
  Description of Artificial Sequence: Synthetic oligonucleotide
cugcccguucaacauccu

SEQ ID NO: 49478 - RNA, 18 nt, Artificial Sequence
  Description of Artificial Sequence: Synthetic oligonucleotide
ccggucugcccguucaac

SEQ ID NO: 49479 - RNA, 18 nt, Artificial Sequence
  Description of Artificial Sequence: Synthetic oligonucleotide
agcuuccggucugcccgu

SEQ ID NO: 49480 - RNA, 18 nt, Artificial Sequence
  Description of Artificial Sequence: Synthetic oligonucleotide
gccccagcuuccggucug

SEQ ID NO: 49481 - RNA, 18 nt, Artificial Sequence
  Description of Artificial Sequence: Synthetic oligonucleotide
cgggugccccagcuuccg

SEQ ID NO: 49482 - RNA, 18 nt, Artificial Sequence
  Description of Artificial Sequence: Synthetic oligonucleotide
cagggcgggugccccagc

SEQ ID NO: 49483 - RNA, 18 nt, Artificial Sequence
  Description of Artificial Sequence: Synthetic oligonucleotide
ccaaccagggcgggugcc

SEQ ID NO: 49484 - RNA, 18 nt, Artificial Sequence
  Description of Artificial Sequence: Synthetic oligonucleotide
ggauaccaaccagggcgg

SEQ ID NO: 49485 - RNA, 18 nt, Artificial Sequence
  Description of Artificial Sequence: Synthetic oligonucleotide
uccccggauaccaaccag

SEQ ID NO: 49486 - RNA, 18 nt, Artificial Sequence
  Description of Artificial Sequence: Synthetic oligonucleotide
cgaaguccccggauacca

SEQ ID NO: 49487 - RNA, 18 nt, Artificial Sequence
  Description of Artificial Sequence: Synthetic oligonucleotide
ggcaccgaaguccccgga

SEQ ID NO: 49488 - RNA, 18 nt, Artificial Sequence
  Description of Artificial Sequence: Synthetic oligonucleotide
gcccuggcaccgaagucc

SEQ ID NO: 49489 - RNA, 18 nt, Artificial Sequence
  Description of Artificial Sequence: Synthetic oligonucleotide
agguugcccuggcaccga

SEQ ID NO: 49490 - RNA, 18 nt, Artificial Sequence
  Description of Artificial Sequence: Synthetic oligonucleotide
ugcguagguugcccuggc

SEQ ID NO: 49491 - RNA, 18 nt, Artificial Sequence
  Description of Artificial Sequence: Synthetic oligonucleotide
gccgcgggauuccacggg

SEQ ID NO: 49492 - RNA, 18 nt, Artificial Sequence
  Description of Artificial Sequence: Synthetic oligonucleotide
augcuggcucuggcuggg

SEQ ID NO: 49493 - RNA, 18 nt, Artificial Sequence
  Description of Artificial Sequence: Synthetic oligonucleotide
ucugcaugcuggcucugg

SEQ ID NO: 49494 - RNA, 18 nt, Artificial Sequence
  Description of Artificial Sequence: Synthetic oligonucleotide
ccagaaagaccagaggca

SEQ ID NO: 49495 - RNA, 18 nt, Artificial Sequence
  Description of Artificial Sequence: Synthetic oligonucleotide
aagucccagaaagaccag

SEQ ID NO: 49496 - RNA, 18 nt, Artificial Sequence
  Description of Artificial Sequence: Synthetic oligonucleotide
gcccgaagucccagaaag

SEQ ID NO: 49497 - RNA, 18 nt, Artificial Sequence
  Description of Artificial Sequence: Synthetic oligonucleotide
cccgagcccgaaguccca

SEQ ID NO: 49498 - RNA, 18 nt, Artificial Sequence
  Description of Artificial Sequence: Synthetic oligonucleotide
cgcaccccgagcccgaag

SEQ ID NO: 49499 - RNA, 18 nt, Artificial Sequence
  Description of Artificial Sequence: Synthetic oligonucleotide
guccgcgcaccccgagcc

SEQ ID NO: 49500 - RNA, 18 nt, Artificial Sequence
  Description of Artificial Sequence: Synthetic oligonucleotide
cucggguccgcgcacccc

SEQ ID NO: 49501 - RNA, 18 nt, Artificial Sequence
  Description of Artificial Sequence: Synthetic oligonucleotide
ugacccucggguccgcgc

SEQ ID NO: 49502 - RNA, 18 nt, Artificial Sequence
  Description of Artificial Sequence: Synthetic oligonucleotide
uccccugacccucggguc

SEQ ID NO: 49503 - RNA, 18 nt, Artificial Sequence
  Description of Artificial Sequence: Synthetic oligonucleotide
uguccuccccugacccuc

SEQ ID NO: 49504 - RNA, 18 nt, Artificial Sequence
  Description of Artificial Sequence: Synthetic oligonucleotide
cccuguguccuccccuga

SEQ ID NO: 49505 - RNA, 18 nt, Artificial Sequence
  Description of Artificial Sequence: Synthetic oligonucleotide
cgagucccuguguccucc

SEQ ID NO: 49506 - RNA, 18 nt, Artificial Sequence
  Description of Artificial Sequence: Synthetic oligonucleotide
cgucgcgagucccugugu

SEQ ID NO: 49507 - RNA, 18 nt, Artificial Sequence
  Description of Artificial Sequence: Synthetic oligonucleotide
gcgggcgucgcgaguccc

SEQ ID NO: 49508 - RNA, 18 nt, Artificial Sequence
  Description of Artificial Sequence: Synthetic oligonucleotide
ccagcgcgggcgucgcga

SEQ ID NO: 49509 - RNA, 18 nt, Artificial Sequence
  Description of Artificial Sequence: Synthetic oligonucleotide
ccgggccagcgcgggcgu

SEQ ID NO: 49510 - RNA, 18 nt, Artificial Sequence
  Description of Artificial Sequence: Synthetic oligonucleotide
ggcggccgggccagcgcg

SEQ ID NO: 49511 - RNA, 18 nt, Artificial Sequence
  Description of Artificial Sequence: Synthetic oligonucleotide
cggucggcggccgggcca

SEQ ID NO: 49512 - RNA, 18 nt, Artificial Sequence
  Description of Artificial Sequence: Synthetic oligonucleotide
ucagucggucggcggccg

SEQ ID NO: 49513 - RNA, 18 nt, Artificial Sequence
  Description of Artificial Sequence: Synthetic oligonucleotide
gggccucagucggucggc

SEQ ID NO: 49514 - RNA, 18 nt, Artificial Sequence
  Description of Artificial Sequence: Synthetic oligonucleotide
uccccgggccucagucgg

SEQ ID NO: 49515 - RNA, 18 nt, Artificial Sequence
  Description of Artificial Sequence: Synthetic oligonucleotide
gcagguccccgggccuca

SEQ ID NO: 49516 - RNA, 18 nt, Artificial Sequence
  Description of Artificial Sequence: Synthetic oligonucleotide
ccgccgcagguccccggg

SEQ ID NO: 49517 - RNA, 18 nt, Artificial Sequence
  Description of Artificial Sequence: Synthetic oligonucleotide
agcagccgccgcaggucc

SEQ ID NO: 49518 - RNA, 18 nt, Artificial Sequence
  Description of Artificial Sequence: Synthetic oligonucleotide
gggagcagccgccgcagg

SEQ ID NO: 49519 - RNA, 18 nt, Artificial Sequence
  Description of Artificial Sequence: Synthetic oligonucleotide
ugccgggcgcggagcggg

SEQ ID NO: 49520 - RNA, 18 nt, Artificial Sequence
  Description of Artificial Sequence: Synthetic oligonucleotide
cgggcugccgggcgcgga

SEQ ID NO: 49521 - RNA, 18 nt, Artificial Sequence
  Description of Artificial Sequence: Synthetic oligonucleotide
ccucccgggcugccgggc

SEQ ID NO: 49522 - RNA, 18 nt, Artificial Sequence
  Description of Artificial Sequence: Synthetic oligonucleotide
ccuccccucccgggcugc

SEQ ID NO: 49523 - RNA, 18 nt, Artificial Sequence
  Description of Artificial Sequence: Synthetic oligonucleotide
aacgcccuccccucccgg

SEQ ID NO: 49524 - RNA, 18 nt, Artificial Sequence
  Description of Artificial Sequence: Synthetic oligonucleotide
aagcaaacgcccuccccu

SEQ ID NO: 49525 - RNA, 18 nt, Artificial Sequence
  Description of Artificial Sequence: Synthetic oligonucleotide
gagccaagcaaacgcccu

SEQ ID NO: 49526 - RNA, 18 nt, Artificial Sequence
  Description of Artificial Sequence: Synthetic oligonucleotide
gagaagagccaagcaaac

SEQ ID NO: 49527 - RNA, 18 nt, Artificial Sequence
  Description of Artificial Sequence: Synthetic oligonucleotide
guaucgagaagagccaag

SEQ ID NO: 49528 - RNA, 18 nt, Artificial Sequence
  Description of Artificial Sequence: Synthetic oligonucleotide
cuccaguaucgagaagag

SEQ ID NO: 49529 - RNA, 18 nt, Artificial Sequence
  Description of Artificial Sequence: Synthetic oligonucleotide
ugcuucuccaguaucgag

SEQ ID NO: 49530 - RNA, 18 nt, Artificial Sequence
  Description of Artificial Sequence: Synthetic oligonucleotide
gccccugcuucuccagua

SEQ ID NO: 49531 - RNA, 18 nt, Artificial Sequence
  Description of Artificial Sequence: Synthetic oligonucleotide
gcccagccccugcuucuc

SEQ ID NO: 49532 - RNA, 18 nt, Artificial Sequence
  Description of Artificial Sequence: Synthetic oligonucleotide
uaagggcccagccccugc

SEQ ID NO: 49533 - RNA, 18 nt, Artificial Sequence
  Description of Artificial Sequence: Synthetic oligonucleotide
guucuuaagggcccagcc

SEQ ID NO: 49534 - RNA, 18 nt, Artificial Sequence
  Description of Artificial Sequence: Synthetic oligonucleotide
gggcuguucuuaagggcc

SEQ ID NO: 49535 - RNA, 18 nt, Artificial Sequence
  Description of Artificial Sequence: Synthetic oligonucleotide
cgggcgggcuguucuuaa

SEQ ID NO: 49536 - RNA, 18 nt, Artificial Sequence
  Description of Artificial Sequence: Synthetic oligonucleotide
aaacucgggcgggcuguu

SEQ ID NO: 49537 - RNA, 18 nt, Artificial Sequence
  Description of Artificial Sequence: Synthetic oligonucleotide
uucgaaaacucgggcggg

SEQ ID NO: 49538 - RNA, 18 nt, Artificial Sequence
  Description of Artificial Sequence: Synthetic oligonucleotide
gcagcuucgaaaacucgg

SEQ ID NO: 49539 - RNA, 18 nt, Artificial Sequence
  Description of Artificial Sequence: Synthetic oligonucleotide
cuaccgcagcuucgaaaa

SEQ ID NO: 49540 - RNA, 18 nt, Artificial Sequence
  Description of Artificial Sequence: Synthetic oligonucleotide
uuucucuaccgcagcuuc

SEQ ID NO: 49541 - RNA, 18 nt, Artificial Sequence
  Description of Artificial Sequence: Synthetic oligonucleotide
ggguuucucuaccgcagc

SEQ ID NO: 49542 - RNA, 18 nt, Artificial Sequence
  Description of Artificial Sequence: Synthetic oligonucleotide
ugaguuacaggauuuggg

SEQ ID NO: 49543 - RNA, 18 nt, Artificial Sequence
  Description of Artificial Sequence: Synthetic oligonucleotide
gggugugaguuacaggau

SEQ ID NO: 49544 - RNA, 18 nt, Artificial Sequence
  Description of Artificial Sequence: Synthetic oligonucleotide
gggucagagcccgggcag

SEQ ID NO: 49545 - RNA, 18 nt, Artificial Sequence
  Description of Artificial Sequence: Synthetic oligonucleotide
ccagccccucucuccggg

SEQ ID NO: 49546 - RNA, 18 nt, Artificial Sequence
  Description of Artificial Sequence: Synthetic oligonucleotide
ucagcccagccccucucu

SEQ ID NO: 49547 - RNA, 18 nt, Artificial Sequence
  Description of Artificial Sequence: Synthetic oligonucleotide
ccugaucagcccagcccc

SEQ ID NO: 49548 - RNA, 18 nt, Artificial Sequence
  Description of Artificial Sequence: Synthetic oligonucleotide
cccgcccugaucagccca

SEQ ID NO: 49549 - RNA, 18 nt, Artificial Sequence
  Description of Artificial Sequence: Synthetic oligonucleotide
uucgccccgcccugauca

SEQ ID NO: 49550 - RNA, 18 nt, Artificial Sequence
  Description of Artificial Sequence: Synthetic oligonucleotide
aagacuucgccccgcccu

SEQ ID NO: 49551 - RNA, 18 nt, Artificial Sequence
  Description of Artificial Sequence: Synthetic oligonucleotide
aggagaagacuucgcccc

SEQ ID NO: 49552 - RNA, 18 nt, Artificial Sequence
  Description of Artificial Sequence: Synthetic oligonucleotide
caacuaggagaagacuuc

SEQ ID NO: 49553 - RNA, 18 nt, Artificial Sequence
  Description of Artificial Sequence: Synthetic oligonucleotide
ucgcucaacuaggagaag

SEQ ID NO: 49554 - RNA, 18 nt, Artificial Sequence
  Description of Artificial Sequence: Synthetic oligonucleotide
ccuucucgcucaacuagg

SEQ ID NO: 49555 - RNA, 18 nt, Artificial Sequence
  Description of Artificial Sequence: Synthetic oligonucleotide
ggccuccuucucgcucaa

SEQ ID NO: 49556 - RNA, 18 nt, Artificial Sequence
  Description of Artificial Sequence: Synthetic oligonucleotide
gggccuccuucucgcuca

SEQ ID NO: 49557 - RNA, 18 nt, Artificial Sequence
  Description of Artificial Sequence: Synthetic oligonucleotide
uuggcuaagcccaaaggg

SEQ ID NO: 49558 - RNA, 18 nt, Artificial Sequence
  Description of Artificial Sequence: Synthetic oligonucleotide
cagucuuggcuaagccca

SEQ ID NO: 49559 - RNA, 18 nt, Artificial Sequence
  Description of Artificial Sequence: Synthetic oligonucleotide
acuuucagucuuggcuaa

SEQ ID NO: 49560 - RNA, 18 nt, Artificial Sequence
  Description of Artificial Sequence: Synthetic oligonucleotide
uggagacuuucagucuug

SEQ ID NO: 49561 - RNA, 18 nt, Artificial Sequence
  Description of Artificial Sequence: Synthetic oligonucleotide
guugguggagacuuucag

SEQ ID NO: 49562 - RNA, 18 nt, Artificial Sequence
  Description of Artificial Sequence: Synthetic oligonucleotide
gccggguugguggagacu

SEQ ID NO: 49563 - RNA, 18 nt, Artificial Sequence
  Description of Artificial Sequence: Synthetic oligonucleotide
accccgccggguuggugg

SEQ ID NO: 49564 - RNA, 18 nt, Artificial Sequence
  Description of Artificial Sequence: Synthetic oligonucleotide
ccccaaccccgccggguu

SEQ ID NO: 49565 - RNA, 18 nt, Artificial Sequence
  Description of Artificial Sequence: Synthetic oligonucleotide
gaagcccccaaccccgcc

SEQ ID NO: 49566 - RNA, 18 nt, Artificial Sequence
  Description of Artificial Sequence: Synthetic oligonucleotide
ggagagaagcccccaacc

SEQ ID NO: 49567 - RNA, 18 nt, Artificial Sequence
  Description of Artificial Sequence: Synthetic oligonucleotide
gggagagaagcccccaac

SEQ ID NO: 49568 - RNA, 18 nt, Artificial Sequence
  Description of Artificial Sequence: Synthetic oligonucleotide
cccugagagugacuuggg

SEQ ID NO: 49569 - RNA, 18 nt, Artificial Sequence
  Description of Artificial Sequence: Synthetic oligonucleotide
agcugcccugagagugac

SEQ ID NO: 49570 - RNA, 18 nt, Artificial Sequence
  Description of Artificial Sequence: Synthetic oligonucleotide
ggaggagcugcccugaga

SEQ ID NO: 49571 - RNA, 18 nt, Artificial Sequence
  Description of Artificial Sequence: Synthetic oligonucleotide
gggaggagcugcccugag

SEQ ID NO: 49572 - RNA, 18 nt, Artificial Sequence
  Description of Artificial Sequence: Synthetic oligonucleotide
uucuaggcccguaguggg

SEQ ID NO: 49573 - RNA, 18 nt, Artificial Sequence
  Description of Artificial Sequence: Synthetic oligonucleotide
aucccuucuaggcccgua

SEQ ID NO: 49574 - RNA, 18 nt, Artificial Sequence
  Description of Artificial Sequence: Synthetic oligonucleotide
uccccaucccuucuaggc

SEQ ID NO: 49575 - RNA, 18 nt, Artificial Sequence
  Description of Artificial Sequence: Synthetic oligonucleotide
uggguucuacagauccca

SEQ ID NO: 49576 - RNA, 18 nt, Artificial Sequence
  Description of Artificial Sequence: Synthetic oligonucleotide
aaccauggguucuacaga

SEQ ID NO: 49577 - RNA, 18 nt, Artificial Sequence
  Description of Artificial Sequence: Synthetic oligonucleotide
ccgcaaaccauggguucu

SEQ ID NO: 49578 - RNA, 18 nt, Artificial Sequence
  Description of Artificial Sequence: Synthetic oligonucleotide
ugucaccgcaaaccaugg

SEQ ID NO: 49579 - RNA, 18 nt, Artificial Sequence
  Description of Artificial Sequence: Synthetic oligonucleotide
cugagugucaccgcaaac

SEQ ID NO: 49580 - RNA, 18 nt, Artificial Sequence
  Description of Artificial Sequence: Synthetic oligonucleotide
ccccucugagugucaccg

SEQ ID NO: 49581 - RNA, 18 nt, Artificial Sequence
  Description of Artificial Sequence: Synthetic oligonucleotide
aagauccccucugagugu

SEQ ID NO: 49582 - RNA, 18 nt, Artificial Sequence
  Description of Artificial Sequence: Synthetic oligonucleotide
ucccaaagauccccucug

SEQ ID NO: 49583 - RNA, 18 nt, Artificial Sequence
  Description of Artificial Sequence: Synthetic oligonucleotide
aaaucucccaaagauccc

SEQ ID NO: 49584 - RNA, 18 nt, Artificial Sequence
  Description of Artificial Sequence: Synthetic oligonucleotide
ucuauaaaucucccaaag

SEQ ID NO: 49585 - RNA, 18 nt, Artificial Sequence
  Description of Artificial Sequence: Synthetic oligonucleotide
ccggcucuauaaaucucc

SEQ ID NO: 49586 - RNA, 18 nt, Artificial Sequence
  Description of Artificial Sequence: Synthetic oligonucleotide
aagaaccggcucuauaaa

SEQ ID NO: 49587 - RNA, 18 nt, Artificial Sequence
  Description of Artificial Sequence: Synthetic oligonucleotide
gcgcuaagaaccggcucu

SEQ ID NO: 49588 - RNA, 18 nt, Artificial Sequence
  Description of Artificial Sequence: Synthetic oligonucleotide
acaaagcgcuaagaaccg

SEQ ID NO: 49589 - RNA, 18 nt, Artificial Sequence
  Description of Artificial Sequence: Synthetic oligonucleotide
aacccacaaagcgcuaag

SEQ ID NO: 49590 - RNA, 18 nt, Artificial Sequence
  Description of Artificial Sequence: Synthetic oligonucleotide
cucugaacccacaaagcg

SEQ ID NO: 49591 - RNA, 18 nt, Artificial Sequence
  Description of Artificial Sequence: Synthetic oligonucleotide
ccagccucugaacccaca

SEQ ID NO: 49592 - RNA, 18 nt, Artificial Sequence
  Description of Artificial Sequence: Synthetic oligonucleotide
ugcagccagccucugaac

SEQ ID NO: 49593 - RNA, 18 nt, Artificial Sequence
  Description of Artificial Sequence: Synthetic oligonucleotide
aacacugcagccagccuc

SEQ ID NO: 49594 - RNA, 18 nt, Artificial Sequence
  Description of Artificial Sequence: Synthetic oligonucleotide
ucauaaacacugcagcca

SEQ ID NO: 49595 - RNA, 18 nt, Artificial Sequence
  Description of Artificial Sequence: Synthetic oligonucleotide
ccucuucauaaacacugc

SEQ ID NO: 49596 - RNA, 18 nt, Artificial Sequence
  Description of Artificial Sequence: Synthetic oligonucleotide
cugccccucuucauaaac

SEQ ID NO: 49597 - RNA, 18 nt, Artificial Sequence
  Description of Artificial Sequence: Synthetic oligonucleotide
gcccacugccccucuuca

SEQ ID NO: 49598 - RNA, 18 nt, Artificial Sequence
  Description of Artificial Sequence: Synthetic oligonucleotide
ccccagcccacugccccu

SEQ ID NO: 49599 - RNA, 18 nt, Artificial Sequence
  Description of Artificial Sequence: Synthetic oligonucleotide
aguguccccagcccacug

SEQ ID NO: 49600 - RNA, 18 nt, Artificial Sequence
  Description of Artificial Sequence: Synthetic oligonucleotide
ccagcaguguccccagcc

SEQ ID NO: 49601 - RNA, 18 nt, Artificial Sequence
  Description of Artificial Sequence: Synthetic oligonucleotide
uaaccccagcaguguccc

SEQ ID NO: 49602 - RNA, 18 nt, Artificial Sequence
  Description of Artificial Sequence: Synthetic oligonucleotide
agccauaaccccagcagu

SEQ ID NO: 49603 - RNA, 18 nt, Artificial Sequence
  Description of Artificial Sequence: Synthetic oligonucleotide
acuacagccauaacccca

SEQ ID NO: 49604 - RNA, 18 nt, Artificial Sequence
  Description of Artificial Sequence: Synthetic oligonucleotide
accucacuacagccauaa

SEQ ID NO: 49605 - RNA, 18 nt, Artificial Sequence
  Description of Artificial Sequence: Synthetic oligonucleotide
cauggaccucacuacagc

SEQ ID NO: 49606 - RNA, 18 nt, Artificial Sequence
  Description of Artificial Sequence: Synthetic oligonucleotide
guacacauggaccucacu

SEQ ID NO: 49607 - RNA, 18 nt, Artificial Sequence
  Description of Artificial Sequence: Synthetic oligonucleotide
aacaaguacacauggacc

SEQ ID NO: 49608 - RNA, 18 nt, Artificial Sequence
  Description of Artificial Sequence: Synthetic oligonucleotide
caaggaacaaguacacau

SEQ ID NO: 49609 - RNA, 18 nt, Artificial Sequence
  Description of Artificial Sequence: Synthetic oligonucleotide
caugccaaggaacaagua

SEQ ID NO: 49610 - RNA, 18 nt, Artificial Sequence
  Description of Artificial Sequence: Synthetic oligonucleotide
agacacaugccaaggaac

SEQ ID NO: 49611 - RNA, 18 nt, Artificial Sequence
  Description of Artificial Sequence: Synthetic oligonucleotide
gagucagacacaugccaa

SEQ ID NO: 49612 - RNA, 18 nt, Artificial Sequence
  Description of Artificial Sequence: Synthetic oligonucleotide
acacagagucagacacau

SEQ ID NO: 49613 - RNA, 18 nt, Artificial Sequence
  Description of Artificial Sequence: Synthetic oligonucleotide
cagcaacacagagucaga

SEQ ID NO: 49614 - RNA, 18 nt, Artificial Sequence
  Description of Artificial Sequence: Synthetic oligonucleotide
ugcagcagcaacacagag

SEQ ID NO: 49615 - RNA, 18 nt, Artificial Sequence
  Description of Artificial Sequence: Synthetic oligonucleotide
uguacugcagcagcaaca

SEQ ID NO: 49616 - RNA, 18 nt, Artificial Sequence
  Description of Artificial Sequence: Synthetic oligonucleotide
cccacuguacugcagcag

SEQ ID NO: 49617 - RNA, 18 nt, Artificial Sequence
  Description of Artificial Sequence: Synthetic oligonucleotide
cccugcccacuguacugc

SEQ ID NO: 49618 - RNA, 18 nt, Artificial Sequence
  Description of Artificial Sequence: Synthetic oligonucleotide
cgugccccugcccacugu

SEQ ID NO: 49619 - RNA, 18 nt, Artificial Sequence
  Description of Artificial Sequence: Synthetic oligonucleotide
gcaaccgugccccugccc

SEQ ID NO: 49620 - RNA, 18 nt, Artificial Sequence
  Description of Artificial Sequence: Synthetic oligonucleotide
uccaagcaaccgugcccc

SEQ ID NO: 49621 - RNA, 18 nt, Artificial Sequence
  Description of Artificial Sequence: Synthetic oligonucleotide
cccaguccaagcaaccgu

SEQ ID NO: 49622 - RNA, 18 nt, Artificial Sequence
  Description of Artificial Sequence: Synthetic oligonucleotide
ggcagcccaguccaagca

SEQ ID NO: 49623 - RNA, 18 nt, Artificial Sequence
  Description of Artificial Sequence: Synthetic oligonucleotide
caucgggcagcccagucc

SEQ ID NO: 49624 - RNA, 18 nt, Artificial Sequence
  Description of Artificial Sequence: Synthetic oligonucleotide
ccagacaucgggcagccc

SEQ ID NO: 49625 - RNA, 18 nt, Artificial Sequence
  Description of Artificial Sequence: Synthetic oligonucleotide
ccaugccagacaucgggc

SEQ ID NO: 49626 - RNA, 18 nt, Artificial Sequence
  Description of Artificial Sequence: Synthetic oligonucleotide
accagccaugccagacau

SEQ ID NO: 49627 - RNA, 18 nt, Artificial Sequence
  Description of Artificial Sequence: Synthetic oligonucleotide
ggaccaccagccaugcca

SEQ ID NO: 49628 - RNA, 18 nt, Artificial Sequence
  Description of Artificial Sequence: Synthetic oligonucleotide
caacaggaccaccagcca

SEQ ID NO: 49629 - RNA, 18 nt, Artificial Sequence
  Description of Artificial Sequence: Synthetic oligonucleotide
aaggacaacaggaccacc

SEQ ID NO: 49630 - RNA, 18 nt, Artificial Sequence
  Description of Artificial Sequence: Synthetic oligonucleotide
aaauaaaggacaacagga

SEQ ID NO: 49631 - RNA, 18 nt, Artificial Sequence
  Description of Artificial Sequence: Synthetic oligonucleotide
cgaucaaauaaaggacaa

SEQ ID NO: 49632 - RNA, 18 nt, Artificial Sequence
  Description of Artificial Sequence: Synthetic oligonucleotide
gcuaucgaucaaauaaag

SEQ ID NO: 49633 - RNA, 18 nt, Artificial Sequence
  Description of Artificial Sequence: Synthetic oligonucleotide
ucccugcuaucgaucaaa

SEQ ID NO: 49634 - RNA, 18 nt, Artificial Sequence
  Description of Artificial Sequence: Synthetic oligonucleotide
ucaguucccugcuaucga

SEQ ID NO: 49635 - RNA, 18 nt, Artificial Sequence
  Description of Artificial Sequence: Synthetic oligonucleotide
ggcggucaguucccugcu

SEQ ID NO: 49636 - RNA, 18 nt, Artificial Sequence
  Description of Artificial Sequence: Synthetic oligonucleotide
accucggcggucaguucc

SEQ ID NO: 49637 - RNA, 18 nt, Artificial Sequence
  Description of Artificial Sequence: Synthetic oligonucleotide
ugccaaccucggcgguca

SEQ ID NO: 49638 - RNA, 18 nt, Artificial Sequence
  Description of Artificial Sequence: Synthetic oligonucleotide
accugugccaaccucggc

SEQ ID NO: 49639 - RNA, 18 nt, Artificial Sequence
  Description of Artificial Sequence: Synthetic oligonucleotide
ugccaaccugugccaacc

SEQ ID NO: 49640 - RNA, 18 nt, Artificial Sequence
  Description of Artificial Sequence: Synthetic oligonucleotide
cccccugccaaccugugc

SEQ ID NO: 49641 - RNA, 18 nt, Artificial Sequence
  Description of Artificial Sequence: Synthetic oligonucleotide
cucaucccccugccaacc

SEQ ID NO: 49642 - RNA, 18 nt, Artificial Sequence
  Description of Artificial Sequence: Synthetic oligonucleotide
gcauccucaucccccugc

SEQ ID NO: 49643 - RNA, 18 nt, Artificial Sequence
  Description of Artificial Sequence: Synthetic oligonucleotide
acaaugcauccucauccc

SEQ ID NO: 49644 - RNA, 18 nt, Artificial Sequence
  Description of Artificial Sequence: Synthetic oligonucleotide
caaccacaaugcauccuc

SEQ ID NO: 49645 - RNA, 18 nt, Artificial Sequence
  Description of Artificial Sequence: Synthetic oligonucleotide
ggagacaaccacaaugca

SEQ ID NO: 49646 - RNA, 18 nt, Artificial Sequence
  Description of Artificial Sequence: Synthetic oligonucleotide
gaggaggagacaaccaca

SEQ ID NO: 49647 - RNA, 18 nt, Artificial Sequence
  Description of Artificial Sequence: Synthetic oligonucleotide
gagaggaggaggagacaa

SEQ ID NO: 49648 - RNA, 18 nt, Artificial Sequence
  Description of Artificial Sequence: Synthetic oligonucleotide
agaaggagaggaggagga

SEQ ID NO: 49649 - RNA, 18 nt, Artificial Sequence
  Description of Artificial Sequence: Synthetic oligonucleotide
gaggaagaaggagaggag

SEQ ID NO: 49650 - RNA, 18 nt, Artificial Sequence
  Description of Artificial Sequence: Synthetic oligonucleotide
gggaagaggaagaaggag

SEQ ID NO: 49651 - RNA, 18 nt, Artificial Sequence
  Description of Artificial Sequence: Synthetic oligonucleotide
aaaggagaggaggaaggg

SEQ ID NO: 49652 - RNA, 18 nt, Artificial Sequence
  Description of Artificial Sequence: Synthetic oligonucleotide
agaaaggagaggaggaag

SEQ ID NO: 49653 - RNA, 18 nt, Artificial Sequence
  Description of Artificial Sequence: Synthetic oligonucleotide
agaacagaaaggagagga

SEQ ID NO: 49654 - RNA, 18 nt, Artificial Sequence
  Description of Artificial Sequence: Synthetic oligonucleotide
gaacaagaacagaaagga

SEQ ID NO: 49655 - RNA, 18 nt, Artificial Sequence
  Description of Artificial Sequence: Synthetic oligonucleotide
agggagaacaagaacaga

SEQ ID NO: 49656 - RNA, 18 nt, Artificial Sequence
  Description of Artificial Sequence: Synthetic oligonucleotide
agaugagggagaacaaga

SEQ ID NO: 49657 - RNA, 18 nt, Artificial Sequence
  Description of Artificial Sequence: Synthetic oligonucleotide
gaggaagaugagggagaa

SEQ ID NO: 49658 - RNA, 18 nt, Artificial Sequence
  Description of Artificial Sequence: Synthetic oligonucleotide
aggaagaggaagaugagg

SEQ ID NO: 49659 - RNA, 18 nt, Artificial Sequence
  Description of Artificial Sequence: Synthetic oligonucleotide
gaagaaggaagaggaaga

SEQ ID NO: 49660 - RNA, 18 nt, Artificial Sequence
  Description of Artificial Sequence: Synthetic oligonucleotide
agggagaagaaggaagag

SEQ ID NO: 49661 - RNA, 18 nt, Artificial Sequence
  Description of Artificial Sequence: Synthetic oligonucleotide
agaagagggagaagaagg

SEQ ID NO: 49662 - RNA, 18 nt, Artificial Sequence
  Description of Artificial Sequence: Synthetic oligonucleotide
gaggaagaagagggagaa

SEQ ID NO: 49663 - RNA, 18 nt, Artificial Sequence
  Description of Artificial Sequence: Synthetic oligonucleotide
gugaagaggaagaagagg

SEQ ID NO: 49664 - RNA, 18 nt, Artificial Sequence
  Description of Artificial Sequence: Synthetic oligonucleotide
gcagagugaagaggaaga

SEQ ID NO: 49665 - RNA, 18 nt, Artificial Sequence
  Description of Artificial Sequence: Synthetic oligonucleotide
agagagcagagugaagag

SEQ ID NO: 49666 - RNA, 18 nt, Artificial Sequence
  Description of Artificial Sequence: Synthetic oligonucleotide
agagaagagagcagagug

SEQ ID NO: 49667 - RNA, 18 nt, Artificial Sequence
  Description of Artificial Sequence: Synthetic oligonucleotide
aaagaagagaagagagca

SEQ ID NO: 49668 - RNA, 18 nt, Artificial Sequence
  Description of Artificial Sequence: Synthetic oligonucleotide
ugauucacuccgcuguga

SEQ ID NO: 49669 - RNA, 18 nt, Artificial Sequence
  Description of Artificial Sequence: Synthetic oligonucleotide
cgagcugauucacuccgc

SEQ ID NO: 49670 - RNA, 18 nt, Artificial Sequence
  Description of Artificial Sequence: Synthetic oligonucleotide
accaccgagcugauucac

SEQ ID NO: 49671 - RNA, 18 nt, Artificial Sequence
  Description of Artificial Sequence: Synthetic oligonucleotide
aagacaccaccgagcuga

SEQ ID NO: 49672 - RNA, 18 nt, Artificial Sequence
  Description of Artificial Sequence: Synthetic oligonucleotide
ugacaaagacaccaccga

SEQ ID NO: 49673 - RNA, 18 nt, Artificial Sequence
  Description of Artificial Sequence: Synthetic oligonucleotide
cccguugacaaagacacc

SEQ ID NO: 49674 - RNA, 18 nt, Artificial Sequence
  Description of Artificial Sequence: Synthetic oligonucleotide
ggccgcccguugacaaag

SEQ ID NO: 49675 - RNA, 18 nt, Artificial Sequence
  Description of Artificial Sequence: Synthetic oligonucleotide
gcaguggccgcccguuga

SEQ ID NO: 49676 - RNA, 18 nt, Artificial Sequence
  Description of Artificial Sequence: Synthetic oligonucleotide
guccggcaguggccgccc

SEQ ID NO: 49677 - RNA, 18 nt, Artificial Sequence
  Description of Artificial Sequence: Synthetic oligonucleotide
guggaguccggcaguggc

SEQ ID NO: 49678 - RNA, 18 nt, Artificial Sequence
  Description of Artificial Sequence: Synthetic oligonucleotide
gccggguggaguccggca

SEQ ID NO: 49679 - RNA, 18 nt, Artificial Sequence
  Description of Artificial Sequence: Synthetic oligonucleotide
cuucugccggguggaguc

SEQ ID NO: 49680 - RNA, 18 nt, Artificial Sequence
  Description of Artificial Sequence: Synthetic oligonucleotide
acaaucuucugccgggug

SEQ ID NO: 49681 - RNA, 18 nt, Artificial Sequence
  Description of Artificial Sequence: Synthetic oligonucleotide
gcucuacaaucuucugcc

SEQ ID NO: 49682 - RNA, 18 nt, Artificial Sequence
  Description of Artificial Sequence: Synthetic oligonucleotide
agcuagcucuacaaucuu

SEQ ID NO: 49683 - RNA, 18 nt, Artificial Sequence
  Description of Artificial Sequence: Synthetic oligonucleotide
cugugagcuagcucuaca

SEQ ID NO: 49684 - RNA, 18 nt, Artificial Sequence
  Description of Artificial Sequence: Synthetic oligonucleotide
ccccgcugugagcuagcu

SEQ ID NO: 49685 - RNA, 18 nt, Artificial Sequence
  Description of Artificial Sequence: Synthetic oligonucleotide
ccgggccccgcugugagc

SEQ ID NO: 49686 - RNA, 18 nt, Artificial Sequence
  Description of Artificial Sequence: Synthetic oligonucleotide
cacggccgggccccgcug

SEQ ID NO: 49687 - RNA, 18 nt, Artificial Sequence
  Description of Artificial Sequence: Synthetic oligonucleotide
ugucgcacggccgggccc

SEQ ID NO: 49688 - RNA, 18 nt, Artificial Sequence
  Description of Artificial Sequence: Synthetic oligonucleotide
ggaaaugucgcacggccg

SEQ ID NO: 49689 - RNA, 18 nt, Artificial Sequence
  Description of Artificial Sequence: Synthetic oligonucleotide
auucgggaaaugucgcac

SEQ ID NO: 49690 - RNA, 18 nt, Artificial Sequence
  Description of Artificial Sequence: Synthetic oligonucleotide
gcagaauucgggaaaugu

SEQ ID NO: 49691 - RNA, 18 nt, Artificial Sequence
  Description of Artificial Sequence: Synthetic oligonucleotide
cuuuugcaucugcauggg

SEQ ID NO: 49692 - RNA, 18 nt, Artificial Sequence
  Description of Artificial Sequence: Synthetic oligonucleotide
uuggacuuuugcaucugc

SEQ ID NO: 49693 - RNA, 18 nt, Artificial Sequence
  Description of Artificial Sequence: Synthetic oligonucleotide
agcacuuggacuuuugca

SEQ ID NO: 49694 - RNA, 18 nt, Artificial Sequence
  Description of Artificial Sequence: Synthetic oligonucleotide
uguccagcacuuggacuu

SEQ ID NO: 49695 - RNA, 18 nt, Artificial Sequence
  Description of Artificial Sequence: Synthetic oligonucleotide
uugauuguccagcacuug

SEQ ID NO: 49696 - RNA, 18 nt, Artificial Sequence
  Description of Artificial Sequence: Synthetic oligonucleotide
gcauuaaacaaugacaag

SEQ ID NO: 49697 - RNA, 18 nt, Artificial Sequence
  Description of Artificial Sequence: Synthetic oligonucleotide
aguaugcauuaaacaaug

SEQ ID NO: 49698 - RNA, 18 nt, Artificial Sequence
  Description of Artificial Sequence: Synthetic oligonucleotide
guuuaaguaugcauuaaa

SEQ ID NO: 49699 - RNA, 18 nt, Artificial Sequence
  Description of Artificial Sequence: Synthetic oligonucleotide
aaauuguuuaaguaugca

SEQ ID NO: 49700 - RNA, 18 nt, Artificial Sequence
  Description of Artificial Sequence: Synthetic oligonucleotide
aaauaaaauuguuuaagu

SEQ ID NO: 49701 - RNA, 18 nt, Artificial Sequence
  Description of Artificial Sequence: Synthetic oligonucleotide
gacaaaaauaaaauuguu

SEQ ID NO: 49702 - RNA, 18 nt, Artificial Sequence
  Description of Artificial Sequence: Synthetic oligonucleotide
uucaagacaaaaauaaaa

SEQ ID NO: 49703 - RNA, 18 nt, Artificial Sequence
  Description of Artificial Sequence: Synthetic oligonucleotide
auaauuucaagacaaaaa

SEQ ID NO: 49704 - RNA, 18 nt, Artificial Sequence
  Description of Artificial Sequence: Synthetic oligonucleotide
uauuaauaauuucaagac

SEQ ID NO: 49705 - RNA, 18 nt, Artificial Sequence
  Description of Artificial Sequence: Synthetic oligonucleotide
cacauuauuaauaauuuc

SEQ ID NO: 49706 - RNA, 18 nt, Artificial Sequence
  Description of Artificial Sequence: Synthetic oligonucleotide
aaaaccacauuauuaaua

SEQ ID NO: 49707 - RNA, 18 nt, Artificial Sequence
  Description of Artificial Sequence: Synthetic oligonucleotide
gacagaaaaccacauuau

SEQ ID NO: 49708 - RNA, 18 nt, Artificial Sequence
  Description of Artificial Sequence: Synthetic oligonucleotide
uguuuaaguaugcauuaa

SEQ ID NO: 49709 - RNA, 18 nt, Artificial Sequence
  Description of Artificial Sequence: Synthetic oligonucleotide
aaaauuguuuaaguaugc

SEQ ID NO: 49710 - RNA, 18 nt, Artificial Sequence
  Description of Artificial Sequence: Synthetic oligonucleotide
aaaauaaaauuguuuaag

SEQ ID NO: 49711 - RNA, 18 nt, Artificial Sequence
  Description of Artificial Sequence: Synthetic oligonucleotide
agacaaaaauaaaauugu

SEQ ID NO: 49712 - RNA, 18 nt, Artificial Sequence
  Description of Artificial Sequence: Synthetic oligonucleotide
uuucaagacaaaaauaaa

SEQ ID NO: 49713 - RNA, 18 nt, Artificial Sequence
  Description of Artificial Sequence: Synthetic oligonucleotide
aauaauuucaagacaaaa

SEQ ID NO: 49714 - RNA, 18 nt, Artificial Sequence
  Description of Artificial Sequence: Synthetic oligonucleotide
uuauuaauaauuucaaga

SEQ ID NO: 49715 - RNA, 18 nt, Artificial Sequence
  Description of Artificial Sequence: Synthetic oligonucleotide
ccacauuauuaauaauuu

SEQ ID NO: 49716 - RNA, 18 nt, Artificial Sequence
  Description of Artificial Sequence: Synthetic oligonucleotide
gaaaaccacauuauuaau

SEQ ID NO: 49717 - RNA, 18 nt, Artificial Sequence
  Description of Artificial Sequence: Synthetic oligonucleotide
ggacagaaaaccacauua

SEQ ID NO: 49718 - RNA, 18 nt, Artificial Sequence
  Description of Artificial Sequence: Synthetic oligonucleotide
ucacacauccguuggaca

SEQ ID NO: 49719 - RNA, 18 nt, Artificial Sequence
  Description of Artificial Sequence: Synthetic oligonucleotide
uuuacucacacauccguu

SEQ ID NO: 49720 - RNA, 18 nt, Artificial Sequence
  Description of Artificial Sequence: Synthetic oligonucleotide
agaauuuuacucacacau

SEQ ID NO: 49721 - RNA, 18 nt, Artificial Sequence
  Description of Artificial Sequence: Synthetic oligonucleotide
ugcccagaauuuuacuca

SEQ ID NO: 49722 - RNA, 18 nt, Artificial Sequence
  Description of Artificial Sequence: Synthetic oligonucleotide
auaccugcccagaauuuu

SEQ ID NO: 49723 - RNA, 18 nt, Artificial Sequence
  Description of Artificial Sequence: Synthetic oligonucleotide
ucguaauaccugcccaga

SEQ ID NO: 49724 - RNA, 18 nt, Artificial Sequence
  Description of Artificial Sequence: Synthetic oligonucleotide
cagucucguaauaccugc

SEQ ID NO: 49725 - RNA, 18 nt, Artificial Sequence
  Description of Artificial Sequence: Synthetic oligonucleotide
ggagccagucucguaaua

SEQ ID NO: 49726 - RNA, 18 nt, Artificial Sequence
  Description of Artificial Sequence: Synthetic oligonucleotide
cugauggagccagucucg

SEQ ID NO: 49727 - RNA, 18 nt, Artificial Sequence
  Description of Artificial Sequence: Synthetic oligonucleotide
ugggucugauggagccag

SEQ ID NO: 49728 - RNA, 18 nt, Artificial Sequence
  Description of Artificial Sequence: Synthetic oligonucleotide
ugcccugggucugaugga

SEQ ID NO: 49729 - RNA, 18 nt, Artificial Sequence
  Description of Artificial Sequence: Synthetic oligonucleotide
ccgauugcccugggucug

SEQ ID NO: 49730 - RNA, 18 nt, Artificial Sequence
  Description of Artificial Sequence: Synthetic oligonucleotide
uaccaccgauugcccugg

SEQ ID NO: 49731 - RNA, 18 nt, Artificial Sequence
  Description of Artificial Sequence: Synthetic oligonucleotide
uuuacuaccaccgauugc

SEQ ID NO: 49732 - RNA, 18 nt, Artificial Sequence
  Description of Artificial Sequence: Synthetic oligonucleotide
cucgguuuacuaccaccg

SEQ ID NO: 49733 - RNA, 18 nt, Artificial Sequence
  Description of Artificial Sequence: Synthetic oligonucleotide
cuacucucgguuuacuac

SEQ ID NO: 49734 - RNA, 18 nt, Artificial Sequence
  Description of Artificial Sequence: Synthetic oligonucleotide
agucgcuacucucgguuu

SEQ ID NO: 49735 - RNA, 18 nt, Artificial Sequence
  Description of Artificial Sequence: Synthetic oligonucleotide
ucuggagucgcuacucuc

SEQ ID NO: 49736 - RNA, 18 nt, Artificial Sequence
  Description of Artificial Sequence: Synthetic oligonucleotide
caacuucuggagucgcua

SEQ ID NO: 49737 - RNA, 18 nt, Artificial Sequence
  Description of Artificial Sequence: Synthetic oligonucleotide
gcuuacaacuucuggagu

SEQ ID NO: 49738 - RNA, 18 nt, Artificial Sequence
  Description of Artificial Sequence: Synthetic oligonucleotide
auuuugcuuacaacuucu

SEQ ID NO: 49739 - RNA, 18 nt, Artificial Sequence
  Description of Artificial Sequence: Synthetic oligonucleotide
gggcuauuuugcuuacaa

SEQ ID NO: 49740 - RNA, 18 nt, Artificial Sequence
  Description of Artificial Sequence: Synthetic oligonucleotide
auacugggcuauuuugcu

SEQ ID NO: 49741 - RNA, 18 nt, Artificial Sequence
  Description of Artificial Sequence: Synthetic oligonucleotide
cgcuuauacugggcuauu

SEQ ID NO: 49742 - RNA, 18 nt, Artificial Sequence
  Description of Artificial Sequence: Synthetic oligonucleotide
acucccgcuuauacuggg

SEQ ID NO: 49743 - RNA, 18 nt, Artificial Sequence
  Description of Artificial Sequence: Synthetic oligonucleotide
cgggcacucccgcuuaua

SEQ ID NO: 49744 - RNA, 18 nt, Artificial Sequence
  Description of Artificial Sequence: Synthetic oligonucleotide
auggacgggcacucccgc

SEQ ID NO: 49745 - RNA, 18 nt, Artificial Sequence
  Description of Artificial Sequence: Synthetic oligonucleotide
caaagauggacgggcacu

SEQ ID NO: 49746 - RNA, 18 nt, Artificial Sequence
  Description of Artificial Sequence: Synthetic oligonucleotide
ccaagcaaagauggacgg

SEQ ID NO: 49747 - RNA, 18 nt, Artificial Sequence
  Description of Artificial Sequence: Synthetic oligonucleotide
auuucccaagcaaagaug

SEQ ID NO: 49748 - RNA, 18 nt, Artificial Sequence
  Description of Artificial Sequence: Synthetic oligonucleotide
cucggauuucccaagcaa

SEQ ID NO: 49749 - RNA, 18 nt, Artificial Sequence
  Description of Artificial Sequence: Synthetic oligonucleotide
ucugucucggauuuccca

SEQ ID NO: 49750 - RNA, 18 nt, Artificial Sequence
  Description of Artificial Sequence: Synthetic oligonucleotide
aguaaucugucucggauu

SEQ ID NO: 49751 - RNA, 18 nt, Artificial Sequence
  Description of Artificial Sequence: Synthetic oligonucleotide
cggacaguaaucugucuc

SEQ ID NO: 49752 - RNA, 18 nt, Artificial Sequence
  Description of Artificial Sequence: Synthetic oligonucleotide
ccccucggacaguaaucu

SEQ ID NO: 49753 - RNA, 18 nt, Artificial Sequence
  Description of Artificial Sequence: Synthetic oligonucleotide
cagacccccucggacagu

SEQ ID NO: 49754 - RNA, 18 nt, Artificial Sequence
  Description of Artificial Sequence: Synthetic oligonucleotide
ugguacagacccccucgg

SEQ ID NO: 49755 - RNA, 18 nt, Artificial Sequence
  Description of Artificial Sequence: Synthetic oligonucleotide
aucguugguacagacccc

SEQ ID NO: 49756 - RNA, 18 nt, Artificial Sequence
  Description of Artificial Sequence: Synthetic oligonucleotide
auguuaucguugguacag

SEQ ID NO: 49757 - RNA, 18 nt, Artificial Sequence
  Description of Artificial Sequence: Synthetic oligonucleotide
uugguauguuaucguugg

SEQ ID NO: 49758 - RNA, 18 nt, Artificial Sequence
  Description of Artificial Sequence: Synthetic oligonucleotide
cacacauccguuggacac

SEQ ID NO: 49759 - RNA, 18 nt, Artificial Sequence
  Description of Artificial Sequence: Synthetic oligonucleotide
uuacucacacauccguug

SEQ ID NO: 49760 - RNA, 18 nt, Artificial Sequence
  Description of Artificial Sequence: Synthetic oligonucleotide
gaauuuuacucacacauc

SEQ ID NO: 49761 - RNA, 18 nt, Artificial Sequence
  Description of Artificial Sequence: Synthetic oligonucleotide
gcccagaauuuuacucac

SEQ ID NO: 49762 - RNA, 18 nt, Artificial Sequence
  Description of Artificial Sequence: Synthetic oligonucleotide
uaccugcccagaauuuua

SEQ ID NO: 49763 - RNA, 18 nt, Artificial Sequence
  Description of Artificial Sequence: Synthetic oligonucleotide
cguaauaccugcccagaa

SEQ ID NO: 49764 - RNA, 18 nt, Artificial Sequence
  Description of Artificial Sequence: Synthetic oligonucleotide
agucucguaauaccugcc

SEQ ID NO: 49765 - RNA, 18 nt, Artificial Sequence
  Description of Artificial Sequence: Synthetic oligonucleotide
gagccagucucguaauac

SEQ ID NO: 49766 - RNA, 18 nt, Artificial Sequence
  Description of Artificial Sequence: Synthetic oligonucleotide
ugauggagccagucucgu

SEQ ID NO: 49767 - RNA, 18 nt, Artificial Sequence
  Description of Artificial Sequence: Synthetic oligonucleotide
gggucugauggagccagu

SEQ ID NO: 49768 - RNA, 18 nt, Artificial Sequence
  Description of Artificial Sequence: Synthetic oligonucleotide
gcccugggucugauggag

SEQ ID NO: 49769 - RNA, 18 nt, Artificial Sequence
  Description of Artificial Sequence: Synthetic oligonucleotide
cgauugcccugggucuga

SEQ ID NO: 49770 - RNA, 18 nt, Artificial Sequence
  Description of Artificial Sequence: Synthetic oligonucleotide
accaccgauugcccuggg

SEQ ID NO: 49771 - RNA, 18 nt, Artificial Sequence
  Description of Artificial Sequence: Synthetic oligonucleotide
uuacuaccaccgauugcc

SEQ ID NO: 49772 - RNA, 18 nt, Artificial Sequence
  Description of Artificial Sequence: Synthetic oligonucleotide
ucgguuuacuaccaccga

SEQ ID NO: 49773 - RNA, 18 nt, Artificial Sequence
  Description of Artificial Sequence: Synthetic oligonucleotide
uacucucgguuuacuacc

SEQ ID NO: 49774 - RNA, 18 nt, Artificial Sequence
  Description of Artificial Sequence: Synthetic oligonucleotide
gucgcuacucucgguuua

SEQ ID NO: 49775 - RNA, 18 nt, Artificial Sequence
  Description of Artificial Sequence: Synthetic oligonucleotide
cuggagucgcuacucucg

SEQ ID NO: 49776 - RNA, 18 nt, Artificial Sequence
  Description of Artificial Sequence: Synthetic oligonucleotide
aacuucuggagucgcuac

SEQ ID NO: 49777 - RNA, 18 nt, Artificial Sequence
  Description of Artificial Sequence: Synthetic oligonucleotide
cuuacaacuucuggaguc

SEQ ID NO: 49778 - RNA, 18 nt, Artificial Sequence
  Description of Artificial Sequence: Synthetic oligonucleotide
uuuugcuuacaacuucug

SEQ ID NO: 49779 - RNA, 18 nt, Artificial Sequence
  Description of Artificial Sequence: Synthetic oligonucleotide
ggcuauuuugcuuacaac

SEQ ID NO: 49780 - RNA, 18 nt, Artificial Sequence
  Description of Artificial Sequence: Synthetic oligonucleotide
uacugggcuauuuugcuu

SEQ ID NO: 49781 - RNA, 18 nt, Artificial Sequence
  Description of Artificial Sequence: Synthetic oligonucleotide
gcuuauacugggcuauuu

SEQ ID NO: 49782 - RNA, 18 nt, Artificial Sequence
  Description of Artificial Sequence: Synthetic oligonucleotide
cucccgcuuauacugggc

SEQ ID NO: 49783 - RNA, 18 nt, Artificial Sequence
  Description of Artificial Sequence: Synthetic oligonucleotide
gggcacucccgcuuauac

SEQ ID NO: 49784 - RNA, 18 nt, Artificial Sequence
  Description of Artificial Sequence: Synthetic oligonucleotide
uggacgggcacucccgcu

SEQ ID NO: 49785 - RNA, 18 nt, Artificial Sequence
  Description of Artificial Sequence: Synthetic oligonucleotide
aaagauggacgggcacuc

SEQ ID NO: 49786 - RNA, 18 nt, Artificial Sequence
  Description of Artificial Sequence: Synthetic oligonucleotide
caagcaaagauggacggg

SEQ ID NO: 49787 - RNA, 18 nt, Artificial Sequence
  Description of Artificial Sequence: Synthetic oligonucleotide
uuucccaagcaaagaugg

SEQ ID NO: 49788 - RNA, 18 nt, Artificial Sequence
  Description of Artificial Sequence: Synthetic oligonucleotide
ucggauuucccaagcaaa

SEQ ID NO: 49789 - RNA, 18 nt, Artificial Sequence
  Description of Artificial Sequence: Synthetic oligonucleotide
cugucucggauuucccaa

SEQ ID NO: 49790 - RNA, 18 nt, Artificial Sequence
  Description of Artificial Sequence: Synthetic oligonucleotide
guaaucugucucggauuu

SEQ ID NO: 49791 - RNA, 18 nt, Artificial Sequence
  Description of Artificial Sequence: Synthetic oligonucleotide
ggacaguaaucugucucg

SEQ ID NO: 49792 - RNA, 18 nt, Artificial Sequence
  Description of Artificial Sequence: Synthetic oligonucleotide
cccucggacaguaaucug

SEQ ID NO: 49793 - RNA, 18 nt, Artificial Sequence
  Description of Artificial Sequence: Synthetic oligonucleotide
agacccccucggacagua

SEQ ID NO: 49794 - RNA, 18 nt, Artificial Sequence
  Description of Artificial Sequence: Synthetic oligonucleotide
gguacagacccccucgga

SEQ ID NO: 49795 - RNA, 18 nt, Artificial Sequence
  Description of Artificial Sequence: Synthetic oligonucleotide
ucguugguacagaccccc

SEQ ID NO: 49796 - RNA, 18 nt, Artificial Sequence
  Description of Artificial Sequence: Synthetic oligonucleotide
uguuaucguugguacaga

SEQ ID NO: 49797 - RNA, 18 nt, Artificial Sequence
  Description of Artificial Sequence: Synthetic oligonucleotide
ugguauguuaucguuggu

SEQ ID NO: 49798 - RNA, 18 nt, Artificial Sequence
  Description of Artificial Sequence: Synthetic oligonucleotide
gcagauguucucaaugaa

SEQ ID NO: 49799 - RNA, 18 nt, Artificial Sequence
  Description of Artificial Sequence: Synthetic oligonucleotide
ggagggcagauguucuca

SEQ ID NO: 49800 - RNA, 18 nt, Artificial Sequence
  Description of Artificial Sequence: Synthetic oligonucleotide
ggcagggagggcagaugu

SEQ ID NO: 49801 - RNA, 18 nt, Artificial Sequence
  Description of Artificial Sequence: Synthetic oligonucleotide
cuuagggcagggagggca

SEQ ID NO: 49802 - RNA, 18 nt, Artificial Sequence
  Description of Artificial Sequence: Synthetic oligonucleotide
uugggcuuagggcaggga

SEQ ID NO: 49803 - RNA, 18 nt, Artificial Sequence
  Description of Artificial Sequence: Synthetic oligonucleotide
gagcauugggcuuagggc

SEQ ID NO: 49804 - RNA, 18 nt, Artificial Sequence
  Description of Artificial Sequence: Synthetic oligonucleotide
ggagagagcauugggcuu

SEQ ID NO: 49805 - RNA, 18 nt, Artificial Sequence
  Description of Artificial Sequence: Synthetic oligonucleotide
aaagaggagagagcauug

SEQ ID NO: 49806 - RNA, 18 nt, Artificial Sequence
  Description of Artificial Sequence: Synthetic oligonucleotide
gagguaaagaggagagag

SEQ ID NO: 49807 - RNA, 18 nt, Artificial Sequence
  Description of Artificial Sequence: Synthetic oligonucleotide
gggaggagguaaagagga

SEQ ID NO: 49808 - RNA, 18 nt, Artificial Sequence
  Description of Artificial Sequence: Synthetic oligonucleotide
agggugggaggagguaaa

SEQ ID NO: 49809 - RNA, 18 nt, Artificial Sequence
  Description of Artificial Sequence: Synthetic oligonucleotide
gagagagggugggaggag

SEQ ID NO: 49810 - RNA, 18 nt, Artificial Sequence
  Description of Artificial Sequence: Synthetic oligonucleotide
guggagagagaggguggg

SEQ ID NO: 49811 - RNA, 18 nt, Artificial Sequence
  Description of Artificial Sequence: Synthetic oligonucleotide
agacaguggagagagagg

SEQ ID NO: 49812 - RNA, 18 nt, Artificial Sequence
  Description of Artificial Sequence: Synthetic oligonucleotide
cuaagagacaguggagag

SEQ ID NO: 49813 - RNA, 18 nt, Artificial Sequence
  Description of Artificial Sequence: Synthetic oligonucleotide
acagacuaagagacagug

SEQ ID NO: 49814 - RNA, 18 nt, Artificial Sequence
  Description of Artificial Sequence: Synthetic oligonucleotide
aggacacagacuaagaga

SEQ ID NO: 49815 - RNA, 18 nt, Artificial Sequence
  Description of Artificial Sequence: Synthetic oligonucleotide
gggagaggacacagacua

SEQ ID NO: 49816 - RNA, 18 nt, Artificial Sequence
  Description of Artificial Sequence: Synthetic oligonucleotide
gagcagggagaggacaca

SEQ ID NO: 49817 - RNA, 18 nt, Artificial Sequence
  Description of Artificial Sequence: Synthetic oligonucleotide
auguggagcagggagagg

SEQ ID NO: 49818 - RNA, 18 nt, Artificial Sequence
  Description of Artificial Sequence: Synthetic oligonucleotide
gacaaauguggagcaggg

SEQ ID NO: 49819 - RNA, 18 nt, Artificial Sequence
  Description of Artificial Sequence: Synthetic oligonucleotide
aaggagacaaauguggag

SEQ ID NO: 49820 - RNA, 18 nt, Artificial Sequence
  Description of Artificial Sequence: Synthetic oligonucleotide
guacaaaggagacaaaug

SEQ ID NO: 49821 - RNA, 18 nt, Artificial Sequence
  Description of Artificial Sequence: Synthetic oligonucleotide
cccagguacaaaggagac

SEQ ID NO: 49822 - RNA, 18 nt, Artificial Sequence
  Description of Artificial Sequence: Synthetic oligonucleotide
guucccccagguacaaag

SEQ ID NO: 49823 - RNA, 18 nt, Artificial Sequence
  Description of Artificial Sequence: Synthetic oligonucleotide
ucucuguucccccaggua

SEQ ID NO: 49824 - RNA, 18 nt, Artificial Sequence
  Description of Artificial Sequence: Synthetic oligonucleotide
auuccucucuguuccccc

SEQ ID NO: 49825 - RNA, 18 nt, Artificial Sequence
  Description of Artificial Sequence: Synthetic oligonucleotide
agggcauuccucucuguu

SEQ ID NO: 49826 - RNA, 18 nt, Artificial Sequence
  Description of Artificial Sequence: Synthetic oligonucleotide
aagucagggcauuccucu

SEQ ID NO: 49827 - RNA, 18 nt, Artificial Sequence
  Description of Artificial Sequence: Synthetic oligonucleotide
aagaaaagucagggcauu

SEQ ID NO: 49828 - RNA, 18 nt, Artificial Sequence
  Description of Artificial Sequence: Synthetic oligonucleotide
agucaaagaaaagucagg

SEQ ID NO: 49829 - RNA, 18 nt, Artificial Sequence
  Description of Artificial Sequence: Synthetic oligonucleotide
cagacagucaaagaaaag

SEQ ID NO: 49830 - RNA, 18 nt, Artificial Sequence
  Description of Artificial Sequence: Synthetic oligonucleotide
uuuuccagacagucaaag

SEQ ID NO: 49831 - RNA, 18 nt, Artificial Sequence
  Description of Artificial Sequence: Synthetic oligonucleotide
ucccauuuuccagacagu

SEQ ID NO: 49832 - RNA, 18 nt, Artificial Sequence
  Description of Artificial Sequence: Synthetic oligonucleotide
uugacucccauuuuccag

SEQ ID NO: 49833 - RNA, 18 nt, Artificial Sequence
  Description of Artificial Sequence: Synthetic oligonucleotide
cacacuugacucccauuu

SEQ ID NO: 49834 - RNA, 18 nt, Artificial Sequence
  Description of Artificial Sequence: Synthetic oligonucleotide
cuccccacacuugacucc

SEQ ID NO: 49835 - RNA, 18 nt, Artificial Sequence
  Description of Artificial Sequence: Synthetic oligonucleotide
aaugacuccccacacuug

SEQ ID NO: 49836 - RNA, 18 nt, Artificial Sequence
  Description of Artificial Sequence: Synthetic oligonucleotide
aagugaaugacuccccac

SEQ ID NO: 49837 - RNA, 18 nt, Artificial Sequence
  Description of Artificial Sequence: Synthetic oligonucleotide
aaaugaagugaaugacuc

SEQ ID NO: 49838 - RNA, 18 nt, Artificial Sequence
  Description of Artificial Sequence: Synthetic oligonucleotide
caugcaaaugaagugaau

SEQ ID NO: 49839 - RNA, 18 nt, Artificial Sequence
  Description of Artificial Sequence: Synthetic oligonucleotide
ugcagcaugcaaaugaag

SEQ ID NO: 49840 - RNA, 18 nt, Artificial Sequence
  Description of Artificial Sequence: Synthetic oligonucleotide
uguuuugcagcaugcaaa

SEQ ID NO: 49841 - RNA, 18 nt, Artificial Sequence
  Description of Artificial Sequence: Synthetic oligonucleotide
cccucuguuuugcagcau

SEQ ID NO: 49842 - RNA, 18 nt, Artificial Sequence
  Description of Artificial Sequence: Synthetic oligonucleotide
cuccgcccucuguuuugc

SEQ ID NO: 49843 - RNA, 18 nt, Artificial Sequence
  Description of Artificial Sequence: Synthetic oligonucleotide
ggugccuccgcccucugu

SEQ ID NO: 49844 - RNA, 18 nt, Artificial Sequence
  Description of Artificial Sequence: Synthetic oligonucleotide
ucccuggugccuccgccc

SEQ ID NO: 49845 - RNA, 18 nt, Artificial Sequence
  Description of Artificial Sequence: Synthetic oligonucleotide
gccuuucccuggugccuc

SEQ ID NO: 49846 - RNA, 18 nt, Artificial Sequence
  Description of Artificial Sequence: Synthetic oligonucleotide
caagugccuuucccuggu

SEQ ID NO: 49847 - RNA, 18 nt, Artificial Sequence
  Description of Artificial Sequence: Synthetic oligonucleotide
ucauucaagugccuuucc

SEQ ID NO: 49848 - RNA, 18 nt, Artificial Sequence
  Description of Artificial Sequence: Synthetic oligonucleotide
cuucuucauucaagugcc

SEQ ID NO: 49849 - RNA, 18 nt, Artificial Sequence
  Description of Artificial Sequence: Synthetic oligonucleotide
uuuuccuucuucauucaa

SEQ ID NO: 49850 - RNA, 18 nt, Artificial Sequence
  Description of Artificial Sequence: Synthetic oligonucleotide
ucucauuuuccuucuuca

SEQ ID NO: 49851 - RNA, 18 nt, Artificial Sequence
  Description of Artificial Sequence: Synthetic oligonucleotide
cugguucucauuuuccuu

SEQ ID NO: 49852 - RNA, 18 nt, Artificial Sequence
  Description of Artificial Sequence: Synthetic oligonucleotide
acaaucugguucucauuu

SEQ ID NO: 49853 - RNA, 18 nt, Artificial Sequence
  Description of Artificial Sequence: Synthetic oligonucleotide
aaguuacaaucugguucu

SEQ ID NO: 49854 - RNA, 18 nt, Artificial Sequence
  Description of Artificial Sequence: Synthetic oligonucleotide
ggacgaaguuacaaucug

SEQ ID NO: 49855 - RNA, 18 nt, Artificial Sequence
  Description of Artificial Sequence: Synthetic oligonucleotide
gauuaggacgaaguuaca

SEQ ID NO: 49856 - RNA, 18 nt, Artificial Sequence
  Description of Artificial Sequence: Synthetic oligonucleotide
agguggauuaggacgaag

SEQ ID NO: 49857 - RNA, 18 nt, Artificial Sequence
  Description of Artificial Sequence: Synthetic oligonucleotide
cuggcagguggauuagga

SEQ ID NO: 49858 - RNA, 18 nt, Artificial Sequence
  Description of Artificial Sequence: Synthetic oligonucleotide
aaguucuggcagguggau

SEQ ID NO: 49859 - RNA, 18 nt, Artificial Sequence
  Description of Artificial Sequence: Synthetic oligonucleotide
aaggaaaguucuggcagg

SEQ ID NO: 49860 - RNA, 18 nt, Artificial Sequence
  Description of Artificial Sequence: Synthetic oligonucleotide
accugaaggaaaguucug

SEQ ID NO: 49861 - RNA, 18 nt, Artificial Sequence
  Description of Artificial Sequence: Synthetic oligonucleotide
gugacaccugaaggaaag

SEQ ID NO: 49862 - RNA, 18 nt, Artificial Sequence
  Description of Artificial Sequence: Synthetic oligonucleotide
gaugugugacaccugaag

SEQ ID NO: 49863 - RNA, 18 nt, Artificial Sequence
  Description of Artificial Sequence: Synthetic oligonucleotide
aaauggaugugugacacc

SEQ ID NO: 49864 - RNA, 18 nt, Artificial Sequence
  Description of Artificial Sequence: Synthetic oligonucleotide
gauggaaauggaugugug

SEQ ID NO: 49865 - RNA, 18 nt, Artificial Sequence
  Description of Artificial Sequence: Synthetic oligonucleotide
auuaggauggaaauggau

SEQ ID NO: 49866 - RNA, 18 nt, Artificial Sequence
  Description of Artificial Sequence: Synthetic oligonucleotide
uuaauauuaggauggaaa

SEQ ID NO: 49867 - RNA, 18 nt, Artificial Sequence
  Description of Artificial Sequence: Synthetic oligonucleotide
auuguuuaauauuaggau

SEQ ID NO: 49868 - RNA, 18 nt, Artificial Sequence
  Description of Artificial Sequence: Synthetic oligonucleotide
auuauauuguuuaauauu

SEQ ID NO: 49869 - RNA, 18 nt, Artificial Sequence
  Description of Artificial Sequence: Synthetic oligonucleotide
cuuucauuauauuguuua

SEQ ID NO: 49870 - RNA, 18 nt, Artificial Sequence
  Description of Artificial Sequence: Synthetic oligonucleotide
gcuuucuuucauuauauu

SEQ ID NO: 49871 - RNA, 18 nt, Artificial Sequence
  Description of Artificial Sequence: Synthetic oligonucleotide
gaugugugacaccugaag

SEQ ID NO: 49872 - RNA, 18 nt, Artificial Sequence
  Description of Artificial Sequence: Synthetic oligonucleotide
aaauggaugugugacacc

SEQ ID NO: 49873 - RNA, 18 nt, Artificial Sequence
  Description of Artificial Sequence: Synthetic oligonucleotide
gauggaaauggaugugug

SEQ ID NO: 49874 - RNA, 18 nt, Artificial Sequence
  Description of Artificial Sequence: Synthetic oligonucleotide
auuaggauggaaauggau

SEQ ID NO: 49875 - RNA, 18 nt, Artificial Sequence
  Description of Artificial Sequence: Synthetic oligonucleotide
uuaauauuaggauggaaa

SEQ ID NO: 49876 - RNA, 18 nt, Artificial Sequence
  Description of Artificial Sequence: Synthetic oligonucleotide
auuguuuaauauuaggau

SEQ ID NO: 49877 - RNA, 18 nt, Artificial Sequence
  Description of Artificial Sequence: Synthetic oligonucleotide
auuauauuguuuaauauu

SEQ ID NO: 49878 - RNA, 18 nt, Artificial Sequence
  Description of Artificial Sequence: Synthetic oligonucleotide
cuuucauuauauuguuua

SEQ ID NO: 49879 - RNA, 18 nt, Artificial Sequence
  Description of Artificial Sequence: Synthetic oligonucleotide
gcuuucuuucauuauauu

SEQ ID NO: 49880 - RNA, 18 nt, Artificial Sequence
  Description of Artificial Sequence: Synthetic oligonucleotide
guaaagcuuucuuucauu

SEQ ID NO: 49881 - RNA, 18 nt, Artificial Sequence
  Description of Artificial Sequence: Synthetic oligonucleotide
uuguuguaaagcuuucuu

SEQ ID NO: 49882 - RNA, 18 nt, Artificial Sequence
  Description of Artificial Sequence: Synthetic oligonucleotide
uagacuuguuguaaagcu

SEQ ID NO: 49883 - RNA, 18 nt, Artificial Sequence
  Description of Artificial Sequence: Synthetic oligonucleotide
cuauuuagacuuguugua

SEQ ID NO: 49884 - RNA, 18 nt, Artificial Sequence
  Description of Artificial Sequence: Synthetic oligonucleotide
aaaaacuauuuagacuug

SEQ ID NO: 49885 - RNA, 18 nt, Artificial Sequence
  Description of Artificial Sequence: Synthetic oligonucleotide
aaaauaaaaacuauuuag

SEQ ID NO: 49886 - RNA, 18 nt, Artificial Sequence
  Description of Artificial Sequence: Synthetic oligonucleotide
gcccgaaaauaaaaacua

SEQ ID NO: 49887 - RNA, 18 nt, Artificial Sequence
  Description of Artificial Sequence: Synthetic oligonucleotide
agacugcccgaaaauaaa

SEQ ID NO: 49888 - RNA, 18 nt, Artificial Sequence
  Description of Artificial Sequence: Synthetic oligonucleotide
uuaaaagacugcccgaaa

SEQ ID NO: 49889 - RNA, 18 nt, Artificial Sequence
  Description of Artificial Sequence: Synthetic oligonucleotide
cuuuguuaaaagacugcc

SEQ ID NO: 49890 - RNA, 18 nt, Artificial Sequence
  Description of Artificial Sequence: Synthetic oligonucleotide
cuuugcuuuguuaaaaga

SEQ ID NO: 49891 - RNA, 18 nt, Artificial Sequence
  Description of Artificial Sequence: Synthetic oligonucleotide
gguugcuuugcuuuguua

SEQ ID NO: 49892 - RNA, 18 nt, Artificial Sequence
  Description of Artificial Sequence: Synthetic oligonucleotide
cacacgguugcuuugcuu

SEQ ID NO: 49893 - RNA, 18 nt, Artificial Sequence
  Description of Artificial Sequence: Synthetic oligonucleotide
uaacucacacgguugcuu

SEQ ID NO: 49894 - RNA, 18 nt, Artificial Sequence
  Description of Artificial Sequence: Synthetic oligonucleotide
ugaccuaacucacacggu

SEQ ID NO: 49895 - RNA, 18 nt, Artificial Sequence
  Description of Artificial Sequence: Synthetic oligonucleotide
ucuggugaccuaacucac

SEQ ID NO: 49896 - RNA, 18 nt, Artificial Sequence
  Description of Artificial Sequence: Synthetic oligonucleotide
gugucucuggugaccuaa

SEQ ID NO: 49897 - RNA, 18 nt, Artificial Sequence
  Description of Artificial Sequence: Synthetic oligonucleotide
gcuuggugucucugguga

SEQ ID NO: 49898 - RNA, 18 nt, Artificial Sequence
  Description of Artificial Sequence: Synthetic oligonucleotide
ccauugcuuggugucucu

SEQ ID NO: 49899 - RNA, 18 nt, Artificial Sequence
  Description of Artificial Sequence: Synthetic oligonucleotide
cuucaccauugcuuggug

SEQ ID NO: 49900 - RNA, 18 nt, Artificial Sequence
  Description of Artificial Sequence: Synthetic oligonucleotide
ggguccuucaccauugcu

SEQ ID NO: 49901 - RNA, 18 nt, Artificial Sequence
  Description of Artificial Sequence: Synthetic oligonucleotide
agagaauugggcggaggg

SEQ ID NO: 49902 - RNA, 18 nt, Artificial Sequence
  Description of Artificial Sequence: Synthetic oligonucleotide
ggauagagaauugggcgg

SEQ ID NO: 49903 - RNA, 18 nt, Artificial Sequence
  Description of Artificial Sequence: Synthetic oligonucleotide
uaguuggauagagaauug

SEQ ID NO: 49904 - RNA, 18 nt, Artificial Sequence
  Description of Artificial Sequence: Synthetic oligonucleotide
aaauuuaguuggauagag

SEQ ID NO: 49905 - RNA, 18 nt, Artificial Sequence
  Description of Artificial Sequence: Synthetic oligonucleotide
cauggaaauuuaguugga

SEQ ID NO: 49906 - RNA, 18 nt, Artificial Sequence
  Description of Artificial Sequence: Synthetic oligonucleotide
uugggcauggaaauuuag

SEQ ID NO: 49907 - RNA, 18 nt, Artificial Sequence
  Description of Artificial Sequence: Synthetic oligonucleotide
ucacuuugggcauggaaa

SEQ ID NO: 49908 - RNA, 18 nt, Artificial Sequence
  Description of Artificial Sequence: Synthetic oligonucleotide
agcuaucacuuugggcau

SEQ ID NO: 49909 - RNA, 18 nt, Artificial Sequence
  Description of Artificial Sequence: Synthetic oligonucleotide
augauagcuaucacuuug

SEQ ID NO: 49910 - RNA, 18 nt, Artificial Sequence
  Description of Artificial Sequence: Synthetic oligonucleotide
aaaaaaugauagcuauca

SEQ ID NO: 49911 - RNA, 18 nt, Artificial Sequence
  Description of Artificial Sequence: Synthetic oligonucleotide
cguggaaaaaaugauagc

SEQ ID NO: 49912 - RNA, 18 nt, Artificial Sequence
  Description of Artificial Sequence: Synthetic oligonucleotide
uacaccguggaaaaaaug

SEQ ID NO: 49913 - RNA, 18 nt, Artificial Sequence
  Description of Artificial Sequence: Synthetic oligonucleotide
gcagauacaccguggaaa

SEQ ID NO: 49914 - RNA, 18 nt, Artificial Sequence
  Description of Artificial Sequence: Synthetic oligonucleotide
gauuugcagauacaccgu

SEQ ID NO: 49915 - RNA, 18 nt, Artificial Sequence
  Description of Artificial Sequence: Synthetic oligonucleotide
ggguggauuugcagauac

SEQ ID NO: 49916 - RNA, 18 nt, Artificial Sequence
  Description of Artificial Sequence: Synthetic oligonucleotide
acaguggguggauuugca

SEQ ID NO: 49917 - RNA, 18 nt, Artificial Sequence
  Description of Artificial Sequence: Synthetic oligonucleotide
ccgggacaguggguggau

SEQ ID NO: 49918 - RNA, 18 nt, Artificial Sequence
  Description of Artificial Sequence: Synthetic oligonucleotide
ccaccccgggacaguggg

SEQ ID NO: 49919 - RNA, 18 nt, Artificial Sequence
  Description of Artificial Sequence: Synthetic oligonucleotide
cccagccaccccgggaca

SEQ ID NO: 49920 - RNA, 18 nt, Artificial Sequence
  Description of Artificial Sequence: Synthetic oligonucleotide
aagcucccagccaccccg

SEQ ID NO: 49921 - RNA, 18 nt, Artificial Sequence
  Description of Artificial Sequence: Synthetic oligonucleotide
uuaaaaagcucccagcca

SEQ ID NO: 49922 - RNA, 18 nt, Artificial Sequence
  Description of Artificial Sequence: Synthetic oligonucleotide
acccguuaaaaagcuccc

SEQ ID NO: 49923 - RNA, 18 nt, Artificial Sequence
  Description of Artificial Sequence: Synthetic oligonucleotide
ucucaacccguuaaaaag

SEQ ID NO: 49924 - RNA, 18 nt, Artificial Sequence
  Description of Artificial Sequence: Synthetic oligonucleotide
gcaacucucaacccguua

SEQ ID NO: 49925 - RNA, 18 nt, Artificial Sequence
  Description of Artificial Sequence: Synthetic oligonucleotide
aaaaagcaacucucaacc

SEQ ID NO: 49926 - RNA, 18 nt, Artificial Sequence
  Description of Artificial Sequence: Synthetic oligonucleotide
accuuaaaaagcaacucu

SEQ ID NO: 49927 - RNA, 18 nt, Artificial Sequence
  Description of Artificial Sequence: Synthetic oligonucleotide
ccacaaccuuaaaaagca

SEQ ID NO: 49928 - RNA, 18 nt, Artificial Sequence
  Description of Artificial Sequence: Synthetic oligonucleotide
cucacccacaaccuuaaa

SEQ ID NO: 49929 - RNA, 18 nt, Artificial Sequence
  Description of Artificial Sequence: Synthetic oligonucleotide
cucagcucacccacaacc

SEQ ID NO: 49930 - RNA, 18 nt, Artificial Sequence
  Description of Artificial Sequence: Synthetic oligonucleotide
cccaucucagcucaccca

SEQ ID NO: 49931 - RNA, 18 nt, Artificial Sequence
  Description of Artificial Sequence: Synthetic oligonucleotide
agucacccaucucagcuc

SEQ ID NO: 49932 - RNA, 18 nt, Artificial Sequence
  Description of Artificial Sequence: Synthetic oligonucleotide
gacacagucacccaucuc

SEQ ID NO: 49933 - RNA, 18 nt, Artificial Sequence
  Description of Artificial Sequence: Synthetic oligonucleotide
cugaagacacagucaccc

SEQ ID NO: 49934 - RNA, 18 nt, Artificial Sequence
  Description of Artificial Sequence: Synthetic oligonucleotide
gucuccugaagacacagu

SEQ ID NO: 49935 - RNA, 18 nt, Artificial Sequence
  Description of Artificial Sequence: Synthetic oligonucleotide
guagugucuccugaagac

SEQ ID NO: 49936 - RNA, 18 nt, Artificial Sequence
  Description of Artificial Sequence: Synthetic oligonucleotide
aaaugguagugucuccug

SEQ ID NO: 49937 - RNA, 18 nt, Artificial Sequence
  Description of Artificial Sequence: Synthetic oligonucleotide
aaaccaaaugguaguguc

SEQ ID NO: 49938 - RNA, 18 nt, Artificial Sequence
  Description of Artificial Sequence: Synthetic oligonucleotide
aaaucaaaccaaauggua

SEQ ID NO: 49939 - RNA, 18 nt, Artificial Sequence
  Description of Artificial Sequence: Synthetic oligonucleotide
cucuguuuauugaugaca

SEQ ID NO: 49940 - RNA, 18 nt, Artificial Sequence
  Description of Artificial Sequence: Synthetic oligonucleotide
aagaacucuguuuauuga

SEQ ID NO: 49941 - RNA, 18 nt, Artificial Sequence
  Description of Artificial Sequence: Synthetic oligonucleotide
uugcgaagaacucuguuu

SEQ ID NO: 49942 - RNA, 18 nt, Artificial Sequence
  Description of Artificial Sequence: Synthetic oligonucleotide
ccagguugcgaagaacuc

SEQ ID NO: 49943 - RNA, 18 nt, Artificial Sequence
  Description of Artificial Sequence: Synthetic oligonucleotide
gcuagccagguugcgaag

SEQ ID NO: 49944 - RNA, 18 nt, Artificial Sequence
  Description of Artificial Sequence: Synthetic oligonucleotide
uuuucgcuagccagguug

SEQ ID NO: 49945 - RNA, 18 nt, Artificial Sequence
  Description of Artificial Sequence: Synthetic oligonucleotide
guugcuuuucgcuagcca

SEQ ID NO: 49946 - RNA, 18 nt, Artificial Sequence
  Description of Artificial Sequence: Synthetic oligonucleotide
caucuguugcuuuucgcu

SEQ ID NO: 49947 - RNA, 18 nt, Artificial Sequence
  Description of Artificial Sequence: Synthetic oligonucleotide
gcgcccaucuguugcuuu

SEQ ID NO: 49948 - RNA, 18 nt, Artificial Sequence
  Description of Artificial Sequence: Synthetic oligonucleotide
cgucugcgcccaucuguu

SEQ ID NO: 49949 - RNA, 18 nt, Artificial Sequence
  Description of Artificial Sequence: Synthetic oligonucleotide
caugccgucugcgcccau

SEQ ID NO: 49950 - RNA, 18 nt, Artificial Sequence
  Description of Artificial Sequence: Synthetic oligonucleotide
ucauacaugccgucugcg

SEQ ID NO: 49951 - RNA, 18 nt, Artificial Sequence
  Description of Artificial Sequence: Synthetic oligonucleotide
guuuaucauacaugccgu

SEQ ID NO: 49952 - RNA, 18 nt, Artificial Sequence
  Description of Artificial Sequence: Synthetic oligonucleotide
ccuuaguuuaucauacau

SEQ ID NO: 49953 - RNA, 18 nt, Artificial Sequence
  Description of Artificial Sequence: Synthetic oligonucleotide
aacauccuuaguuuauca

SEQ ID NO: 49954 - RNA, 18 nt, Artificial Sequence
  Description of Artificial Sequence: Synthetic oligonucleotide
cguucaacauccuuaguu

SEQ ID NO: 49955 - RNA, 18 nt, Artificial Sequence
  Description of Artificial Sequence: Synthetic oligonucleotide
cugcccguucaacauccu

SEQ ID NO: 49956 - RNA, 18 nt, Artificial Sequence
  Description of Artificial Sequence: Synthetic oligonucleotide
ccggucugcccguucaac

SEQ ID NO: 49957 - RNA, 18 nt, Artificial Sequence
  Description of Artificial Sequence: Synthetic oligonucleotide
agcuuccggucugcccgu

SEQ ID NO: 49958 - RNA, 18 nt, Artificial Sequence
  Description of Artificial Sequence: Synthetic oligonucleotide
gccccagcuuccggucug

SEQ ID NO: 49959 - RNA, 18 nt, Artificial Sequence
  Description of Artificial Sequence: Synthetic oligonucleotide
cgggugccccagcuuccg

SEQ ID NO: 49960 - RNA, 18 nt, Artificial Sequence
  Description of Artificial Sequence: Synthetic oligonucleotide
cagggcgggugccccagc

SEQ ID NO: 49961 - RNA, 18 nt, Artificial Sequence
  Description of Artificial Sequence: Synthetic oligonucleotide
ccaaccagggcgggugcc

SEQ ID NO: 49962 - RNA, 18 nt, Artificial Sequence
  Description of Artificial Sequence: Synthetic oligonucleotide
ggauaccaaccagggcgg

SEQ ID NO: 49963 - RNA, 18 nt, Artificial Sequence
  Description of Artificial Sequence: Synthetic oligonucleotide
uccccggauaccaaccag

SEQ ID NO: 49964 - RNA, 18 nt, Artificial Sequence
  Description of Artificial Sequence: Synthetic oligonucleotide
cgaaguccccggauacca

SEQ ID NO: 49965 - RNA, 18 nt, Artificial Sequence
  Description of Artificial Sequence: Synthetic oligonucleotide
ggcaccgaaguccccgga

SEQ ID NO: 49966 - RNA, 18 nt, Artificial Sequence
  Description of Artificial Sequence: Synthetic oligonucleotide
gcccuggcaccgaagucc

SEQ ID NO: 49967 - RNA, 18 nt, Artificial Sequence
  Description of Artificial Sequence: Synthetic oligonucleotide
agguugcccuggcaccga

SEQ ID NO: 49968 - RNA, 18 nt, Artificial Sequence
  Description of Artificial Sequence: Synthetic oligonucleotide
ugcguagguugcccuggc

SEQ ID NO: 49969 - RNA, 18 nt, Artificial Sequence
  Description of Artificial Sequence: Synthetic oligonucleotide
gcguccggcgccuguuug

SEQ ID NO: 49970 - RNA, 18 nt, Artificial Sequence
  Description of Artificial Sequence: Synthetic oligonucleotide
gcuccgcguccggcgccu

SEQ ID NO: 49971 - RNA, 18 nt, Artificial Sequence
  Description of Artificial Sequence: Synthetic oligonucleotide
uggcggcuccgcguccgg

SEQ ID NO: 49972 - RNA, 18 nt, Artificial Sequence
  Description of Artificial Sequence: Synthetic oligonucleotide
cuuccuggcggcuccgcg

SEQ ID NO: 49973 - RNA, 18 nt, Artificial Sequence
  Description of Artificial Sequence: Synthetic oligonucleotide
ccgcgcuuccuggcggcu

SEQ ID NO: 49974 - RNA, 18 nt, Artificial Sequence
  Description of Artificial Sequence: Synthetic oligonucleotide
cccucccgcgcuuccugg

SEQ ID NO: 49975 - RNA, 18 nt, Artificial Sequence
  Description of Artificial Sequence: Synthetic oligonucleotide
gcccccccucccgcgcuu

SEQ ID NO: 49976 - RNA, 18 nt, Artificial Sequence
  Description of Artificial Sequence: Synthetic oligonucleotide
ggcccgcccccccucccg

SEQ ID NO: 49977 - RNA, 18 nt, Artificial Sequence
  Description of Artificial Sequence: Synthetic oligonucleotide
ccucgggcccgccccccc

SEQ ID NO: 49978 - RNA, 18 nt, Artificial Sequence
  Description of Artificial Sequence: Synthetic oligonucleotide
cccccccucgggcccgcc

SEQ ID NO: 49979 - RNA, 18 nt, Artificial Sequence
  Description of Artificial Sequence: Synthetic oligonucleotide
cccggcccccccucgggc

SEQ ID NO: 49980 - RNA, 18 nt, Artificial Sequence
  Description of Artificial Sequence: Synthetic oligonucleotide
agcggcccggcccccccu

SEQ ID NO: 49981 - RNA, 18 nt, Artificial Sequence
  Description of Artificial Sequence: Synthetic oligonucleotide
uaccaagcggcccggccc

SEQ ID NO: 49982 - RNA, 18 nt, Artificial Sequence
  Description of Artificial Sequence: Synthetic oligonucleotide
aggcccggacagggaggg

SEQ ID NO: 49983 - RNA, 18 nt, Artificial Sequence
  Description of Artificial Sequence: Synthetic oligonucleotide
cggcgaggcccggacagg

SEQ ID NO: 49984 - RNA, 18 nt, Artificial Sequence
  Description of Artificial Sequence: Synthetic oligonucleotide
cugagcggcgaggcccgg

SEQ ID NO: 49985 - RNA, 18 nt, Artificial Sequence
  Description of Artificial Sequence: Synthetic oligonucleotide
ccguacugagcggcgagg

SEQ ID NO: 49986 - RNA, 18 nt, Artificial Sequence
  Description of Artificial Sequence: Synthetic oligonucleotide
cgcccccguacugagcgg

SEQ ID NO: 49987 - RNA, 18 nt, Artificial Sequence
  Description of Artificial Sequence: Synthetic oligonucleotide
agccccgcccccguacug

SEQ ID NO: 49988 - RNA, 18 nt, Artificial Sequence
  Description of Artificial Sequence: Synthetic oligonucleotide
cggcuagccccgcccccg

SEQ ID NO: 49989 - RNA, 18 nt, Artificial Sequence
  Description of Artificial Sequence: Synthetic oligonucleotide
ucagccggcuagccccgc

SEQ ID NO: 49990 - RNA, 18 nt, Artificial Sequence
  Description of Artificial Sequence: Synthetic oligonucleotide
gccgggaguaggccaggg

SEQ ID NO: 49991 - RNA, 18 nt, Artificial Sequence
  Description of Artificial Sequence: Synthetic oligonucleotide
cggaggccgggaguaggc

SEQ ID NO: 49992 - RNA, 18 nt, Artificial Sequence
  Description of Artificial Sequence: Synthetic oligonucleotide
ggagccggaggccgggag

SEQ ID NO: 49993 - RNA, 18 nt, Artificial Sequence
  Description of Artificial Sequence: Synthetic oligonucleotide
ggccuggagccggaggcc

SEQ ID NO: 49994 - RNA, 18 nt, Artificial Sequence
  Description of Artificial Sequence: Synthetic oligonucleotide
ggaagggccuggagccgg

SEQ ID NO: 49995 - RNA, 18 nt, Artificial Sequence
  Description of Artificial Sequence: Synthetic oligonucleotide
auccgggaagggccugga

SEQ ID NO: 49996 - RNA, 18 nt, Artificial Sequence
  Description of Artificial Sequence: Synthetic oligonucleotide
guccccugggaauccggg

SEQ ID NO: 49997 - RNA, 18 nt, Artificial Sequence
  Description of Artificial Sequence: Synthetic oligonucleotide
uccccguccccugggaau

SEQ ID NO: 49998 - RNA, 18 nt, Artificial Sequence
  Description of Artificial Sequence: Synthetic oligonucleotide
ucccuuccccguccccug

SEQ ID NO: 49999 - RNA, 18 nt, Artificial Sequence
  Description of Artificial Sequence: Synthetic oligonucleotide
ggcgcucccuuccccguc

SEQ ID NO: 50000 - RNA, 18 nt, Artificial Sequence
  Description of Artificial Sequence: Synthetic oligonucleotide
gggcgggcgcucccuucc

SEQ ID NO: 50001 - RNA, 18 nt, Artificial Sequence
  Description of Artificial Sequence: Synthetic oligonucleotide
uccgcucaacccugaggg

SEQ ID NO: 50002 - RNA, 18 nt, Artificial Sequence
  Description of Artificial Sequence: Synthetic oligonucleotide
gguccgcucaacccugag

SEQ ID NO: 50003 - RNA, 18 nt, Artificial Sequence
  Description of Artificial Sequence: Synthetic oligonucleotide
ggguugguccgcucaacc

SEQ ID NO: 50004 - RNA, 18 nt, Artificial Sequence
  Description of Artificial Sequence: Synthetic oligonucleotide
ccucgcggaagugguggg

SEQ ID NO: 50005 - RNA, 18 nt, Artificial Sequence
  Description of Artificial Sequence: Synthetic oligonucleotide
ccccucgcggaaguggug

SEQ ID NO: 50006 - RNA, 18 nt, Artificial Sequence
  Description of Artificial Sequence: Synthetic oligonucleotide
cccugccccucgcggaag

SEQ ID NO: 50007 - RNA, 18 nt, Artificial Sequence
  Description of Artificial Sequence: Synthetic oligonucleotide
cccgccccugccccucgc

SEQ ID NO: 50008 - RNA, 18 nt, Artificial Sequence
  Description of Artificial Sequence: Synthetic oligonucleotide
gugaccccgccccugccc

SEQ ID NO: 50009 - RNA, 18 nt, Artificial Sequence
  Description of Artificial Sequence: Synthetic oligonucleotide
guuuugugaccccgcccc

SEQ ID NO: 50010 - RNA, 18 nt, Artificial Sequence
  Description of Artificial Sequence: Synthetic oligonucleotide
ggcccguuuugugacccc

SEQ ID NO: 50011 - RNA, 18 nt, Artificial Sequence
  Description of Artificial Sequence: Synthetic oligonucleotide
ccgagggcccguuuugug

SEQ ID NO: 50012 - RNA, 18 nt, Artificial Sequence
  Description of Artificial Sequence: Synthetic oligonucleotide
cuaggccgagggcccguu

SEQ ID NO: 50013 - RNA, 18 nt, Artificial Sequence
  Description of Artificial Sequence: Synthetic oligonucleotide
cgccccuaggccgagggc

SEQ ID NO: 50014 - RNA, 18 nt, Artificial Sequence
  Description of Artificial Sequence: Synthetic oligonucleotide
aacuccgccccuaggccg

SEQ ID NO: 50015 - RNA, 18 nt, Artificial Sequence
  Description of Artificial Sequence: Synthetic oligonucleotide
cgagaaacuccgccccua

SEQ ID NO: 50016 - RNA, 18 nt, Artificial Sequence
  Description of Artificial Sequence: Synthetic oligonucleotide
ccuuacgagaaacuccgc

SEQ ID NO: 50017 - RNA, 18 nt, Artificial Sequence
  Description of Artificial Sequence: Synthetic oligonucleotide
uugccccuuacgagaaac

SEQ ID NO: 50018 - RNA, 18 nt, Artificial Sequence
  Description of Artificial Sequence: Synthetic oligonucleotide
uggccuugccccuuacga

SEQ ID NO: 50019 - RNA, 18 nt, Artificial Sequence
  Description of Artificial Sequence: Synthetic oligonucleotide
ugccuuggccuugccccu

SEQ ID NO: 50020 - RNA, 18 nt, Artificial Sequence
  Description of Artificial Sequence: Synthetic oligonucleotide
caagaugccuuggccuug

SEQ ID NO: 50021 - RNA, 18 nt, Artificial Sequence
  Description of Artificial Sequence: Synthetic oligonucleotide
caauacaagaugccuugg

SEQ ID NO: 50022 - RNA, 18 nt, Artificial Sequence
  Description of Artificial Sequence: Synthetic oligonucleotide
agccccaauacaagaugc

SEQ ID NO: 50023 - RNA, 18 nt, Artificial Sequence
  Description of Artificial Sequence: Synthetic oligonucleotide
cugucagccccaauacaa

SEQ ID NO: 50024 - RNA, 18 nt, Artificial Sequence
  Description of Artificial Sequence: Synthetic oligonucleotide
ccccccugucagccccaa

SEQ ID NO: 50025 - RNA, 18 nt, Artificial Sequence
  Description of Artificial Sequence: Synthetic oligonucleotide
acccgccccccugucagc

SEQ ID NO: 50026 - RNA, 18 nt, Artificial Sequence
  Description of Artificial Sequence: Synthetic oligonucleotide
uaauaacccgccccccug

SEQ ID NO: 50027 - RNA, 18 nt, Artificial Sequence
  Description of Artificial Sequence: Synthetic oligonucleotide
agcccuaauaacccgccc

SEQ ID NO: 50028 - RNA, 18 nt, Artificial Sequence
  Description of Artificial Sequence: Synthetic oligonucleotide
uccucagcccuaauaacc

SEQ ID NO: 50029 - RNA, 18 nt, Artificial Sequence
  Description of Artificial Sequence: Synthetic oligonucleotide
ucccauccucagcccuaa

SEQ ID NO: 50030 - RNA, 18 nt, Artificial Sequence
  Description of Artificial Sequence: Synthetic oligonucleotide
cauccucccauccucagc

SEQ ID NO: 50031 - RNA, 18 nt, Artificial Sequence
  Description of Artificial Sequence: Synthetic oligonucleotide
cugagcauccucccaucc

SEQ ID NO: 50032 - RNA, 18 nt, Artificial Sequence
  Description of Artificial Sequence: Synthetic oligonucleotide
auacccugagcauccucc

SEQ ID NO: 50033 - RNA, 18 nt, Artificial Sequence
  Description of Artificial Sequence: Synthetic oligonucleotide
ccccaauacccugagcau

SEQ ID NO: 50034 - RNA, 18 nt, Artificial Sequence
  Description of Artificial Sequence: Synthetic oligonucleotide
ccugaccccaauacccug

SEQ ID NO: 50035 - RNA, 18 nt, Artificial Sequence
  Description of Artificial Sequence: Synthetic oligonucleotide
gccacccugaccccaaua

SEQ ID NO: 50036 - RNA, 18 nt, Artificial Sequence
  Description of Artificial Sequence: Synthetic oligonucleotide
cuaaugccacccugaccc

SEQ ID NO: 50037 - RNA, 18 nt, Artificial Sequence
  Description of Artificial Sequence: Synthetic oligonucleotide
cugggcuaaugccacccu

SEQ ID NO: 50038 - RNA, 18 nt, Artificial Sequence
  Description of Artificial Sequence: Synthetic oligonucleotide
uugagcugggcuaaugcc

SEQ ID NO: 50039 - RNA, 18 nt, Artificial Sequence
  Description of Artificial Sequence: Synthetic oligonucleotide
ccggcuugagcugggcua

SEQ ID NO: 50040 - RNA, 18 nt, Artificial Sequence
  Description of Artificial Sequence: Synthetic oligonucleotide
ccggcccggcuugagcug

SEQ ID NO: 50041 - RNA, 18 nt, Artificial Sequence
  Description of Artificial Sequence: Synthetic oligonucleotide
ucagcccggcccggcuug

SEQ ID NO: 50042 - RNA, 18 nt, Artificial Sequence
  Description of Artificial Sequence: Synthetic oligonucleotide
cugagucagcccggcccg

SEQ ID NO: 50043 - RNA, 18 nt, Artificial Sequence
  Description of Artificial Sequence: Synthetic oligonucleotide
ggaugcugagucagcccg

SEQ ID NO: 50044 - RNA, 18 nt, Artificial Sequence
  Description of Artificial Sequence: Synthetic oligonucleotide
gggcaggaugcugaguca

SEQ ID NO: 50045 - RNA, 18 nt, Artificial Sequence
  Description of Artificial Sequence: Synthetic oligonucleotide
ggauggaagcuggcuggg

SEQ ID NO: 50046 - RNA, 18 nt, Artificial Sequence
  Description of Artificial Sequence: Synthetic oligonucleotide
ucagggauggaagcuggc

SEQ ID NO: 50047 - RNA, 18 nt, Artificial Sequence
  Description of Artificial Sequence: Synthetic oligonucleotide
aggugucagggauggaag

SEQ ID NO: 50048 - RNA, 18 nt, Artificial Sequence
  Description of Artificial Sequence: Synthetic oligonucleotide
ugcagaggugucagggau

SEQ ID NO: 50049 - RNA, 18 nt, Artificial Sequence
  Description of Artificial Sequence: Synthetic oligonucleotide
gggaaugcagagguguca

SEQ ID NO: 50050 - RNA, 18 nt, Artificial Sequence
  Description of Artificial Sequence: Synthetic oligonucleotide
cccaagggaaugcagagg

SEQ ID NO: 50051 - RNA, 18 nt, Artificial Sequence
  Description of Artificial Sequence: Synthetic oligonucleotide
cucugcccaagggaaugc

SEQ ID NO: 50052 - RNA, 18 nt, Artificial Sequence
  Description of Artificial Sequence: Synthetic oligonucleotide
cccaucucugcccaaggg

SEQ ID NO: 50053 - RNA, 18 nt, Artificial Sequence
  Description of Artificial Sequence: Synthetic oligonucleotide
caucucccaucucugccc

SEQ ID NO: 50054 - RNA, 18 nt, Artificial Sequence
  Description of Artificial Sequence: Synthetic oligonucleotide
ggcgccaucucccaucuc

SEQ ID NO: 50055 - RNA, 18 nt, Artificial Sequence
  Description of Artificial Sequence: Synthetic oligonucleotide
acaccggcgccaucuccc

SEQ ID NO: 50056 - RNA, 18 nt, Artificial Sequence
  Description of Artificial Sequence: Synthetic oligonucleotide
gggcaacaccggcgccau

SEQ ID NO: 50057 - RNA, 18 nt, Artificial Sequence
  Description of Artificial Sequence: Synthetic oligonucleotide
gugccaggcggaugcggg

SEQ ID NO: 50058 - RNA, 18 nt, Artificial Sequence
  Description of Artificial Sequence: Synthetic oligonucleotide
ccuugugccaggcggaug

SEQ ID NO: 50059 - RNA, 18 nt, Artificial Sequence
  Description of Artificial Sequence: Synthetic oligonucleotide
agagcccuugugccaggc

SEQ ID NO: 50060 - RNA, 18 nt, Artificial Sequence
  Description of Artificial Sequence: Synthetic oligonucleotide
gagccagagcccuugugc

SEQ ID NO: 50061 - RNA, 18 nt, Artificial Sequence
  Description of Artificial Sequence: Synthetic oligonucleotide
gagaggagccagagcccu

SEQ ID NO: 50062 - RNA, 18 nt, Artificial Sequence
  Description of Artificial Sequence: Synthetic oligonucleotide
gccaggagaggagccaga

SEQ ID NO: 50063 - RNA, 18 nt, Artificial Sequence
  Description of Artificial Sequence: Synthetic oligonucleotide
cagcagccaggagaggag

SEQ ID NO: 50064 - RNA, 18 nt, Artificial Sequence
  Description of Artificial Sequence: Synthetic oligonucleotide
agcgccagcagccaggag

SEQ ID NO: 50065 - RNA, 18 nt, Artificial Sequence
  Description of Artificial Sequence: Synthetic oligonucleotide
cagccagcgccagcagcc

SEQ ID NO: 50066 - RNA, 18 nt, Artificial Sequence
  Description of Artificial Sequence: Synthetic oligonucleotide
gccaccagccagcgccag

SEQ ID NO: 50067 - RNA, 18 nt, Artificial Sequence
  Description of Artificial Sequence: Synthetic oligonucleotide
augacgccaccagccagc

SEQ ID NO: 50068 - RNA, 18 nt, Artificial Sequence
  Description of Artificial Sequence: Synthetic oligonucleotide
ggaggaugacgccaccag

SEQ ID NO: 50069 - RNA, 18 nt, Artificial Sequence
  Description of Artificial Sequence: Synthetic oligonucleotide
acagaggaggaugacgcc

SEQ ID NO: 50070 - RNA, 18 nt, Artificial Sequence
  Description of Artificial Sequence: Synthetic oligonucleotide
ccacuacagaggaggaug

SEQ ID NO: 50071 - RNA, 18 nt, Artificial Sequence
  Description of Artificial Sequence: Synthetic oligonucleotide
ggugcccacuacagagga

SEQ ID NO: 50072 - RNA, 18 nt, Artificial Sequence
  Description of Artificial Sequence: Synthetic oligonucleotide
caggaggugcccacuaca

SEQ ID NO: 50073 - RNA, 18 nt, Artificial Sequence
  Description of Artificial Sequence: Synthetic oligonucleotide
uggaccaggaggugccca

SEQ ID NO: 50074 - RNA, 18 nt, Artificial Sequence
  Description of Artificial Sequence: Synthetic oligonucleotide
uuagcuggaccaggaggu

SEQ ID NO: 50075 - RNA, 18 nt, Artificial Sequence
  Description of Artificial Sequence: Synthetic oligonucleotide
gugccuuagcuggaccag

SEQ ID NO: 50076 - RNA, 18 nt, Artificial Sequence
  Description of Artificial Sequence: Synthetic oligonucleotide
ccaaggugccuuagcugg

SEQ ID NO: 50077 - RNA, 18 nt, Artificial Sequence
  Description of Artificial Sequence: Synthetic oligonucleotide
aggugccaaggugccuua

SEQ ID NO: 50078 - RNA, 18 nt, Artificial Sequence
  Description of Artificial Sequence: Synthetic oligonucleotide
caggaaggugccaaggug

SEQ ID NO: 50079 - RNA, 18 nt, Artificial Sequence
  Description of Artificial Sequence: Synthetic oligonucleotide
ggagccaggaaggugcca

SEQ ID NO: 50080 - RNA, 18 nt, Artificial Sequence
  Description of Artificial Sequence: Synthetic oligonucleotide
aggagggagccaggaagg

SEQ ID NO: 50081 - RNA, 18 nt, Artificial Sequence
  Description of Artificial Sequence: Synthetic oligonucleotide
cugacaggagggagccag

SEQ ID NO: 50082 - RNA, 18 nt, Artificial Sequence
  Description of Artificial Sequence: Synthetic oligonucleotide
gggaacugacaggaggga

SEQ ID NO: 50083 - RNA, 18 nt, Artificial Sequence
  Description of Artificial Sequence: Synthetic oligonucleotide
ggacagggaacugacagg

SEQ ID NO: 50084 - RNA, 18 nt, Artificial Sequence
  Description of Artificial Sequence: Synthetic oligonucleotide
gggcaggacagggaacug

SEQ ID NO: 50085 - RNA, 18 nt, Artificial Sequence
  Description of Artificial Sequence: Synthetic oligonucleotide
cugccagggcagccuggg

SEQ ID NO: 50086 - RNA, 18 nt, Artificial Sequence
  Description of Artificial Sequence: Synthetic oligonucleotide
cgcugccagggcagccug

SEQ ID NO: 50087 - RNA, 18 nt, Artificial Sequence
  Description of Artificial Sequence: Synthetic oligonucleotide
gcgcccgcugccagggca

SEQ ID NO: 50088 - RNA, 18 nt, Artificial Sequence
  Description of Artificial Sequence: Synthetic oligonucleotide
ccaccgcgcccgcugcca

SEQ ID NO: 50089 - RNA, 18 nt, Artificial Sequence
  Description of Artificial Sequence: Synthetic oligonucleotide
cagagccaccgcgcccgc

SEQ ID NO: 50090 - RNA, 18 nt, Artificial Sequence
  Description of Artificial Sequence: Synthetic oligonucleotide
gugcccagagccaccgcg

SEQ ID NO: 50091 - RNA, 18 nt, Artificial Sequence
  Description of Artificial Sequence: Synthetic oligonucleotide
guccugugcccagagcca

SEQ ID NO: 50092 - RNA, 18 nt, Artificial Sequence
  Description of Artificial Sequence: Synthetic oligonucleotide
cacuaguccugugcccag

SEQ ID NO: 50093 - RNA, 18 nt, Artificial Sequence
  Description of Artificial Sequence: Synthetic oligonucleotide
acacccacuaguccugug

SEQ ID NO: 50094 - RNA, 18 nt, Artificial Sequence
  Description of Artificial Sequence: Synthetic oligonucleotide
cuccuacacccacuaguc

SEQ ID NO: 50095 - RNA, 18 nt, Artificial Sequence
  Description of Artificial Sequence: Synthetic oligonucleotide
gcuggcuccuacacccac

SEQ ID NO: 50096 - RNA, 18 nt, Artificial Sequence
  Description of Artificial Sequence: Synthetic oligonucleotide
gcccggcuggcuccuaca

SEQ ID NO: 50097 - RNA, 18 nt, Artificial Sequence
  Description of Artificial Sequence: Synthetic oligonucleotide
gacuugcccggcuggcuc

SEQ ID NO: 50098 - RNA, 18 nt, Artificial Sequence
  Description of Artificial Sequence: Synthetic oligonucleotide
auucagacuugcccggcu

SEQ ID NO: 50099 - RNA, 18 nt, Artificial Sequence
  Description of Artificial Sequence: Synthetic oligonucleotide
gcugcauucagacuugcc

SEQ ID NO: 50100 - RNA, 18 nt, Artificial Sequence
  Description of Artificial Sequence: Synthetic oligonucleotide
auagagcugcauucagac

SEQ ID NO: 50101 - RNA, 18 nt, Artificial Sequence
  Description of Artificial Sequence: Synthetic oligonucleotide
aggguauagagcugcauu

SEQ ID NO: 50102 - RNA, 18 nt, Artificial Sequence
  Description of Artificial Sequence: Synthetic oligonucleotide
cagggaggguauagagcu

SEQ ID NO: 50103 - RNA, 18 nt, Artificial Sequence
  Description of Artificial Sequence: Synthetic oligonucleotide
cucgccagggaggguaua

SEQ ID NO: 50104 - RNA, 18 nt, Artificial Sequence
  Description of Artificial Sequence: Synthetic oligonucleotide
gaccccucgccagggagg

SEQ ID NO: 50105 - RNA, 18 nt, Artificial Sequence
  Description of Artificial Sequence: Synthetic oligonucleotide
cccaggaccccucgccag

SEQ ID NO: 50106 - RNA, 18 nt, Artificial Sequence
  Description of Artificial Sequence: Synthetic oligonucleotide
gcgggcccaggaccccuc

SEQ ID NO: 50107 - RNA, 18 nt, Artificial Sequence
  Description of Artificial Sequence: Synthetic oligonucleotide
cagcagcgggcccaggac

SEQ ID NO: 50108 - RNA, 18 nt, Artificial Sequence
  Description of Artificial Sequence: Synthetic oligonucleotide
gccaccagcagcgggccc

SEQ ID NO: 50109 - RNA, 18 nt, Artificial Sequence
  Description of Artificial Sequence: Synthetic oligonucleotide
ugccagccaccagcagcg

SEQ ID NO: 50110 - RNA, 18 nt, Artificial Sequence
  Description of Artificial Sequence: Synthetic oligonucleotide
agccgugccagccaccag

SEQ ID NO: 50111 - RNA, 18 nt, Artificial Sequence
  Description of Artificial Sequence: Synthetic oligonucleotide
ccaccagccgugccagcc

SEQ ID NO: 50112 - RNA, 18 nt, Artificial Sequence
  Description of Artificial Sequence: Synthetic oligonucleotide
cccccccaccagccgugc

SEQ ID NO: 50113 - RNA, 18 nt, Artificial Sequence
  Description of Artificial Sequence: Synthetic oligonucleotide
gagcccccccccaccagc

SEQ ID NO: 50114 - RNA, 18 nt, Artificial Sequence
  Description of Artificial Sequence: Synthetic oligonucleotide
accaggagccccccccca

SEQ ID NO: 50115 - RNA, 18 nt, Artificial Sequence
  Description of Artificial Sequence: Synthetic oligonucleotide
cgacgaccaggagccccc

SEQ ID NO: 50116 - RNA, 18 nt, Artificial Sequence
  Description of Artificial Sequence: Synthetic oligonucleotide
gaggccgacgaccaggag

SEQ ID NO: 50117 - RNA, 18 nt, Artificial Sequence
  Description of Artificial Sequence: Synthetic oligonucleotide
agcccgaggccgacgacc

SEQ ID NO: 50118 - RNA, 18 nt, Artificial Sequence
  Description of Artificial Sequence: Synthetic oligonucleotide
gggcuagcccgaggccga

SEQ ID NO: 50119 - RNA, 18 nt, Artificial Sequence
  Description of Artificial Sequence: Synthetic oligonucleotide
agccagggcuagcccgag

SEQ ID NO: 50120 - RNA, 18 nt, Artificial Sequence
  Description of Artificial Sequence: Synthetic oligonucleotide
ggcaaagccagggcuagc

SEQ ID NO: 50121 - RNA, 18 nt, Artificial Sequence
  Description of Artificial Sequence: Synthetic oligonucleotide
ucccaggcaaagccaggg

SEQ ID NO: 50122 - RNA, 18 nt, Artificial Sequence
  Description of Artificial Sequence: Synthetic oligonucleotide
cagacucccaggcaaagc

SEQ ID NO: 50123 - RNA, 18 nt, Artificial Sequence
  Description of Artificial Sequence: Synthetic oligonucleotide
ucauccagacucccaggc

SEQ ID NO: 50124 - RNA, 18 nt, Artificial Sequence
  Description of Artificial Sequence: Synthetic oligonucleotide
gcgccucauccagacucc

SEQ ID NO: 50125 - RNA, 18 nt, Artificial Sequence
  Description of Artificial Sequence: Synthetic oligonucleotide
cuccagcgccucauccag

SEQ ID NO: 50126 - RNA, 18 nt, Artificial Sequence
  Description of Artificial Sequence: Synthetic oligonucleotide
cccuccuccagcgccuca

SEQ ID NO: 50127 - RNA, 18 nt, Artificial Sequence
  Description of Artificial Sequence: Synthetic oligonucleotide
ccaggcccuccuccagcg

SEQ ID NO: 50128 - RNA, 18 nt, Artificial Sequence
  Description of Artificial Sequence: Synthetic oligonucleotide
agucaccaggcccuccuc

SEQ ID NO: 50129 - RNA, 18 nt, Artificial Sequence
  Description of Artificial Sequence: Synthetic oligonucleotide
aaggcagucaccaggccc

SEQ ID NO: 50130 - RNA, 18 nt, Artificial Sequence
  Description of Artificial Sequence: Synthetic oligonucleotide
gagccaaggcagucacca

SEQ ID NO: 50131 - RNA, 18 nt, Artificial Sequence
  Description of Artificial Sequence: Synthetic oligonucleotide
guagugagccaaggcagu

SEQ ID NO: 50132 - RNA, 18 nt, Artificial Sequence
  Description of Artificial Sequence: Synthetic oligonucleotide
uccuuguagugagccaag

SEQ ID NO: 50133 - RNA, 18 nt, Artificial Sequence
  Description of Artificial Sequence: Synthetic oligonucleotide
cuguguccuuguagugag

SEQ ID NO: 50134 - RNA, 18 nt, Artificial Sequence
  Description of Artificial Sequence: Synthetic oligonucleotide
caccucuguguccuugua

SEQ ID NO: 50135 - RNA, 18 nt, Artificial Sequence
  Description of Artificial Sequence: Synthetic oligonucleotide
ccaggcaccucugugucc

SEQ ID NO: 50136 - RNA, 18 nt, Artificial Sequence
  Description of Artificial Sequence: Synthetic oligonucleotide
agugcccaggcaccucug

SEQ ID NO: 50137 - RNA, 18 nt, Artificial Sequence
  Description of Artificial Sequence: Synthetic oligonucleotide
cugacagugcccaggcac

SEQ ID NO: 50138 - RNA, 18 nt, Artificial Sequence
  Description of Artificial Sequence: Synthetic oligonucleotide
uuggccugacagugccca

SEQ ID NO: 50139 - RNA, 18 nt, Artificial Sequence
  Description of Artificial Sequence: Synthetic oligonucleotide
gccuuuuggccugacagu

SEQ ID NO: 50140 - RNA, 18 nt, Artificial Sequence
  Description of Artificial Sequence: Synthetic oligonucleotide
caccagccuuuuggccug

SEQ ID NO: 50141 - RNA, 18 nt, Artificial Sequence
  Description of Artificial Sequence: Synthetic oligonucleotide
ucauccaccagccuuuug

SEQ ID NO: 50142 - RNA, 18 nt, Artificial Sequence
  Description of Artificial Sequence: Synthetic oligonucleotide
gcagcucauccaccagcc

SEQ ID NO: 50143 - RNA, 18 nt, Artificial Sequence
  Description of Artificial Sequence: Synthetic oligonucleotide
caguugcagcucauccac

SEQ ID NO: 50144 - RNA, 18 nt, Artificial Sequence
  Description of Artificial Sequence: Synthetic oligonucleotide
uaccucaguugcagcuca

SEQ ID NO: 50145 - RNA, 18 nt, Artificial Sequence
  Description of Artificial Sequence: Synthetic oligonucleotide
agugguaccucaguugca

SEQ ID NO: 50146 - RNA, 18 nt, Artificial Sequence
  Description of Artificial Sequence: Synthetic oligonucleotide
gcagcagugguaccucag

SEQ ID NO: 50147 - RNA, 18 nt, Artificial Sequence
  Description of Artificial Sequence: Synthetic oligonucleotide
cgcccgcagcagugguac

SEQ ID NO: 50148 - RNA, 18 nt, Artificial Sequence
  Description of Artificial Sequence: Synthetic oligonucleotide
cguggcgcccgcagcagu

SEQ ID NO: 50149 - RNA, 18 nt, Artificial Sequence
  Description of Artificial Sequence: Synthetic oligonucleotide
guacccguggcgcccgca

SEQ ID NO: 50150 - RNA, 18 nt, Artificial Sequence
  Description of Artificial Sequence: Synthetic oligonucleotide
uccuuguacccguggcgc

SEQ ID NO: 50151 - RNA, 18 nt, Artificial Sequence
  Description of Artificial Sequence: Synthetic oligonucleotide
accaauccuuguacccgu

SEQ ID NO: 50152 - RNA, 18 nt, Artificial Sequence
  Description of Artificial Sequence: Synthetic oligonucleotide
cccaaaccaauccuugua

SEQ ID NO: 50153 - RNA, 18 nt, Artificial Sequence
  Description of Artificial Sequence: Synthetic oligonucleotide
uggaccccaaaccaaucc

SEQ ID NO: 50154 - RNA, 18 nt, Artificial Sequence
  Description of Artificial Sequence: Synthetic oligonucleotide
cccacuggaccccaaacc

SEQ ID NO: 50155 - RNA, 18 nt, Artificial Sequence
  Description of Artificial Sequence: Synthetic oligonucleotide
gcugacccacuggacccc

SEQ ID NO: 50156 - RNA, 18 nt, Artificial Sequence
  Description of Artificial Sequence: Synthetic oligonucleotide
cggcugcugacccacugg

SEQ ID NO: 50157 - RNA, 18 nt, Artificial Sequence
  Description of Artificial Sequence: Synthetic oligonucleotide
gguaacggcugcugaccc

SEQ ID NO: 50158 - RNA, 18 nt, Artificial Sequence
  Description of Artificial Sequence: Synthetic oligonucleotide
auccagguaacggcugcu

SEQ ID NO: 50159 - RNA, 18 nt, Artificial Sequence
  Description of Artificial Sequence: Synthetic oligonucleotide
ccgggauccagguaacgg

SEQ ID NO: 50160 - RNA, 18 nt, Artificial Sequence
  Description of Artificial Sequence: Synthetic oligonucleotide
ggucaccgggauccaggu

SEQ ID NO: 50161 - RNA, 18 nt, Artificial Sequence
  Description of Artificial Sequence: Synthetic oligonucleotide
aucccggucaccgggauc

SEQ ID NO: 50162 - RNA, 18 nt, Artificial Sequence
  Description of Artificial Sequence: Synthetic oligonucleotide
gccacaucccggucaccg

SEQ ID NO: 50163 - RNA, 18 nt, Artificial Sequence
  Description of Artificial Sequence: Synthetic oligonucleotide
gaagggagacgcaaauca

SEQ ID NO: 50164 - RNA, 18 nt, Artificial Sequence
  Description of Artificial Sequence: Synthetic oligonucleotide
aggaggaagggagacgca

SEQ ID NO: 50165 - RNA, 18 nt, Artificial Sequence
  Description of Artificial Sequence: Synthetic oligonucleotide
ggaggaggaggaagggag

SEQ ID NO: 50166 - RNA, 18 nt, Artificial Sequence
  Description of Artificial Sequence: Synthetic oligonucleotide
gaggaggaggaggaggaa

SEQ ID NO: 50167 - RNA, 18 nt, Artificial Sequence
  Description of Artificial Sequence: Synthetic oligonucleotide
ccagggaggaggaggagg

SEQ ID NO: 50168 - RNA, 18 nt, Artificial Sequence
  Description of Artificial Sequence: Synthetic oligonucleotide
ccuguccagggaggagga

SEQ ID NO: 50169 - RNA, 18 nt, Artificial Sequence
  Description of Artificial Sequence: Synthetic oligonucleotide
gggagccuguccagggag

SEQ ID NO: 50170 - RNA, 18 nt, Artificial Sequence
  Description of Artificial Sequence: Synthetic oligonucleotide
caggagggagccugucca

SEQ ID NO: 50171 - RNA, 18 nt, Artificial Sequence
  Description of Artificial Sequence: Synthetic oligonucleotide
ggcagcaggagggagccu

SEQ ID NO: 50172 - RNA, 18 nt, Artificial Sequence
  Description of Artificial Sequence: Synthetic oligonucleotide
uucaaggcagcaggaggg

SEQ ID NO: 50173 - RNA, 18 nt, Artificial Sequence
  Description of Artificial Sequence: Synthetic oligonucleotide
gggauucaaggcagcagg

SEQ ID NO: 50174 - RNA, 18 nt, Artificial Sequence
  Description of Artificial Sequence: Synthetic oligonucleotide
cccucugagcgagguggg

SEQ ID NO: 50175 - RNA, 18 nt, Artificial Sequence
  Description of Artificial Sequence: Synthetic oligonucleotide
auugccccucugagcgag

SEQ ID NO: 50176 - RNA, 18 nt, Artificial Sequence
  Description of Artificial Sequence: Synthetic oligonucleotide
uacuuauugccccucuga

SEQ ID NO: 50177 - RNA, 18 nt, Artificial Sequence
  Description of Artificial Sequence: Synthetic oligonucleotide
uguucuacuuauugcccc

SEQ ID NO: 50178 - RNA, 18 nt, Artificial Sequence
  Description of Artificial Sequence: Synthetic oligonucleotide
cacuauguucuacuuauu

SEQ ID NO: 50179 - RNA, 18 nt, Artificial Sequence
  Description of Artificial Sequence: Synthetic oligonucleotide
ucagccacuauguucuac

SEQ ID NO: 50180 - RNA, 18 nt, Artificial Sequence
  Description of Artificial Sequence: Synthetic oligonucleotide
gucucucagccacuaugu

SEQ ID NO: 50181 - RNA, 18 nt, Artificial Sequence
  Description of Artificial Sequence: Synthetic oligonucleotide
aaccagucucucagccac

SEQ ID NO: 50182 - RNA, 18 nt, Artificial Sequence
  Description of Artificial Sequence: Synthetic oligonucleotide
gcuguaaccagucucuca

SEQ ID NO: 50183 - RNA, 18 nt, Artificial Sequence
  Description of Artificial Sequence: Synthetic oligonucleotide
gcagagcuguaaccaguc

SEQ ID NO: 50184 - RNA, 18 nt, Artificial Sequence
  Description of Artificial Sequence: Synthetic oligonucleotide
aaauggcagagcuguaac

SEQ ID NO: 50185 - RNA, 18 nt, Artificial Sequence
  Description of Artificial Sequence: Synthetic oligonucleotide
cuaauaaauggcagagcu

SEQ ID NO: 50186 - RNA, 18 nt, Artificial Sequence
  Description of Artificial Sequence: Synthetic oligonucleotide
cacagcuaauaaauggca

SEQ ID NO: 50187 - RNA, 18 nt, Artificial Sequence
  Description of Artificial Sequence: Synthetic oligonucleotide
gguuucacagcuaauaaa

SEQ ID NO: 50188 - RNA, 18 nt, Artificial Sequence
  Description of Artificial Sequence: Synthetic oligonucleotide
cccuggguuucacagcua

SEQ ID NO: 50189 - RNA, 18 nt, Artificial Sequence
  Description of Artificial Sequence: Synthetic oligonucleotide
acaugcccuggguuucac

SEQ ID NO: 50190 - RNA, 18 nt, Artificial Sequence
  Description of Artificial Sequence: Synthetic oligonucleotide
ugguaacaugcccugggu

SEQ ID NO: 50191 - RNA, 18 nt, Artificial Sequence
  Description of Artificial Sequence: Synthetic oligonucleotide
ugguuugguaacaugccc

SEQ ID NO: 50192 - RNA, 18 nt, Artificial Sequence
  Description of Artificial Sequence: Synthetic oligonucleotide
cagggugguuugguaaca

SEQ ID NO: 50193 - RNA, 18 nt, Artificial Sequence
  Description of Artificial Sequence: Synthetic oligonucleotide
gggcccagggugguuugg

SEQ ID NO: 50194 - RNA, 18 nt, Artificial Sequence
  Description of Artificial Sequence: Synthetic oligonucleotide
ggaaugggcccagggugg

SEQ ID NO: 50195 - RNA, 18 nt, Artificial Sequence
  Description of Artificial Sequence: Synthetic oligonucleotide
gugaaggaaugggcccag

SEQ ID NO: 50196 - RNA, 18 nt, Artificial Sequence
  Description of Artificial Sequence: Synthetic oligonucleotide
uacaggugaaggaauggg

SEQ ID NO: 50197 - RNA, 18 nt, Artificial Sequence
  Description of Artificial Sequence: Synthetic oligonucleotide
cauuuuacaggugaagga

SEQ ID NO: 50198 - RNA, 18 nt, Artificial Sequence
  Description of Artificial Sequence: Synthetic oligonucleotide
auuuccauuuuacaggug

SEQ ID NO: 50199 - RNA, 18 nt, Artificial Sequence
  Description of Artificial Sequence: Synthetic oligonucleotide
cuauuauuuccauuuuac

SEQ ID NO: 50200 - RNA, 18 nt, Artificial Sequence
  Description of Artificial Sequence: Synthetic oligonucleotide
aaguacuauuauuuccau

SEQ ID NO: 50201 - RNA, 18 nt, Artificial Sequence
  Description of Artificial Sequence: Synthetic oligonucleotide
cagauaaguacuauuauu

SEQ ID NO: 50202 - RNA, 18 nt, Artificial Sequence
  Description of Artificial Sequence: Synthetic oligonucleotide
gcccagggugguuuggua

SEQ ID NO: 50203 - RNA, 18 nt, Artificial Sequence
  Description of Artificial Sequence: Synthetic oligonucleotide
aaugggcccagggugguu

SEQ ID NO: 50204 - RNA, 18 nt, Artificial Sequence
  Description of Artificial Sequence: Synthetic oligonucleotide
gaaggaaugggcccaggg

SEQ ID NO: 50205 - RNA, 18 nt, Artificial Sequence
  Description of Artificial Sequence: Synthetic oligonucleotide
caggugaaggaaugggcc

SEQ ID NO: 50206 - RNA, 18 nt, Artificial Sequence
  Description of Artificial Sequence: Synthetic oligonucleotide
uuuuacaggugaaggaau

SEQ ID NO: 50207 - RNA, 18 nt, Artificial Sequence
  Description of Artificial Sequence: Synthetic oligonucleotide
uuccauuuuacaggugaa

SEQ ID NO: 50208 - RNA, 18 nt, Artificial Sequence
  Description of Artificial Sequence: Synthetic oligonucleotide
auuauuuccauuuuacag

SEQ ID NO: 50209 - RNA, 18 nt, Artificial Sequence
  Description of Artificial Sequence: Synthetic oligonucleotide
guacuauuauuuccauuu

SEQ ID NO: 50210 - RNA, 18 nt, Artificial Sequence
  Description of Artificial Sequence: Synthetic oligonucleotide
gauaaguacuauuauuuc

SEQ ID NO: 50211 - RNA, 18 nt, Artificial Sequence
  Description of Artificial Sequence: Synthetic oligonucleotide
uaucagauaaguacuauu

SEQ ID NO: 50212 - RNA, 18 nt, Artificial Sequence
  Description of Artificial Sequence: Synthetic oligonucleotide
aacucuaucagauaagua

SEQ ID NO: 50213 - RNA, 18 nt, Artificial Sequence
  Description of Artificial Sequence: Synthetic oligonucleotide
acaacaacucuaucagau

SEQ ID NO: 50214 - RNA, 18 nt, Artificial Sequence
  Description of Artificial Sequence: Synthetic oligonucleotide
ucuucacaacaacucuau

SEQ ID NO: 50215 - RNA, 18 nt, Artificial Sequence
  Description of Artificial Sequence: Synthetic oligonucleotide
ucacaucuucacaacaac

SEQ ID NO: 50216 - RNA, 18 nt, Artificial Sequence
  Description of Artificial Sequence: Synthetic oligonucleotide
auaauucacaucuucaca

SEQ ID NO: 50217 - RNA, 18 nt, Artificial Sequence
  Description of Artificial Sequence: Synthetic oligonucleotide
caagcauaauucacaucu

SEQ ID NO: 50218 - RNA, 18 nt, Artificial Sequence
  Description of Artificial Sequence: Synthetic oligonucleotide
ccagccaagcauaauuca

SEQ ID NO: 50219 - RNA, 18 nt, Artificial Sequence
  Description of Artificial Sequence: Synthetic oligonucleotide
augugccagccaagcaua

SEQ ID NO: 50220 - RNA, 18 nt, Artificial Sequence
  Description of Artificial Sequence: Synthetic oligonucleotide
guacuaugugccagccaa

SEQ ID NO: 50221 - RNA, 18 nt, Artificial Sequence
  Description of Artificial Sequence: Synthetic oligonucleotide
cugcuguacuaugugcca

SEQ ID NO: 50222 - RNA, 18 nt, Artificial Sequence
  Description of Artificial Sequence: Synthetic oligonucleotide
acugacugcuguacuaug

SEQ ID NO: 50223 - RNA, 18 nt, Artificial Sequence
  Description of Artificial Sequence: Synthetic oligonucleotide
cauuuacugacugcugua

SEQ ID NO: 50224 - RNA, 18 nt, Artificial Sequence
  Description of Artificial Sequence: Synthetic oligonucleotide
uaaaacauuuacugacug

SEQ ID NO: 50225 - RNA, 18 nt, Artificial Sequence
  Description of Artificial Sequence: Synthetic oligonucleotide
aauaguaaaacauuuacu

SEQ ID NO: 50226 - RNA, 18 nt, Artificial Sequence
  Description of Artificial Sequence: Synthetic oligonucleotide
aaaagaauaguaaaacau

SEQ ID NO: 50227 - RNA, 18 nt, Artificial Sequence
  Description of Artificial Sequence: Synthetic oligonucleotide
agggaaaaagaauaguaa

SEQ ID NO: 50228 - RNA, 18 nt, Artificial Sequence
  Description of Artificial Sequence: Synthetic oligonucleotide
ucagaagggaaaaagaau

SEQ ID NO: 50229 - RNA, 18 nt, Artificial Sequence
  Description of Artificial Sequence: Synthetic oligonucleotide
gguguucagaagggaaaa

SEQ ID NO: 50230 - RNA, 18 nt, Artificial Sequence
  Description of Artificial Sequence: Synthetic oligonucleotide
gcacagguguucagaagg

SEQ ID NO: 50231 - RNA, 18 nt, Artificial Sequence
  Description of Artificial Sequence: Synthetic oligonucleotide
gaagggcacagguguuca

SEQ ID NO: 50232 - RNA, 18 nt, Artificial Sequence
  Description of Artificial Sequence: Synthetic oligonucleotide
ggacugaagggcacaggu

SEQ ID NO: 50233 - RNA, 18 nt, Artificial Sequence
  Description of Artificial Sequence: Synthetic oligonucleotide
gggagggacugaagggca

SEQ ID NO: 50234 - RNA, 18 nt, Artificial Sequence
  Description of Artificial Sequence: Synthetic oligonucleotide
uggagauagaggccuggg

SEQ ID NO: 50235 - RNA, 18 nt, Artificial Sequence
  Description of Artificial Sequence: Synthetic oligonucleotide
gucuggagauagaggccu

SEQ ID NO: 50236 - RNA, 18 nt, Artificial Sequence
  Description of Artificial Sequence: Synthetic oligonucleotide
aggaugucuggagauaga

SEQ ID NO: 50237 - RNA, 18 nt, Artificial Sequence
  Description of Artificial Sequence: Synthetic oligonucleotide
ggguuaggaugucuggag

SEQ ID NO: 50238 - RNA, 18 nt, Artificial Sequence
  Description of Artificial Sequence: Synthetic oligonucleotide
uacauugcucuggauccg

SEQ ID NO: 50239 - RNA, 18 nt, Artificial Sequence
  Description of Artificial Sequence: Synthetic oligonucleotide
ccuucuacauugcucugg

SEQ ID NO: 50240 - RNA, 18 nt, Artificial Sequence
  Description of Artificial Sequence: Synthetic oligonucleotide
auaggccuucuacauugc

SEQ ID NO: 50241 - RNA, 18 nt, Artificial Sequence
  Description of Artificial Sequence: Synthetic oligonucleotide
cagguauaggccuucuac

SEQ ID NO: 50242 - RNA, 18 nt, Artificial Sequence
  Description of Artificial Sequence: Synthetic oligonucleotide
ucagucagguauaggccu

SEQ ID NO: 50243 - RNA, 18 nt, Artificial Sequence
  Description of Artificial Sequence: Synthetic oligonucleotide
ccccaucagucagguaua

SEQ ID NO: 50244 - RNA, 18 nt, Artificial Sequence
  Description of Artificial Sequence: Synthetic oligonucleotide
agggaccccaucagucag

SEQ ID NO: 50245 - RNA, 18 nt, Artificial Sequence
  Description of Artificial Sequence: Synthetic oligonucleotide
gagaaagggaccccauca

SEQ ID NO: 50246 - RNA, 18 nt, Artificial Sequence
  Description of Artificial Sequence: Synthetic oligonucleotide
aacaggagaaagggaccc

SEQ ID NO: 50247 - RNA, 18 nt, Artificial Sequence
  Description of Artificial Sequence: Synthetic oligonucleotide
guugcaacaggagaaagg

SEQ ID NO: 50248 - RNA, 18 nt, Artificial Sequence
  Description of Artificial Sequence: Synthetic oligonucleotide
ggguugcaacaggagaaa

SEQ ID NO: 50249 - RNA, 18 nt, Artificial Sequence
  Description of Artificial Sequence: Synthetic oligonucleotide
uuugcaggcaaggccggg

SEQ ID NO: 50250 - RNA, 18 nt, Artificial Sequence
  Description of Artificial Sequence: Synthetic oligonucleotide
acgguuuugcaggcaagg

SEQ ID NO: 50251 - RNA, 18 nt, Artificial Sequence
  Description of Artificial Sequence: Synthetic oligonucleotide
gaaagacgguuuugcagg

SEQ ID NO: 50252 - RNA, 18 nt, Artificial Sequence
  Description of Artificial Sequence: Synthetic oligonucleotide
agucugaaagacgguuuu

SEQ ID NO: 50253 - RNA, 18 nt, Artificial Sequence
  Description of Artificial Sequence: Synthetic oligonucleotide
guaggagucugaaagacg

SEQ ID NO: 50254 - RNA, 18 nt, Artificial Sequence
  Description of Artificial Sequence: Synthetic oligonucleotide
ugggcguaggagucugaa

SEQ ID NO: 50255 - RNA, 18 nt, Artificial Sequence
  Description of Artificial Sequence: Synthetic oligonucleotide
gggugggcguaggagucu

SEQ ID NO: 50256 - RNA, 18 nt, Artificial Sequence
  Description of Artificial Sequence: Synthetic oligonucleotide
uuugguuggguugucggg

SEQ ID NO: 50257 - RNA, 18 nt, Artificial Sequence
  Description of Artificial Sequence: Synthetic oligonucleotide
gagguuuugguuggguug

SEQ ID NO: 50258 - RNA, 18 nt, Artificial Sequence
  Description of Artificial Sequence: Synthetic oligonucleotide
gcccagagguuuugguug

SEQ ID NO: 50259 - RNA, 18 nt, Artificial Sequence
  Description of Artificial Sequence: Synthetic oligonucleotide
cuugggcccagagguuuu

SEQ ID NO: 50260 - RNA, 18 nt, Artificial Sequence
  Description of Artificial Sequence: Synthetic oligonucleotide
gcacccuugggcccagag

SEQ ID NO: 50261 - RNA, 18 nt, Artificial Sequence
  Description of Artificial Sequence: Synthetic oligonucleotide
ucauggcacccuugggcc

SEQ ID NO: 50262 - RNA, 18 nt, Artificial Sequence
  Description of Artificial Sequence: Synthetic oligonucleotide
gcaccucauggcacccuu

SEQ ID NO: 50263 - RNA, 18 nt, Artificial Sequence
  Description of Artificial Sequence: Synthetic oligonucleotide
cagcagcaccucauggca

SEQ ID NO: 50264 - RNA, 18 nt, Artificial Sequence
  Description of Artificial Sequence: Synthetic oligonucleotide
ugcuccagcagcaccuca

SEQ ID NO: 50265 - RNA, 18 nt, Artificial Sequence
  Description of Artificial Sequence: Synthetic oligonucleotide
gcaagugcuccagcagca

SEQ ID NO: 50266 - RNA, 18 nt, Artificial Sequence
  Description of Artificial Sequence: Synthetic oligonucleotide
guccugcaagugcuccag

SEQ ID NO: 50267 - RNA, 18 nt, Artificial Sequence
  Description of Artificial Sequence: Synthetic oligonucleotide
gccaaguccugcaagugc

SEQ ID NO: 50268 - RNA, 18 nt, Artificial Sequence
  Description of Artificial Sequence: Synthetic oligonucleotide
ugccugccaaguccugca

SEQ ID NO: 50269 - RNA, 18 nt, Artificial Sequence
  Description of Artificial Sequence: Synthetic oligonucleotide
cagugugccugccaaguc

SEQ ID NO: 50270 - RNA, 18 nt, Artificial Sequence
  Description of Artificial Sequence: Synthetic oligonucleotide
cuacccagugugccugcc

SEQ ID NO: 50271 - RNA, 18 nt, Artificial Sequence
  Description of Artificial Sequence: Synthetic oligonucleotide
gcaugcuacccagugugc

SEQ ID NO: 50272 - RNA, 18 nt, Artificial Sequence
  Description of Artificial Sequence: Synthetic oligonucleotide
agccagcaugcuacccag

SEQ ID NO: 50273 - RNA, 18 nt, Artificial Sequence
  Description of Artificial Sequence: Synthetic oligonucleotide
gugacagccagcaugcua

SEQ ID NO: 50274 - RNA, 18 nt, Artificial Sequence
  Description of Artificial Sequence: Synthetic oligonucleotide
ggaaggugacagccagca

SEQ ID NO: 50275 - RNA, 18 nt, Artificial Sequence
  Description of Artificial Sequence: Synthetic oligonucleotide
caguaggaaggugacagc

SEQ ID NO: 50276 - RNA, 18 nt, Artificial Sequence
  Description of Artificial Sequence: Synthetic oligonucleotide
uuggaugccaggcguauu

SEQ ID NO: 50277 - RNA, 18 nt, Artificial Sequence
  Description of Artificial Sequence: Synthetic oligonucleotide
uggacuuggaugccaggc

SEQ ID NO: 50278 - RNA, 18 nt, Artificial Sequence
  Description of Artificial Sequence: Synthetic oligonucleotide
guggguggacuuggaugc

SEQ ID NO: 50279 - RNA, 18 nt, Artificial Sequence
  Description of Artificial Sequence: Synthetic oligonucleotide
ccggaguggguggacuug

SEQ ID NO: 50280 - RNA, 18 nt, Artificial Sequence
  Description of Artificial Sequence: Synthetic oligonucleotide
aaaguccggagugggugg

SEQ ID NO: 50281 - RNA, 18 nt, Artificial Sequence
  Description of Artificial Sequence: Synthetic oligonucleotide
aggccaaaguccggagug

SEQ ID NO: 50282 - RNA, 18 nt, Artificial Sequence
  Description of Artificial Sequence: Synthetic oligonucleotide
ugcuaaggccaaaguccg

SEQ ID NO: 50283 - RNA, 18 nt, Artificial Sequence
  Description of Artificial Sequence: Synthetic oligonucleotide
acuacugcuaaggccaaa

SEQ ID NO: 50284 - RNA, 18 nt, Artificial Sequence
  Description of Artificial Sequence: Synthetic oligonucleotide
cacuaacuacugcuaagg

SEQ ID NO: 50285 - RNA, 18 nt, Artificial Sequence
  Description of Artificial Sequence: Synthetic oligonucleotide
ucccacacuaacuacugc

SEQ ID NO: 50286 - RNA, 18 nt, Artificial Sequence
  Description of Artificial Sequence: Synthetic oligonucleotide
cagccucccacacuaacu

SEQ ID NO: 50287 - RNA, 18 nt, Artificial Sequence
  Description of Artificial Sequence: Synthetic oligonucleotide
cuucccagccucccacac

SEQ ID NO: 50288 - RNA, 18 nt, Artificial Sequence
  Description of Artificial Sequence: Synthetic oligonucleotide
ccagucuucccagccucc

SEQ ID NO: 50289 - RNA, 18 nt, Artificial Sequence
  Description of Artificial Sequence: Synthetic oligonucleotide
ugcucccagucuucccag

SEQ ID NO: 50290 - RNA, 18 nt, Artificial Sequence
  Description of Artificial Sequence: Synthetic oligonucleotide
gagacugcucccagucuu

SEQ ID NO: 50291 - RNA, 18 nt, Artificial Sequence
  Description of Artificial Sequence: Synthetic oligonucleotide
uuuaagagacugcuccca

SEQ ID NO: 50292 - RNA, 18 nt, Artificial Sequence
  Description of Artificial Sequence: Synthetic oligonucleotide
uuuuguuuaagagacugc

SEQ ID NO: 50293 - RNA, 18 nt, Artificial Sequence
  Description of Artificial Sequence: Synthetic oligonucleotide
uuugcuuuuguuuaagag

SEQ ID NO: 50294 - RNA, 18 nt, Artificial Sequence
  Description of Artificial Sequence: Synthetic oligonucleotide
auucuuuugcuuuuguuu

SEQ ID NO: 50295 - RNA, 18 nt, Artificial Sequence
  Description of Artificial Sequence: Synthetic oligonucleotide
agcuuauucuuuugcuuu

SEQ ID NO: 50296 - RNA, 18 nt, Artificial Sequence
  Description of Artificial Sequence: Synthetic oligonucleotide
cccgaagcuuauucuuuu

SEQ ID NO: 50297 - RNA, 18 nt, Artificial Sequence
  Description of Artificial Sequence: Synthetic oligonucleotide
cagcgcccgaagcuuauu

SEQ ID NO: 50298 - RNA, 18 nt, Artificial Sequence
  Description of Artificial Sequence: Synthetic oligonucleotide
uacuacagcgcccgaagc

SEQ ID NO: 50299 - RNA, 18 nt, Artificial Sequence
  Description of Artificial Sequence: Synthetic oligonucleotide
gcagguacuacagcgccc

SEQ ID NO: 50300 - RNA, 18 nt, Artificial Sequence
  Description of Artificial Sequence: Synthetic oligonucleotide
agcuggcagguacuacag

SEQ ID NO: 50301 - RNA, 18 nt, Artificial Sequence
  Description of Artificial Sequence: Synthetic oligonucleotide
gcgaaagcuggcagguac

SEQ ID NO: 50302 - RNA, 18 nt, Artificial Sequence
  Description of Artificial Sequence: Synthetic oligonucleotide
cuguggcgaaagcuggca

SEQ ID NO: 50303 - RNA, 18 nt, Artificial Sequence
  Description of Artificial Sequence: Synthetic oligonucleotide
cccagcucccaguaucca

SEQ ID NO: 50304 - RNA, 18 nt, Artificial Sequence
  Description of Artificial Sequence: Synthetic oligonucleotide
guucccccagcucccagu

SEQ ID NO: 50305 - RNA, 18 nt, Artificial Sequence
  Description of Artificial Sequence: Synthetic oligonucleotide
ucucaguucccccagcuc

SEQ ID NO: 50306 - RNA, 18 nt, Artificial Sequence
  Description of Artificial Sequence: Synthetic oligonucleotide
agucuucucaguuccccc

SEQ ID NO: 50307 - RNA, 18 nt, Artificial Sequence
  Description of Artificial Sequence: Synthetic oligonucleotide
uggcuagucuucucaguu

SEQ ID NO: 50308 - RNA, 18 nt, Artificial Sequence
  Description of Artificial Sequence: Synthetic oligonucleotide
auaucuggcuagucuucu

SEQ ID NO: 50309 - RNA, 18 nt, Artificial Sequence
  Description of Artificial Sequence: Synthetic oligonucleotide
auguaauaucuggcuagu

SEQ ID NO: 50310 - RNA, 18 nt, Artificial Sequence
  Description of Artificial Sequence: Synthetic oligonucleotide
aauacauguaauaucugg

SEQ ID NO: 50311 - RNA, 18 nt, Artificial Sequence
  Description of Artificial Sequence: Synthetic oligonucleotide
uuggcaauacauguaaua

SEQ ID NO: 50312 - RNA, 18 nt, Artificial Sequence
  Description of Artificial Sequence: Synthetic oligonucleotide
uugaguuggcaauacaug

SEQ ID NO: 50313 - RNA, 18 nt, Artificial Sequence
  Description of Artificial Sequence: Synthetic oligonucleotide
aaguuuugaguuggcaau

SEQ ID NO: 50314 - RNA, 18 nt, Artificial Sequence
  Description of Artificial Sequence: Synthetic oligonucleotide
gcugaaaguuuugaguug

SEQ ID NO: 50315 - RNA, 18 nt, Artificial Sequence
  Description of Artificial Sequence: Synthetic oligonucleotide
uaaaagcugaaaguuuug

SEQ ID NO: 50316 - RNA, 18 nt, Artificial Sequence
  Description of Artificial Sequence: Synthetic oligonucleotide
cauguuaaaagcugaaag

SEQ ID NO: 50317 - RNA, 18 nt, Artificial Sequence
  Description of Artificial Sequence: Synthetic oligonucleotide
ggaagcauguuaaaagcu

SEQ ID NO: 50318 - RNA, 18 nt, Artificial Sequence
  Description of Artificial Sequence: Synthetic oligonucleotide
ugugaggaagcauguuaa

SEQ ID NO: 50319 - RNA, 18 nt, Artificial Sequence
  Description of Artificial Sequence: Synthetic oligonucleotide
uaaugugugaggaagcau

SEQ ID NO: 50320 - RNA, 18 nt, Artificial Sequence
  Description of Artificial Sequence: Synthetic oligonucleotide
gggauaaugugugaggaa

SEQ ID NO: 50321 - RNA, 18 nt, Artificial Sequence
  Description of Artificial Sequence: Synthetic oligonucleotide
uuguggaggaucaaaggg

SEQ ID NO: 50322 - RNA, 18 nt, Artificial Sequence
  Description of Artificial Sequence: Synthetic oligonucleotide
cagaguuguggaggauca

SEQ ID NO: 50323 - RNA, 18 nt, Artificial Sequence
  Description of Artificial Sequence: Synthetic oligonucleotide
caccucagaguuguggag

SEQ ID NO: 50324 - RNA, 18 nt, Artificial Sequence
  Description of Artificial Sequence: Synthetic oligonucleotide
agguccaccucagaguug

SEQ ID NO: 50325 - RNA, 18 nt, Artificial Sequence
  Description of Artificial Sequence: Synthetic oligonucleotide
ccaccagguccaccucag

SEQ ID NO: 50326 - RNA, 18 nt, Artificial Sequence
  Description of Artificial Sequence: Synthetic oligonucleotide
aagacccaccagguccac

SEQ ID NO: 50327 - RNA, 18 nt, Artificial Sequence
  Description of Artificial Sequence: Synthetic oligonucleotide
gggcuaagacccaccagg

SEQ ID NO: 50328 - RNA, 18 nt, Artificial Sequence
  Description of Artificial Sequence: Synthetic oligonucleotide
auuuucucaucuaccaag

SEQ ID NO: 50329 - RNA, 18 nt, Artificial Sequence
  Description of Artificial Sequence: Synthetic oligonucleotide
aaccuauuuucucaucua

SEQ ID NO: 50330 - RNA, 18 nt, Artificial Sequence
  Description of Artificial Sequence: Synthetic oligonucleotide
cucucaaccuauuuucuc

SEQ ID NO: 50331 - RNA, 18 nt, Artificial Sequence
  Description of Artificial Sequence: Synthetic oligonucleotide
ugucucucucaaccuauu

SEQ ID NO: 50332 - RNA, 18 nt, Artificial Sequence
  Description of Artificial Sequence: Synthetic oligonucleotide
cucacugucucucucaac

SEQ ID NO: 50333 - RNA, 18 nt, Artificial Sequence
  Description of Artificial Sequence: Synthetic oligonucleotide
agcaucucacugucucuc

SEQ ID NO: 50334 - RNA, 18 nt, Artificial Sequence
  Description of Artificial Sequence: Synthetic oligonucleotide
uacugagcaucucacugu

SEQ ID NO: 50335 - RNA, 18 nt, Artificial Sequence
  Description of Artificial Sequence: Synthetic oligonucleotide
ugugauacugagcaucuc

SEQ ID NO: 50336 - RNA, 18 nt, Artificial Sequence
  Description of Artificial Sequence: Synthetic oligonucleotide
ugcugugugauacugagc

SEQ ID NO: 50337 - RNA, 18 nt, Artificial Sequence
  Description of Artificial Sequence: Synthetic oligonucleotide
agguuugcugugugauac

SEQ ID NO: 50338 - RNA, 18 nt, Artificial Sequence
  Description of Artificial Sequence: Synthetic oligonucleotide
ccaagagguuugcugugu

SEQ ID NO: 50339 - RNA, 18 nt, Artificial Sequence
  Description of Artificial Sequence: Synthetic oligonucleotide
uagggccaagagguuugc

SEQ ID NO: 50340 - RNA, 18 nt, Artificial Sequence
  Description of Artificial Sequence: Synthetic oligonucleotide
auguauagggccaagagg

SEQ ID NO: 50341 - RNA, 18 nt, Artificial Sequence
  Description of Artificial Sequence: Synthetic oligonucleotide
gaaugauguauagggcca

SEQ ID NO: 50342 - RNA, 18 nt, Artificial Sequence
  Description of Artificial Sequence: Synthetic oligonucleotide
guuuggaaugauguauag

SEQ ID NO: 50343 - RNA, 18 nt, Artificial Sequence
  Description of Artificial Sequence: Synthetic oligonucleotide
cuuguguuuggaaugaug

SEQ ID NO: 50344 - RNA, 18 nt, Artificial Sequence
  Description of Artificial Sequence: Synthetic oligonucleotide
ugggucuuguguuuggaa

SEQ ID NO: 50345 - RNA, 18 nt, Artificial Sequence
  Description of Artificial Sequence: Synthetic oligonucleotide
caaccugggucuuguguu

SEQ ID NO: 50346 - RNA, 18 nt, Artificial Sequence
  Description of Artificial Sequence: Synthetic oligonucleotide
auaugcaaccugggucuu

SEQ ID NO: 50347 - RNA, 18 nt, Artificial Sequence
  Description of Artificial Sequence: Synthetic oligonucleotide
cuucuauaugcaaccugg

SEQ ID NO: 50348 - RNA, 18 nt, Artificial Sequence
  Description of Artificial Sequence: Synthetic oligonucleotide
ugaaccuucuauaugcaa

SEQ ID NO: 50349 - RNA, 18 nt, Artificial Sequence
  Description of Artificial Sequence: Synthetic oligonucleotide
gacacugaaccuucuaua

SEQ ID NO: 50350 - RNA, 18 nt, Artificial Sequence
  Description of Artificial Sequence: Synthetic oligonucleotide
ccagggacacugaaccuu

SEQ ID NO: 50351 - RNA, 18 nt, Artificial Sequence
  Description of Artificial Sequence: Synthetic oligonucleotide
cuaaaccagggacacuga

SEQ ID NO: 50352 - RNA, 18 nt, Artificial Sequence
  Description of Artificial Sequence: Synthetic oligonucleotide
uccuucuaaaccagggac

SEQ ID NO: 50353 - RNA, 18 nt, Artificial Sequence
  Description of Artificial Sequence: Synthetic oligonucleotide
accucuccuucuaaacca

SEQ ID NO: 50354 - RNA, 18 nt, Artificial Sequence
  Description of Artificial Sequence: Synthetic oligonucleotide
acaccaccucuccuucua

SEQ ID NO: 50355 - RNA, 18 nt, Artificial Sequence
  Description of Artificial Sequence: Synthetic oligonucleotide
gccucacaccaccucucc

SEQ ID NO: 50356 - RNA, 18 nt, Artificial Sequence
  Description of Artificial Sequence: Synthetic oligonucleotide
ugcuugccucacaccacc

SEQ ID NO: 50357 - RNA, 18 nt, Artificial Sequence
  Description of Artificial Sequence: Synthetic oligonucleotide
cuucuugcuugccucaca

SEQ ID NO: 50358 - RNA, 18 nt, Artificial Sequence
  Description of Artificial Sequence: Synthetic oligonucleotide
ggcaucuucuugcuugcc

SEQ ID NO: 50359 - RNA, 18 nt, Artificial Sequence
  Description of Artificial Sequence: Synthetic oligonucleotide
gcagaggcaucuucuugc

SEQ ID NO: 50360 - RNA, 18 nt, Artificial Sequence
  Description of Artificial Sequence: Synthetic oligonucleotide
gugcagcagaggcaucuu

SEQ ID NO: 50361 - RNA, 18 nt, Artificial Sequence
  Description of Artificial Sequence: Synthetic oligonucleotide
cuggagugcagcagaggc

SEQ ID NO: 50362 - RNA, 18 nt, Artificial Sequence
  Description of Artificial Sequence: Synthetic oligonucleotide
ccaggcuggagugcagca

SEQ ID NO: 50363 - RNA, 18 nt, Artificial Sequence
  Description of Artificial Sequence: Synthetic oligonucleotide
gucgcccaggcuggagug

SEQ ID NO: 50364 - RNA, 18 nt, Artificial Sequence
  Description of Artificial Sequence: Synthetic oligonucleotide
ucacaccaccucuccuuc

SEQ ID NO: 50365 - RNA, 18 nt, Artificial Sequence
  Description of Artificial Sequence: Synthetic oligonucleotide
uugccucacaccaccucu

SEQ ID NO: 50366 - RNA, 18 nt, Artificial Sequence
  Description of Artificial Sequence: Synthetic oligonucleotide
cuugcuugccucacacca

SEQ ID NO: 50367 - RNA, 18 nt, Artificial Sequence
  Description of Artificial Sequence: Synthetic oligonucleotide
aucuucuugcuugccuca

SEQ ID NO: 50368 - RNA, 18 nt, Artificial Sequence
  Description of Artificial Sequence: Synthetic oligonucleotide
gaggcaucuucuugcuug

SEQ ID NO: 50369 - RNA, 18 nt, Artificial Sequence
  Description of Artificial Sequence: Synthetic oligonucleotide
cagcagaggcaucuucuu

SEQ ID NO: 50370 - RNA, 18 nt, Artificial Sequence
  Description of Artificial Sequence: Synthetic oligonucleotide
gagugcagcagaggcauc

SEQ ID NO: 50371 - RNA, 18 nt, Artificial Sequence
  Description of Artificial Sequence: Synthetic oligonucleotide
ggcuggagugcagcagag

SEQ ID NO: 50372 - RNA, 18 nt, Artificial Sequence
  Description of Artificial Sequence: Synthetic oligonucleotide
gcccaggcuggagugcag

SEQ ID NO: 50373 - RNA, 18 nt, Artificial Sequence
  Description of Artificial Sequence: Synthetic oligonucleotide
cugucgcccaggcuggag

SEQ ID NO: 50374 - RNA, 18 nt, Artificial Sequence
  Description of Artificial Sequence: Synthetic oligonucleotide
ucacucugucgcccaggc

SEQ ID NO: 50375 - RNA, 18 nt, Artificial Sequence
  Description of Artificial Sequence: Synthetic oligonucleotide
gagucucacucugucgcc

SEQ ID NO: 50376 - RNA, 18 nt, Artificial Sequence
  Description of Artificial Sequence: Synthetic oligonucleotide
agauggagucucacucug

SEQ ID NO: 50377 - RNA, 18 nt, Artificial Sequence
  Description of Artificial Sequence: Synthetic oligonucleotide
uuuugagauggagucuca

SEQ ID NO: 50378 - RNA, 18 nt, Artificial Sequence
  Description of Artificial Sequence: Synthetic oligonucleotide
uuuuuuuuugagauggag

SEQ ID NO: 50379 - RNA, 18 nt, Artificial Sequence
  Description of Artificial Sequence: Synthetic oligonucleotide
uuuuuuuuuuuuuugaga

SEQ ID NO: 50380 - RNA, 18 nt, Artificial Sequence
  Description of Artificial Sequence: Synthetic oligonucleotide
uuuuuuuuuuuuuuuuuu

SEQ ID NO: 50381 - RNA, 18 nt, Artificial Sequence
  Description of Artificial Sequence: Synthetic oligonucleotide
cuuuuuuuuuuuuuuuuu

SEQ ID NO: 50382 - RNA, 18 nt, Artificial Sequence
  Description of Artificial Sequence: Synthetic oligonucleotide
ggcaucuuuuuuuuuuuu

SEQ ID NO: 50383 - RNA, 18 nt, Artificial Sequence
  Description of Artificial Sequence: Synthetic oligonucleotide
gcagaggcaucuuuuuuu

SEQ ID NO: 50384 - RNA, 18 nt, Artificial Sequence
  Description of Artificial Sequence: Synthetic oligonucleotide
auggagcagaggcaucuu

SEQ ID NO: 50385 - RNA, 18 nt, Artificial Sequence
  Description of Artificial Sequence: Synthetic oligonucleotide
gcuguauggagcagaggc

SEQ ID NO: 50386 - RNA, 18 nt, Artificial Sequence
  Description of Artificial Sequence: Synthetic oligonucleotide
gaccugcuguauggagca

SEQ ID NO: 50387 - RNA, 18 nt, Artificial Sequence
  Description of Artificial Sequence: Synthetic oligonucleotide
guacagaccugcuguaug

SEQ ID NO: 50388 - RNA, 18 nt, Artificial Sequence
  Description of Artificial Sequence: Synthetic oligonucleotide
ccuguguacagaccugcu

SEQ ID NO: 50389 - RNA, 18 nt, Artificial Sequence
  Description of Artificial Sequence: Synthetic oligonucleotide
cagauccuguguacagac

SEQ ID NO: 50390 - RNA, 18 nt, Artificial Sequence
  Description of Artificial Sequence: Synthetic oligonucleotide
ugagccagauccugugua

SEQ ID NO: 50391 - RNA, 18 nt, Artificial Sequence
  Description of Artificial Sequence: Synthetic oligonucleotide
ccacaugagccagauccu

SEQ ID NO: 50392 - RNA, 18 nt, Artificial Sequence
  Description of Artificial Sequence: Synthetic oligonucleotide
uaaaaccacaugagccag

SEQ ID NO: 50393 - RNA, 18 nt, Artificial Sequence
  Description of Artificial Sequence: Synthetic oligonucleotide
uuaacuaaaaccacauga

SEQ ID NO: 50394 - RNA, 18 nt, Artificial Sequence
  Description of Artificial Sequence: Synthetic oligonucleotide
cuaacuuaacuaaaacca

SEQ ID NO: 50395 - RNA, 18 nt, Artificial Sequence
  Description of Artificial Sequence: Synthetic oligonucleotide
uguggcuaacuuaacuaa

SEQ ID NO: 50396 - RNA, 18 nt, Artificial Sequence
  Description of Artificial Sequence: Synthetic oligonucleotide
guauuuguggcuaacuua

SEQ ID NO: 50397 - RNA, 18 nt, Artificial Sequence
  Description of Artificial Sequence: Synthetic oligonucleotide
acccuguauuuguggcua

SEQ ID NO: 50398 - RNA, 18 nt, Artificial Sequence
  Description of Artificial Sequence: Synthetic oligonucleotide
ggcagacccuguauuugu

SEQ ID NO: 50399 - RNA, 18 nt, Artificial Sequence
  Description of Artificial Sequence: Synthetic oligonucleotide
augugggcagacccugua

SEQ ID NO: 50400 - RNA, 18 nt, Artificial Sequence
  Description of Artificial Sequence: Synthetic oligonucleotide
caaagaugugggcagacc

SEQ ID NO: 50401 - RNA, 18 nt, Artificial Sequence
  Description of Artificial Sequence: Synthetic oligonucleotide
caaagcaaagaugugggc

SEQ ID NO: 50402 - RNA, 18 nt, Artificial Sequence
  Description of Artificial Sequence: Synthetic oligonucleotide
cuguucaaagcaaagaug

SEQ ID NO: 50403 - RNA, 18 nt, Artificial Sequence
  Description of Artificial Sequence: Synthetic oligonucleotide
cucaucuguucaaagcaa

SEQ ID NO: 50404 - RNA, 18 nt, Artificial Sequence
  Description of Artificial Sequence: Synthetic oligonucleotide
cauggcucaucuguucaa

SEQ ID NO: 50405 - RNA, 18 nt, Artificial Sequence
  Description of Artificial Sequence: Synthetic oligonucleotide
ccaaccauggcucaucug

SEQ ID NO: 50406 - RNA, 18 nt, Artificial Sequence
  Description of Artificial Sequence: Synthetic oligonucleotide
auuggccaaccauggcuc

SEQ ID NO: 50407 - RNA, 18 nt, Artificial Sequence
  Description of Artificial Sequence: Synthetic oligonucleotide
agauaauuggccaaccau

SEQ ID NO: 50408 - RNA, 18 nt, Artificial Sequence
  Description of Artificial Sequence: Synthetic oligonucleotide
uuggcagauaauuggcca

SEQ ID NO: 50409 - RNA, 18 nt, Artificial Sequence
  Description of Artificial Sequence: Synthetic oligonucleotide
ucugguuggcagauaauu

SEQ ID NO: 50410 - RNA, 18 nt, Artificial Sequence
  Description of Artificial Sequence: Synthetic oligonucleotide
aauuaucugguuggcaga

SEQ ID NO: 50411 - RNA, 18 nt, Artificial Sequence
  Description of Artificial Sequence: Synthetic oligonucleotide
ugagaaauuaucugguug

SEQ ID NO: 50412 - RNA, 18 nt, Artificial Sequence
  Description of Artificial Sequence: Synthetic oligonucleotide
cauauugagaaauuaucu

SEQ ID NO: 50413 - RNA, 18 nt, Artificial Sequence
  Description of Artificial Sequence: Synthetic oligonucleotide
gugagcauauugagaaau

SEQ ID NO: 50414 - RNA, 18 nt, Artificial Sequence
  Description of Artificial Sequence: Synthetic oligonucleotide
cuggugugagcauauuga

SEQ ID NO: 50415 - RNA, 18 nt, Artificial Sequence
  Description of Artificial Sequence: Synthetic oligonucleotide
agcaucuggugugagcau

SEQ ID NO: 50416 - RNA, 18 nt, Artificial Sequence
  Description of Artificial Sequence: Synthetic oligonucleotide
cuggaagcaucuggugug

SEQ ID NO: 50417 - RNA, 18 nt, Artificial Sequence
  Description of Artificial Sequence: Synthetic oligonucleotide
ccuagcuggaagcaucug

SEQ ID NO: 50418 - RNA, 18 nt, Artificial Sequence
  Description of Artificial Sequence: Synthetic oligonucleotide
cccucccuagcuggaagc

SEQ ID NO: 50419 - RNA, 18 nt, Artificial Sequence
  Description of Artificial Sequence: Synthetic oligonucleotide
uaauacccucccuagcug

SEQ ID NO: 50420 - RNA, 18 nt, Artificial Sequence
  Description of Artificial Sequence: Synthetic oligonucleotide
uccccuaauacccucccu

SEQ ID NO: 50421 - RNA, 18 nt, Artificial Sequence
  Description of Artificial Sequence: Synthetic oligonucleotide
cccuuuccccuaauaccc

SEQ ID NO: 50422 - RNA, 18 nt, Artificial Sequence
  Description of Artificial Sequence: Synthetic oligonucleotide
ucaagcccuuuccccuaa

SEQ ID NO: 50423 - RNA, 18 nt, Artificial Sequence
  Description of Artificial Sequence: Synthetic oligonucleotide
ggcccucaagcccuuucc

SEQ ID NO: 50424 - RNA, 18 nt, Artificial Sequence
  Description of Artificial Sequence: Synthetic oligonucleotide
acuguggcccucaagccc

SEQ ID NO: 50425 - RNA, 18 nt, Artificial Sequence
  Description of Artificial Sequence: Synthetic oligonucleotide
aguuuacuguggcccuca

SEQ ID NO: 50426 - RNA, 18 nt, Artificial Sequence
  Description of Artificial Sequence: Synthetic oligonucleotide
uguccaguuuacuguggc

SEQ ID NO: 50427 - RNA, 18 nt, Artificial Sequence
  Description of Artificial Sequence: Synthetic oligonucleotide
aaacuuguccaguuuacu

SEQ ID NO: 50428 - RNA, 18 nt, Artificial Sequence
  Description of Artificial Sequence: Synthetic oligonucleotide
gugaccuacagguggcag

SEQ ID NO: 50429 - RNA, 18 nt, Artificial Sequence
  Description of Artificial Sequence: Synthetic oligonucleotide
cccaagugaccuacaggu

SEQ ID NO: 50430 - RNA, 18 nt, Artificial Sequence
  Description of Artificial Sequence: Synthetic oligonucleotide
uggagcccaagugaccua

SEQ ID NO: 50431 - RNA, 18 nt, Artificial Sequence
  Description of Artificial Sequence: Synthetic oligonucleotide
auagcuggagcccaagug

SEQ ID NO: 50432 - RNA, 18 nt, Artificial Sequence
  Description of Artificial Sequence: Synthetic oligonucleotide
gccacauagcuggagccc

SEQ ID NO: 50433 - RNA, 18 nt, Artificial Sequence
  Description of Artificial Sequence: Synthetic oligonucleotide
aggcagccacauagcugg

SEQ ID NO: 50434 - RNA, 18 nt, Artificial Sequence
  Description of Artificial Sequence: Synthetic oligonucleotide
agaagaggcagccacaua

SEQ ID NO: 50435 - RNA, 18 nt, Artificial Sequence
  Description of Artificial Sequence: Synthetic oligonucleotide
ccagcagaagaggcagcc

SEQ ID NO: 50436 - RNA, 18 nt, Artificial Sequence
  Description of Artificial Sequence: Synthetic oligonucleotide
ggcacccagcagaagagg

SEQ ID NO: 50437 - RNA, 18 nt, Artificial Sequence
  Description of Artificial Sequence: Synthetic oligonucleotide
aguaaggcacccagcaga

SEQ ID NO: 50438 - RNA, 18 nt, Artificial Sequence
  Description of Artificial Sequence: Synthetic oligonucleotide
cccagaguaaggcaccca

SEQ ID NO: 50439 - RNA, 18 nt, Artificial Sequence
  Description of Artificial Sequence: Synthetic oligonucleotide
cacugcccagaguaaggc

SEQ ID NO: 50440 - RNA, 18 nt, Artificial Sequence
  Description of Artificial Sequence: Synthetic oligonucleotide
cacagcacugcccagagu

SEQ ID NO: 50441 - RNA, 18 nt, Artificial Sequence
  Description of Artificial Sequence: Synthetic oligonucleotide
gcaaccacagcacugccc

SEQ ID NO: 50442 - RNA, 18 nt, Artificial Sequence
  Description of Artificial Sequence: Synthetic oligonucleotide
ccugagcaaccacagcac

SEQ ID NO: 50443 - RNA, 18 nt, Artificial Sequence
  Description of Artificial Sequence: Synthetic oligonucleotide
cggucccugagcaaccac

SEQ ID NO: 50444 - RNA, 18 nt, Artificial Sequence
  Description of Artificial Sequence: Synthetic oligonucleotide
ucugccggucccugagca

SEQ ID NO: 50445 - RNA, 18 nt, Artificial Sequence
  Description of Artificial Sequence: Synthetic oligonucleotide
caggcucugccggucccu

SEQ ID NO: 50446 - RNA, 18 nt, Artificial Sequence
  Description of Artificial Sequence: Synthetic oligonucleotide
gcgggcaggcucugccgg

SEQ ID NO: 50447 - RNA, 18 nt, Artificial Sequence
  Description of Artificial Sequence: Synthetic oligonucleotide
ugcuggcgggcaggcucu

SEQ ID NO: 50448 - RNA, 18 nt, Artificial Sequence
  Description of Artificial Sequence: Synthetic oligonucleotide
ggcauugcuggcgggcag

SEQ ID NO: 50449 - RNA, 18 nt, Artificial Sequence
  Description of Artificial Sequence: Synthetic oligonucleotide
acaaaggcauugcuggcg

SEQ ID NO: 50450 - RNA, 18 nt, Artificial Sequence
  Description of Artificial Sequence: Synthetic oligonucleotide
ugaagacaaaggcauugc

SEQ ID NO: 50451 - RNA, 18 nt, Artificial Sequence
  Description of Artificial Sequence: Synthetic oligonucleotide
ggugaugaagacaaaggc

SEQ ID NO: 50452 - RNA, 18 nt, Artificial Sequence
  Description of Artificial Sequence: Synthetic oligonucleotide
cagccggugaugaagaca

SEQ ID NO: 50453 - RNA, 18 nt, Artificial Sequence
  Description of Artificial Sequence: Synthetic oligonucleotide
agucacagccggugauga

SEQ ID NO: 50454 - RNA, 18 nt, Artificial Sequence
  Description of Artificial Sequence: Synthetic oligonucleotide
gccugagucacagccggu

SEQ ID NO: 50455 - RNA, 18 nt, Artificial Sequence
  Description of Artificial Sequence: Synthetic oligonucleotide
ccaaagccugagucacag

SEQ ID NO: 50456 - RNA, 18 nt, Artificial Sequence
  Description of Artificial Sequence: Synthetic oligonucleotide
ggcgcccaaagccugagu

SEQ ID NO: 50457 - RNA, 18 nt, Artificial Sequence
  Description of Artificial Sequence: Synthetic oligonucleotide
cagaaggcgcccaaagcc

SEQ ID NO: 50458 - RNA, 18 nt, Artificial Sequence
  Description of Artificial Sequence: Synthetic oligonucleotide
agugccagaaggcgccca

SEQ ID NO: 50459 - RNA, 18 nt, Artificial Sequence
  Description of Artificial Sequence: Synthetic oligonucleotide
gcugcagugccagaaggc

SEQ ID NO: 50460 - RNA, 18 nt, Artificial Sequence
  Description of Artificial Sequence: Synthetic oligonucleotide
guccagcugcagugccag

SEQ ID NO: 50461 - RNA, 18 nt, Artificial Sequence
  Description of Artificial Sequence: Synthetic oligonucleotide
cucugguccagcugcagu

SEQ ID NO: 50462 - RNA, 18 nt, Artificial Sequence
  Description of Artificial Sequence: Synthetic oligonucleotide
agccucucugguccagcu

SEQ ID NO: 50463 - RNA, 18 nt, Artificial Sequence
  Description of Artificial Sequence: Synthetic oligonucleotide
ucggaagccucucugguc

SEQ ID NO: 50464 - RNA, 18 nt, Artificial Sequence
  Description of Artificial Sequence: Synthetic oligonucleotide
aggacucggaagccucuc

SEQ ID NO: 50465 - RNA, 18 nt, Artificial Sequence
  Description of Artificial Sequence: Synthetic oligonucleotide
uggccaggacucggaagc

SEQ ID NO: 50466 - RNA, 18 nt, Artificial Sequence
  Description of Artificial Sequence: Synthetic oligonucleotide
gcagcuggccaggacucg

SEQ ID NO: 50467 - RNA, 18 nt, Artificial Sequence
  Description of Artificial Sequence: Synthetic oligonucleotide
gucaggcagcuggccagg

SEQ ID NO: 50468 - RNA, 18 nt, Artificial Sequence
  Description of Artificial Sequence: Synthetic oligonucleotide
gggucaggcagcuggcca

SEQ ID NO: 50469 - RNA, 18 nt, Artificial Sequence
  Description of Artificial Sequence: Synthetic oligonucleotide
guccucggccccggaggg

SEQ ID NO: 50470 - RNA, 18 nt, Artificial Sequence
  Description of Artificial Sequence: Synthetic oligonucleotide
ugcagguccucggccccg

SEQ ID NO: 50471 - RNA, 18 nt, Artificial Sequence
  Description of Artificial Sequence: Synthetic oligonucleotide
cccgcugcagguccucgg

SEQ ID NO: 50472 - RNA, 18 nt, Artificial Sequence
  Description of Artificial Sequence: Synthetic oligonucleotide
ggccacccgcugcagguc

SEQ ID NO: 50473 - RNA, 18 nt, Artificial Sequence
  Description of Artificial Sequence: Synthetic oligonucleotide
gaggaggccacccgcugc

SEQ ID NO: 50474 - RNA, 18 nt, Artificial Sequence
  Description of Artificial Sequence: Synthetic oligonucleotide
ggcgggaggaggccaccc

SEQ ID NO: 50475 - RNA, 18 nt, Artificial Sequence
  Description of Artificial Sequence: Synthetic oligonucleotide
guggaggcgggaggaggc

SEQ ID NO: 50476 - RNA, 18 nt, Artificial Sequence
  Description of Artificial Sequence: Synthetic oligonucleotide
gugguguggaggcgggag

SEQ ID NO: 50477 - RNA, 18 nt, Artificial Sequence
  Description of Artificial Sequence: Synthetic oligonucleotide
acagggugguguggaggc

SEQ ID NO: 50478 - RNA, 18 nt, Artificial Sequence
  Description of Artificial Sequence: Synthetic oligonucleotide
auccaacaggguggugug

SEQ ID NO: 50479 - RNA, 18 nt, Artificial Sequence
  Description of Artificial Sequence: Synthetic oligonucleotide
gugauauccaacagggug

SEQ ID NO: 50480 - RNA, 18 nt, Artificial Sequence
  Description of Artificial Sequence: Synthetic oligonucleotide
gaucagugauauccaaca

SEQ ID NO: 50481 - RNA, 18 nt, Artificial Sequence
  Description of Artificial Sequence: Synthetic oligonucleotide
gggaucagugauauccaa

SEQ ID NO: 50482 - RNA, 18 nt, Artificial Sequence
  Description of Artificial Sequence: Synthetic oligonucleotide
ccugcuggacgcucuggg

SEQ ID NO: 50483 - RNA, 18 nt, Artificial Sequence
  Description of Artificial Sequence: Synthetic oligonucleotide
ggcugccugcuggacgcu

SEQ ID NO: 50484 - RNA, 18 nt, Artificial Sequence
  Description of Artificial Sequence: Synthetic oligonucleotide
cacuuggcugccugcugg

SEQ ID NO: 50485 - RNA, 18 nt, Artificial Sequence
  Description of Artificial Sequence: Synthetic oligonucleotide
ccacccacuuggcugccu

SEQ ID NO: 50486 - RNA, 18 nt, Artificial Sequence
  Description of Artificial Sequence: Synthetic oligonucleotide
caucuccacccacuuggc

SEQ ID NO: 50487 - RNA, 18 nt, Artificial Sequence
  Description of Artificial Sequence: Synthetic oligonucleotide
acgugcaucuccacccac

SEQ ID NO: 50488 - RNA, 18 nt, Artificial Sequence
  Description of Artificial Sequence: Synthetic oligonucleotide
ccuuaacgugcaucucca

SEQ ID NO: 50489 - RNA, 18 nt, Artificial Sequence
  Description of Artificial Sequence: Synthetic oligonucleotide
ugcuuccuuaacgugcau

SEQ ID NO: 50490 - RNA, 18 nt, Artificial Sequence
  Description of Artificial Sequence: Synthetic oligonucleotide
aagugaccuacagguggc

SEQ ID NO: 50491 - RNA, 18 nt, Artificial Sequence
  Description of Artificial Sequence: Synthetic oligonucleotide
agcccaagugaccuacag

SEQ ID NO: 50492 - RNA, 18 nt, Artificial Sequence
  Description of Artificial Sequence: Synthetic oligonucleotide
gcuggagcccaagugacc

SEQ ID NO: 50493 - RNA, 18 nt, Artificial Sequence
  Description of Artificial Sequence: Synthetic oligonucleotide
acauagcuggagcccaag

SEQ ID NO: 50494 - RNA, 18 nt, Artificial Sequence
  Description of Artificial Sequence: Synthetic oligonucleotide
cagccacauagcuggagc

SEQ ID NO: 50495 - RNA, 18 nt, Artificial Sequence
  Description of Artificial Sequence: Synthetic oligonucleotide
agaggcagccacauagcu

SEQ ID NO: 50496 - RNA, 18 nt, Artificial Sequence
  Description of Artificial Sequence: Synthetic oligonucleotide
gcagaagaggcagccaca

SEQ ID NO: 50497 - RNA, 18 nt, Artificial Sequence
  Description of Artificial Sequence: Synthetic oligonucleotide
acccagcagaagaggcag

SEQ ID NO: 50498 - RNA, 18 nt, Artificial Sequence
  Description of Artificial Sequence: Synthetic oligonucleotide
aaggcacccagcagaaga

SEQ ID NO: 50499 - RNA, 18 nt, Artificial Sequence
  Description of Artificial Sequence: Synthetic oligonucleotide
agaguaaggcacccagca

SEQ ID NO: 50500 - RNA, 18 nt, Artificial Sequence
  Description of Artificial Sequence: Synthetic oligonucleotide
ugcccagaguaaggcacc

SEQ ID NO: 50501 - RNA, 18 nt, Artificial Sequence
  Description of Artificial Sequence: Synthetic oligonucleotide
agcacugcccagaguaag

SEQ ID NO: 50502 - RNA, 18 nt, Artificial Sequence
  Description of Artificial Sequence: Synthetic oligonucleotide
accacagcacugcccaga

SEQ ID NO: 50503 - RNA, 18 nt, Artificial Sequence
  Description of Artificial Sequence: Synthetic oligonucleotide
gagcaaccacagcacugc

SEQ ID NO: 50504 - RNA, 18 nt, Artificial Sequence
  Description of Artificial Sequence: Synthetic oligonucleotide
ucccugagcaaccacagc

SEQ ID NO: 50505 - RNA, 18 nt, Artificial Sequence
  Description of Artificial Sequence: Synthetic oligonucleotide
gccggucccugagcaacc

SEQ ID NO: 50506 - RNA, 18 nt, Artificial Sequence
  Description of Artificial Sequence: Synthetic oligonucleotide
gcucugccggucccugag

SEQ ID NO: 50507 - RNA, 18 nt, Artificial Sequence
  Description of Artificial Sequence: Synthetic oligonucleotide
ggcaggcucugccggucc

SEQ ID NO: 50508 - RNA, 18 nt, Artificial Sequence
  Description of Artificial Sequence: Synthetic oligonucleotide
uggcgggcaggcucugcc

SEQ ID NO: 50509 - RNA, 18 nt, Artificial Sequence
  Description of Artificial Sequence: Synthetic oligonucleotide
auugcuggcgggcaggcu

SEQ ID NO: 50510 - RNA, 18 nt, Artificial Sequence
  Description of Artificial Sequence: Synthetic oligonucleotide
aaggcauugcuggcgggc

SEQ ID NO: 50511 - RNA, 18 nt, Artificial Sequence
  Description of Artificial Sequence: Synthetic oligonucleotide
agacaaaggcauugcugg

SEQ ID NO: 50512 - RNA, 18 nt, Artificial Sequence
  Description of Artificial Sequence: Synthetic oligonucleotide
gaugaagacaaaggcauu

SEQ ID NO: 50513 - RNA, 18 nt, Artificial Sequence
  Description of Artificial Sequence: Synthetic oligonucleotide
ccggugaugaagacaaag

SEQ ID NO: 50514 - RNA, 18 nt, Artificial Sequence
  Description of Artificial Sequence: Synthetic oligonucleotide
cacagccggugaugaaga

SEQ ID NO: 50515 - RNA, 18 nt, Artificial Sequence
  Description of Artificial Sequence: Synthetic oligonucleotide
ugagucacagccggugau

SEQ ID NO: 50516 - RNA, 18 nt, Artificial Sequence
  Description of Artificial Sequence: Synthetic oligonucleotide
aagccugagucacagccg

SEQ ID NO: 50517 - RNA, 18 nt, Artificial Sequence
  Description of Artificial Sequence: Synthetic oligonucleotide
gcccaaagccugagucac

SEQ ID NO: 50518 - RNA, 18 nt, Artificial Sequence
  Description of Artificial Sequence: Synthetic oligonucleotide
aaggcgcccaaagccuga

SEQ ID NO: 50519 - RNA, 18 nt, Artificial Sequence
  Description of Artificial Sequence: Synthetic oligonucleotide
gccagaaggcgcccaaag

SEQ ID NO: 50520 - RNA, 18 nt, Artificial Sequence
  Description of Artificial Sequence: Synthetic oligonucleotide
gcagugccagaaggcgcc

SEQ ID NO: 50521 - RNA, 18 nt, Artificial Sequence
  Description of Artificial Sequence: Synthetic oligonucleotide
cagcugcagugccagaag

SEQ ID NO: 50522 - RNA, 18 nt, Artificial Sequence
  Description of Artificial Sequence: Synthetic oligonucleotide
ugguccagcugcagugcc

SEQ ID NO: 50523 - RNA, 18 nt, Artificial Sequence
  Description of Artificial Sequence: Synthetic oligonucleotide
cucucugguccagcugca

SEQ ID NO: 50524 - RNA, 18 nt, Artificial Sequence
  Description of Artificial Sequence: Synthetic oligonucleotide
gaagccucucugguccag

SEQ ID NO: 50525 - RNA, 18 nt, Artificial Sequence
  Description of Artificial Sequence: Synthetic oligonucleotide
acucggaagccucucugg

SEQ ID NO: 50526 - RNA, 18 nt, Artificial Sequence
  Description of Artificial Sequence: Synthetic oligonucleotide
ccaggacucggaagccuc

SEQ ID NO: 50527 - RNA, 18 nt, Artificial Sequence
  Description of Artificial Sequence: Synthetic oligonucleotide
gcuggccaggacucggaa

SEQ ID NO: 50528 - RNA, 18 nt, Artificial Sequence
  Description of Artificial Sequence: Synthetic oligonucleotide
aggcagcuggccaggacu

SEQ ID NO: 50529 - RNA, 18 nt, Artificial Sequence
  Description of Artificial Sequence: Synthetic oligonucleotide
gggucaggcagcuggcca

SEQ ID NO: 50530 - RNA, 18 nt, Artificial Sequence
  Description of Artificial Sequence: Synthetic oligonucleotide
guccucggccccggaggg

SEQ ID NO: 50531 - RNA, 18 nt, Artificial Sequence
  Description of Artificial Sequence: Synthetic oligonucleotide
agguccucggccccggag

SEQ ID NO: 50532 - RNA, 18 nt, Artificial Sequence
  Description of Artificial Sequence: Synthetic oligonucleotide
gcugcagguccucggccc

SEQ ID NO: 50533 - RNA, 18 nt, Artificial Sequence
  Description of Artificial Sequence: Synthetic oligonucleotide
cacccgcugcagguccuc

SEQ ID NO: 50534 - RNA, 18 nt, Artificial Sequence
  Description of Artificial Sequence: Synthetic oligonucleotide
gaggccacccgcugcagg

SEQ ID NO: 50535 - RNA, 18 nt, Artificial Sequence
  Description of Artificial Sequence: Synthetic oligonucleotide
gggaggaggccacccgcu

SEQ ID NO: 50536 - RNA, 18 nt, Artificial Sequence
  Description of Artificial Sequence: Synthetic oligonucleotide
gaggcgggaggaggccac

SEQ ID NO: 50537 - RNA, 18 nt, Artificial Sequence
  Description of Artificial Sequence: Synthetic oligonucleotide
guguggaggcgggaggag

SEQ ID NO: 50538 - RNA, 18 nt, Artificial Sequence
  Description of Artificial Sequence: Synthetic oligonucleotide
gggugguguggaggcggg

SEQ ID NO: 50539 - RNA, 18 nt, Artificial Sequence
  Description of Artificial Sequence: Synthetic oligonucleotide
caacagggugguguggag

SEQ ID NO: 50540 - RNA, 18 nt, Artificial Sequence
  Description of Artificial Sequence: Synthetic oligonucleotide
auauccaacaggguggug

SEQ ID NO: 50541 - RNA, 18 nt, Artificial Sequence
  Description of Artificial Sequence: Synthetic oligonucleotide
cagugauauccaacaggg

SEQ ID NO: 50542 - RNA, 18 nt, Artificial Sequence
  Description of Artificial Sequence: Synthetic oligonucleotide
gggaucagugauauccaa

SEQ ID NO: 50543 - RNA, 18 nt, Artificial Sequence
  Description of Artificial Sequence: Synthetic oligonucleotide
ccugcuggacgcucuggg

SEQ ID NO: 50544 - RNA, 18 nt, Artificial Sequence
  Description of Artificial Sequence: Synthetic oligonucleotide
cugccugcuggacgcucu

SEQ ID NO: 50545 - RNA, 18 nt, Artificial Sequence
  Description of Artificial Sequence: Synthetic oligonucleotide
cuuggcugccugcuggac

SEQ ID NO: 50546 - RNA, 18 nt, Artificial Sequence
  Description of Artificial Sequence: Synthetic oligonucleotide
acccacuuggcugccugc

SEQ ID NO: 50547 - RNA, 18 nt, Artificial Sequence
  Description of Artificial Sequence: Synthetic oligonucleotide
ucuccacccacuuggcug

SEQ ID NO: 50548 - RNA, 18 nt, Artificial Sequence
  Description of Artificial Sequence: Synthetic oligonucleotide
gugcaucuccacccacuu

SEQ ID NO: 50549 - RNA, 18 nt, Artificial Sequence
  Description of Artificial Sequence: Synthetic oligonucleotide
uuaacgugcaucuccacc

SEQ ID NO: 50550 - RNA, 18 nt, Artificial Sequence
  Description of Artificial Sequence: Synthetic oligonucleotide
cuuccuuaacgugcaucu

SEQ ID NO: 50551 - RNA, 18 nt, Artificial Sequence
  Description of Artificial Sequence: Synthetic oligonucleotide
uccugguggucuaccaua

SEQ ID NO: 50552 - RNA, 18 nt, Artificial Sequence
  Description of Artificial Sequence: Synthetic oligonucleotide
cauauuccugguggucua

SEQ ID NO: 50553 - RNA, 18 nt, Artificial Sequence
  Description of Artificial Sequence: Synthetic oligonucleotide
cacaccauauuccuggug

SEQ ID NO: 50554 - RNA, 18 nt, Artificial Sequence
  Description of Artificial Sequence: Synthetic oligonucleotide
caccccacaccauauucc

SEQ ID NO: 50555 - RNA, 18 nt, Artificial Sequence
  Description of Artificial Sequence: Synthetic oligonucleotide
caggacaccccacaccau

SEQ ID NO: 50556 - RNA, 18 nt, Artificial Sequence
  Description of Artificial Sequence: Synthetic oligonucleotide
gggaucaggacaccccac

SEQ ID NO: 50557 - RNA, 18 nt, Artificial Sequence
  Description of Artificial Sequence: Synthetic oligonucleotide
cccuugcaggugacuccu

SEQ ID NO: 50558 - RNA, 18 nt, Artificial Sequence
  Description of Artificial Sequence: Synthetic oligonucleotide
cacagcccuugcagguga

SEQ ID NO: 50559 - RNA, 18 nt, Artificial Sequence
  Description of Artificial Sequence: Synthetic oligonucleotide
cuuaccacagcccuugca

SEQ ID NO: 50560 - RNA, 18 nt, Artificial Sequence
  Description of Artificial Sequence: Synthetic oligonucleotide
uuuagcuuaccacagccc

SEQ ID NO: 50561 - RNA, 18 nt, Artificial Sequence
  Description of Artificial Sequence: Synthetic oligonucleotide
gucccuuuagcuuaccac

SEQ ID NO: 50562 - RNA, 18 nt, Artificial Sequence
  Description of Artificial Sequence: Synthetic oligonucleotide
aaauugucccuuuagcuu

SEQ ID NO: 50563 - RNA, 18 nt, Artificial Sequence
  Description of Artificial Sequence: Synthetic oligonucleotide
uccucaaauugucccuuu

SEQ ID NO: 50564 - RNA, 18 nt, Artificial Sequence
  Description of Artificial Sequence: Synthetic oligonucleotide
gcuucuccucaaauuguc

SEQ ID NO: 50565 - RNA, 18 nt, Artificial Sequence
  Description of Artificial Sequence: Synthetic oligonucleotide
aaacugcuucuccucaaa

SEQ ID NO: 50566 - RNA, 18 nt, Artificial Sequence
  Description of Artificial Sequence: Synthetic oligonucleotide
ucugaaaacugcuucucc

SEQ ID NO: 50567 - RNA, 18 nt, Artificial Sequence
  Description of Artificial Sequence: Synthetic oligonucleotide
gagcaucugaaaacugcu

SEQ ID NO: 50568 - RNA, 18 nt, Artificial Sequence
  Description of Artificial Sequence: Synthetic oligonucleotide
ccacagcccuugcaggug

SEQ ID NO: 50569 - RNA, 18 nt, Artificial Sequence
  Description of Artificial Sequence: Synthetic oligonucleotide
gcuuaccacagcccuugc

SEQ ID NO: 50570 - RNA, 18 nt, Artificial Sequence
  Description of Artificial Sequence: Synthetic oligonucleotide
cuuuagcuuaccacagcc

SEQ ID NO: 50571 - RNA, 18 nt, Artificial Sequence
  Description of Artificial Sequence: Synthetic oligonucleotide
ugucccuuuagcuuacca

SEQ ID NO: 50572 - RNA, 18 nt, Artificial Sequence
  Description of Artificial Sequence: Synthetic oligonucleotide
caaauugucccuuuagcu

SEQ ID NO: 50573 - RNA, 18 nt, Artificial Sequence
  Description of Artificial Sequence: Synthetic oligonucleotide
cuccucaaauugucccuu

SEQ ID NO: 50574 - RNA, 18 nt, Artificial Sequence
  Description of Artificial Sequence: Synthetic oligonucleotide
ugcuucuccucaaauugu

SEQ ID NO: 50575 - RNA, 18 nt, Artificial Sequence
  Description of Artificial Sequence: Synthetic oligonucleotide
aaaacugcuucuccucaa

SEQ ID NO: 50576 - RNA, 18 nt, Artificial Sequence
  Description of Artificial Sequence: Synthetic oligonucleotide
aucugaaaacugcuucuc

SEQ ID NO: 50577 - RNA, 18 nt, Artificial Sequence
  Description of Artificial Sequence: Synthetic oligonucleotide
ggagcaucugaaaacugc

SEQ ID NO: 50578 - RNA, 18 nt, Artificial Sequence
  Description of Artificial Sequence: Synthetic oligonucleotide
uccugggagcaucugaaa

SEQ ID NO: 50579 - RNA, 18 nt, Artificial Sequence
  Description of Artificial Sequence: Synthetic oligonucleotide
cuucuuccugggagcauc

SEQ ID NO: 50580 - RNA, 18 nt, Artificial Sequence
  Description of Artificial Sequence: Synthetic oligonucleotide
ucccucuucuuccuggga

SEQ ID NO: 50581 - RNA, 18 nt, Artificial Sequence
  Description of Artificial Sequence: Synthetic oligonucleotide
acagcucccucuucuucc

SEQ ID NO: 50582 - RNA, 18 nt, Artificial Sequence
  Description of Artificial Sequence: Synthetic oligonucleotide
cucccacagcucccucuu

SEQ ID NO: 50583 - RNA, 18 nt, Artificial Sequence
  Description of Artificial Sequence: Synthetic oligonucleotide
aggcacucccacagcucc

SEQ ID NO: 50584 - RNA, 18 nt, Artificial Sequence
  Description of Artificial Sequence: Synthetic oligonucleotide
aggugaggcacucccaca

SEQ ID NO: 50585 - RNA, 18 nt, Artificial Sequence
  Description of Artificial Sequence: Synthetic oligonucleotide
uucaccagaccaaaaagc

SEQ ID NO: 50586 - RNA, 18 nt, Artificial Sequence
  Description of Artificial Sequence: Synthetic oligonucleotide
cauuauucaccagaccaa

SEQ ID NO: 50587 - RNA, 18 nt, Artificial Sequence
  Description of Artificial Sequence: Synthetic oligonucleotide
accagcauuauucaccag

SEQ ID NO: 50588 - RNA, 18 nt, Artificial Sequence
  Description of Artificial Sequence: Synthetic oligonucleotide
gccacaccagcauuauuc

SEQ ID NO: 50589 - RNA, 18 nt, Artificial Sequence
  Description of Artificial Sequence: Synthetic oligonucleotide
uaccagccacaccagcau

SEQ ID NO: 50590 - RNA, 18 nt, Artificial Sequence
  Description of Artificial Sequence: Synthetic oligonucleotide
gaugauaccagccacacc

SEQ ID NO: 50591 - RNA, 18 nt, Artificial Sequence
  Description of Artificial Sequence: Synthetic oligonucleotide
gguccgaugauaccagcc

SEQ ID NO: 50592 - RNA, 18 nt, Artificial Sequence
  Description of Artificial Sequence: Synthetic oligonucleotide
guguggguccgaugauac

SEQ ID NO: 50593 - RNA, 18 nt, Artificial Sequence
  Description of Artificial Sequence: Synthetic oligonucleotide
ccaugguguggguccgau

SEQ ID NO: 50594 - RNA, 18 nt, Artificial Sequence
  Description of Artificial Sequence: Synthetic oligonucleotide
gucagccauggugugggu

SEQ ID NO: 50595 - RNA, 18 nt, Artificial Sequence
  Description of Artificial Sequence: Synthetic oligonucleotide
cccgggucagccauggug

SEQ ID NO: 50596 - RNA, 18 nt, Artificial Sequence
  Description of Artificial Sequence: Synthetic oligonucleotide
aucgucccgggucagcca

SEQ ID NO: 50597 - RNA, 18 nt, Artificial Sequence
  Description of Artificial Sequence: Synthetic oligonucleotide
uggaaaucgucccggguc

SEQ ID NO: 50598 - RNA, 18 nt, Artificial Sequence
  Description of Artificial Sequence: Synthetic oligonucleotide
cccgcuggaaaucguccc

SEQ ID NO: 50599 - RNA, 18 nt, Artificial Sequence
  Description of Artificial Sequence: Synthetic oligonucleotide
cagcacccgcuggaaauc

SEQ ID NO: 50600 - RNA, 18 nt, Artificial Sequence
  Description of Artificial Sequence: Synthetic oligonucleotide
acauucagcacccgcugg

SEQ ID NO: 50601 - RNA, 18 nt, Artificial Sequence
  Description of Artificial Sequence: Synthetic oligonucleotide
uguucacauucagcaccc

SEQ ID NO: 50602 - RNA, 18 nt, Artificial Sequence
  Description of Artificial Sequence: Synthetic oligonucleotide
cauuguguucacauucag

SEQ ID NO: 50603 - RNA, 18 nt, Artificial Sequence
  Description of Artificial Sequence: Synthetic oligonucleotide
ggacccauuguguucaca

SEQ ID NO: 50604 - RNA, 18 nt, Artificial Sequence
  Description of Artificial Sequence: Synthetic oligonucleotide
cgaugggacccauugugu

SEQ ID NO: 50605 - RNA, 18 nt, Artificial Sequence
  Description of Artificial Sequence: Synthetic oligonucleotide
gaccccgaugggacccau

SEQ ID NO: 50606 - RNA, 18 nt, Artificial Sequence
  Description of Artificial Sequence: Synthetic oligonucleotide
agggugaccccgauggga

SEQ ID NO: 50607 - RNA, 18 nt, Artificial Sequence
  Description of Artificial Sequence: Synthetic oligonucleotide
gggcaagggugaccccga

SEQ ID NO: 50608 - RNA, 18 nt, Artificial Sequence
  Description of Artificial Sequence: Synthetic oligonucleotide
cagcagggcaagggugac

SEQ ID NO: 50609 - RNA, 18 nt, Artificial Sequence
  Description of Artificial Sequence: Synthetic oligonucleotide
agaggcagcagggcaagg

SEQ ID NO: 50610 - RNA, 18 nt, Artificial Sequence
  Description of Artificial Sequence: Synthetic oligonucleotide
gcagcagaggcagcaggg

SEQ ID NO: 50611 - RNA, 18 nt, Artificial Sequence
  Description of Artificial Sequence: Synthetic oligonucleotide
uugcugcagcagaggcag

SEQ ID NO: 50612 - RNA, 18 nt, Artificial Sequence
  Description of Artificial Sequence: Synthetic oligonucleotide
cgggcuugcugcagcaga

SEQ ID NO: 50613 - RNA, 18 nt, Artificial Sequence
  Description of Artificial Sequence: Synthetic oligonucleotide
ggccccgggcuugcugca

SEQ ID NO: 50614 - RNA, 18 nt, Artificial Sequence
  Description of Artificial Sequence: Synthetic oligonucleotide
cacccggccccgggcuug

SEQ ID NO: 50615 - RNA, 18 nt, Artificial Sequence
  Description of Artificial Sequence: Synthetic oligonucleotide
uugaucacccggccccgg

SEQ ID NO: 50616 - RNA, 18 nt, Artificial Sequence
  Description of Artificial Sequence: Synthetic oligonucleotide
ugauguugaucacccggc

SEQ ID NO: 50617 - RNA, 18 nt, Artificial Sequence
  Description of Artificial Sequence: Synthetic oligonucleotide
gcuggugauguugaucac

SEQ ID NO: 50618 - RNA, 18 nt, Artificial Sequence
  Description of Artificial Sequence: Synthetic oligonucleotide
aggacgcuggugauguug

SEQ ID NO: 50619 - RNA, 18 nt, Artificial Sequence
  Description of Artificial Sequence: Synthetic oligonucleotide
gacccaggacgcugguga

SEQ ID NO: 50620 - RNA, 18 nt, Artificial Sequence
  Description of Artificial Sequence: Synthetic oligonucleotide
caggcgacccaggacgcu

SEQ ID NO: 50621 - RNA, 18 nt, Artificial Sequence
  Description of Artificial Sequence: Synthetic oligonucleotide
gcugccaggcgacccagg

SEQ ID NO: 50622 - RNA, 18 nt, Artificial Sequence
  Description of Artificial Sequence: Synthetic oligonucleotide
cauuggcugccaggcgac

SEQ ID NO: 50623 - RNA, 18 nt, Artificial Sequence
  Description of Artificial Sequence: Synthetic oligonucleotide
cccaccauuggcugccag

SEQ ID NO: 50624 - RNA, 18 nt, Artificial Sequence
  Description of Artificial Sequence: Synthetic oligonucleotide
uagcccccaccauuggcu

SEQ ID NO: 50625 - RNA, 18 nt, Artificial Sequence
  Description of Artificial Sequence: Synthetic oligonucleotide
cacaguagcccccaccau

SEQ ID NO: 50626 - RNA, 18 nt, Artificial Sequence
  Description of Artificial Sequence: Synthetic oligonucleotide
ggagacacaguagccccc

SEQ ID NO: 50627 - RNA, 18 nt, Artificial Sequence
  Description of Artificial Sequence: Synthetic oligonucleotide
aauuuggagacacaguag

SEQ ID NO: 50628 - RNA, 18 nt, Artificial Sequence
  Description of Artificial Sequence: Synthetic oligonucleotide
ggccaaauuuggagacac

SEQ ID NO: 50629 - RNA, 18 nt, Artificial Sequence
  Description of Artificial Sequence: Synthetic oligonucleotide
cuccaggccaaauuugga

SEQ ID NO: 50630 - RNA, 18 nt, Artificial Sequence
  Description of Artificial Sequence: Synthetic oligonucleotide
aaggccuccaggccaaau

SEQ ID NO: 50631 - RNA, 18 nt, Artificial Sequence
  Description of Artificial Sequence: Synthetic oligonucleotide
cagagaaggccuccaggc

SEQ ID NO: 50632 - RNA, 18 nt, Artificial Sequence
  Description of Artificial Sequence: Synthetic oligonucleotide
gcugucagagaaggccuc

SEQ ID NO: 50633 - RNA, 18 nt, Artificial Sequence
  Description of Artificial Sequence: Synthetic oligonucleotide
cucaggcugucagagaag

SEQ ID NO: 50634 - RNA, 18 nt, Artificial Sequence
  Description of Artificial Sequence: Synthetic oligonucleotide
uuggaugccaggcguauu

SEQ ID NO: 50635 - RNA, 18 nt, Artificial Sequence
  Description of Artificial Sequence: Synthetic oligonucleotide
uggacuuggaugccaggc

SEQ ID NO: 50636 - RNA, 18 nt, Artificial Sequence
  Description of Artificial Sequence: Synthetic oligonucleotide
guggguggacuuggaugc

SEQ ID NO: 50637 - RNA, 18 nt, Artificial Sequence
  Description of Artificial Sequence: Synthetic oligonucleotide
ccggaguggguggacuug

SEQ ID NO: 50638 - RNA, 18 nt, Artificial Sequence
  Description of Artificial Sequence: Synthetic oligonucleotide
aaaguccggagugggugg

SEQ ID NO: 50639 - RNA, 18 nt, Artificial Sequence
  Description of Artificial Sequence: Synthetic oligonucleotide
aggccaaaguccggagug

SEQ ID NO: 50640 - RNA, 18 nt, Artificial Sequence
  Description of Artificial Sequence: Synthetic oligonucleotide
ugcuaaggccaaaguccg

SEQ ID NO: 50641 - RNA, 18 nt, Artificial Sequence
  Description of Artificial Sequence: Synthetic oligonucleotide
acuacugcuaaggccaaa

SEQ ID NO: 50642 - RNA, 18 nt, Artificial Sequence
  Description of Artificial Sequence: Synthetic oligonucleotide
cacuaacuacugcuaagg

SEQ ID NO: 50643 - RNA, 18 nt, Artificial Sequence
  Description of Artificial Sequence: Synthetic oligonucleotide
ucccacacuaacuacugc

SEQ ID NO: 50644 - RNA, 18 nt, Artificial Sequence
  Description of Artificial Sequence: Synthetic oligonucleotide
cagccucccacacuaacu

SEQ ID NO: 50645 - RNA, 18 nt, Artificial Sequence
  Description of Artificial Sequence: Synthetic oligonucleotide
cuucccagccucccacac

SEQ ID NO: 50646 - RNA, 18 nt, Artificial Sequence
  Description of Artificial Sequence: Synthetic oligonucleotide
ccagucuucccagccucc

SEQ ID NO: 50647 - RNA, 18 nt, Artificial Sequence
  Description of Artificial Sequence: Synthetic oligonucleotide
ugcucccagucuucccag

SEQ ID NO: 50648 - RNA, 18 nt, Artificial Sequence
  Description of Artificial Sequence: Synthetic oligonucleotide
gagacugcucccagucuu

SEQ ID NO: 50649 - RNA, 18 nt, Artificial Sequence
  Description of Artificial Sequence: Synthetic oligonucleotide
uuuaagagacugcuccca

SEQ ID NO: 50650 - RNA, 18 nt, Artificial Sequence
  Description of Artificial Sequence: Synthetic oligonucleotide
uuuuguuuaagagacugc

SEQ ID NO: 50651 - RNA, 18 nt, Artificial Sequence
  Description of Artificial Sequence: Synthetic oligonucleotide
uuugcuuuuguuuaagag

SEQ ID NO: 50652 - RNA, 18 nt, Artificial Sequence
  Description of Artificial Sequence: Synthetic oligonucleotide
auucuuuugcuuuuguuu

SEQ ID NO: 50653 - RNA, 18 nt, Artificial Sequence
  Description of Artificial Sequence: Synthetic oligonucleotide
agcuuauucuuuugcuuu

SEQ ID NO: 50654 - RNA, 18 nt, Artificial Sequence
  Description of Artificial Sequence: Synthetic oligonucleotide
cccgaagcuuauucuuuu

SEQ ID NO: 50655 - RNA, 18 nt, Artificial Sequence
  Description of Artificial Sequence: Synthetic oligonucleotide
cagcgcccgaagcuuauu

SEQ ID NO: 50656 - RNA, 18 nt, Artificial Sequence
  Description of Artificial Sequence: Synthetic oligonucleotide
uacuacagcgcccgaagc

SEQ ID NO: 50657 - RNA, 18 nt, Artificial Sequence
  Description of Artificial Sequence: Synthetic oligonucleotide
gcagguacuacagcgccc

SEQ ID NO: 50658 - RNA, 18 nt, Artificial Sequence
  Description of Artificial Sequence: Synthetic oligonucleotide
agcuggcagguacuacag

SEQ ID NO: 50659 - RNA, 18 nt, Artificial Sequence
  Description of Artificial Sequence: Synthetic oligonucleotide
gcgaaagcuggcagguac

SEQ ID NO: 50660 - RNA, 18 nt, Artificial Sequence
  Description of Artificial Sequence: Synthetic oligonucleotide
cuguggcgaaagcuggca

SEQ ID NO: 50661 - RNA, 18 nt, Artificial Sequence
  Description of Artificial Sequence: Synthetic oligonucleotide
cccagcucccaguaucca

SEQ ID NO: 50662 - RNA, 18 nt, Artificial Sequence
  Description of Artificial Sequence: Synthetic oligonucleotide
guucccccagcucccagu

SEQ ID NO: 50663 - RNA, 18 nt, Artificial Sequence
  Description of Artificial Sequence: Synthetic oligonucleotide
ucucaguucccccagcuc

SEQ ID NO: 50664 - RNA, 18 nt, Artificial Sequence
  Description of Artificial Sequence: Synthetic oligonucleotide
agucuucucaguuccccc

SEQ ID NO: 50665 - RNA, 18 nt, Artificial Sequence
  Description of Artificial Sequence: Synthetic oligonucleotide
uggcuagucuucucaguu

SEQ ID NO: 50666 - RNA, 18 nt, Artificial Sequence
  Description of Artificial Sequence: Synthetic oligonucleotide
auaucuggcuagucuucu

SEQ ID NO: 50667 - RNA, 18 nt, Artificial Sequence
  Description of Artificial Sequence: Synthetic oligonucleotide
auguaauaucuggcuagu

SEQ ID NO: 50668 - RNA, 18 nt, Artificial Sequence
  Description of Artificial Sequence: Synthetic oligonucleotide
aauacauguaauaucugg

SEQ ID NO: 50669 - RNA, 18 nt, Artificial Sequence
  Description of Artificial Sequence: Synthetic oligonucleotide
uuggcaauacauguaaua

SEQ ID NO: 50670 - RNA, 18 nt, Artificial Sequence
  Description of Artificial Sequence: Synthetic oligonucleotide
uugaguuggcaauacaug

SEQ ID NO: 50671 - RNA, 18 nt, Artificial Sequence
  Description of Artificial Sequence: Synthetic oligonucleotide
aaguuuugaguuggcaau

SEQ ID NO: 50672 - RNA, 18 nt, Artificial Sequence
  Description of Artificial Sequence: Synthetic oligonucleotide
gcugaaaguuuugaguug

SEQ ID NO: 50673 - RNA, 18 nt, Artificial Sequence
  Description of Artificial Sequence: Synthetic oligonucleotide
uaaaagcugaaaguuuug

SEQ ID NO: 50674 - RNA, 18 nt, Artificial Sequence
  Description of Artificial Sequence: Synthetic oligonucleotide
cauguuaaaagcugaaag

SEQ ID NO: 50675 - RNA, 18 nt, Artificial Sequence
  Description of Artificial Sequence: Synthetic oligonucleotide
ggaagcauguuaaaagcu

SEQ ID NO: 50676 - RNA, 18 nt, Artificial Sequence
  Description of Artificial Sequence: Synthetic oligonucleotide
ugugaggaagcauguuaa

SEQ ID NO: 50677 - RNA, 18 nt, Artificial Sequence
  Description of Artificial Sequence: Synthetic oligonucleotide
uaaugugugaggaagcau

SEQ ID NO: 50678 - RNA, 18 nt, Artificial Sequence
  Description of Artificial Sequence: Synthetic oligonucleotide
gggauaaugugugaggaa

SEQ ID NO: 50679 - RNA, 18 nt, Artificial Sequence
  Description of Artificial Sequence: Synthetic oligonucleotide
uuguggaggaucaaaggg

SEQ ID NO: 50680 - RNA, 18 nt, Artificial Sequence
  Description of Artificial Sequence: Synthetic oligonucleotide
cagaguuguggaggauca

SEQ ID NO: 50681 - RNA, 18 nt, Artificial Sequence
  Description of Artificial Sequence: Synthetic oligonucleotide
caccucagaguuguggag

SEQ ID NO: 50682 - RNA, 18 nt, Artificial Sequence
  Description of Artificial Sequence: Synthetic oligonucleotide
agguccaccucagaguug

SEQ ID NO: 50683 - RNA, 18 nt, Artificial Sequence
  Description of Artificial Sequence: Synthetic oligonucleotide
ccaccagguccaccucag

SEQ ID NO: 50684 - RNA, 18 nt, Artificial Sequence
  Description of Artificial Sequence: Synthetic oligonucleotide
aagacccaccagguccac

SEQ ID NO: 50685 - RNA, 18 nt, Artificial Sequence
  Description of Artificial Sequence: Synthetic oligonucleotide
gggcuaagacccaccagg

SEQ ID NO: 50686 - RNA, 18 nt, Artificial Sequence
  Description of Artificial Sequence: Synthetic oligonucleotide
auuuucucaucuaccaag

SEQ ID NO: 50687 - RNA, 18 nt, Artificial Sequence
  Description of Artificial Sequence: Synthetic oligonucleotide
aaccuauuuucucaucua

SEQ ID NO: 50688 - RNA, 18 nt, Artificial Sequence
  Description of Artificial Sequence: Synthetic oligonucleotide
cucucaaccuauuuucuc

SEQ ID NO: 50689 - RNA, 18 nt, Artificial Sequence
  Description of Artificial Sequence: Synthetic oligonucleotide
ugucucucucaaccuauu

SEQ ID NO: 50690 - RNA, 18 nt, Artificial Sequence
  Description of Artificial Sequence: Synthetic oligonucleotide
cucacugucucucucaac

SEQ ID NO: 50691 - RNA, 18 nt, Artificial Sequence
  Description of Artificial Sequence: Synthetic oligonucleotide
agcaucucacugucucuc

SEQ ID NO: 50692 - RNA, 18 nt, Artificial Sequence
  Description of Artificial Sequence: Synthetic oligonucleotide
uacugagcaucucacugu

SEQ ID NO: 50693 - RNA, 18 nt, Artificial Sequence
  Description of Artificial Sequence: Synthetic oligonucleotide
ugugauacugagcaucuc

SEQ ID NO: 50694 - RNA, 18 nt, Artificial Sequence
  Description of Artificial Sequence: Synthetic oligonucleotide
ugcugugugauacugagc

SEQ ID NO: 50695 - RNA, 18 nt, Artificial Sequence
  Description of Artificial Sequence: Synthetic oligonucleotide
agguuugcugugugauac

SEQ ID NO: 50696 - RNA, 18 nt, Artificial Sequence
  Description of Artificial Sequence: Synthetic oligonucleotide
ccaagagguuugcugugu

SEQ ID NO: 50697 - RNA, 18 nt, Artificial Sequence
  Description of Artificial Sequence: Synthetic oligonucleotide
uagggccaagagguuugc

SEQ ID NO: 50698 - RNA, 18 nt, Artificial Sequence
  Description of Artificial Sequence: Synthetic oligonucleotide
auguauagggccaagagg

SEQ ID NO: 50699 - RNA, 18 nt, Artificial Sequence
  Description of Artificial Sequence: Synthetic oligonucleotide
gaaugauguauagggcca

SEQ ID NO: 50700 - RNA, 18 nt, Artificial Sequence
  Description of Artificial Sequence: Synthetic oligonucleotide
guuuggaaugauguauag

SEQ ID NO: 50701 - RNA, 18 nt, Artificial Sequence
  Description of Artificial Sequence: Synthetic oligonucleotide
cuuguguuuggaaugaug

SEQ ID NO: 50702 - RNA, 18 nt, Artificial Sequence
  Description of Artificial Sequence: Synthetic oligonucleotide
ugggucuuguguuuggaa

SEQ ID NO: 50703 - RNA, 18 nt, Artificial Sequence
  Description of Artificial Sequence: Synthetic oligonucleotide
caaccugggucuuguguu

SEQ ID NO: 50704 - RNA, 18 nt, Artificial Sequence
  Description of Artificial Sequence: Synthetic oligonucleotide
auaugcaaccugggucuu

SEQ ID NO: 50705 - RNA, 18 nt, Artificial Sequence
  Description of Artificial Sequence: Synthetic oligonucleotide
cuucuauaugcaaccugg

SEQ ID NO: 50706 - RNA, 18 nt, Artificial Sequence
  Description of Artificial Sequence: Synthetic oligonucleotide
ugaaccuucuauaugcaa

SEQ ID NO: 50707 - RNA, 18 nt, Artificial Sequence
  Description of Artificial Sequence: Synthetic oligonucleotide
gacacugaaccuucuaua

SEQ ID NO: 50708 - RNA, 18 nt, Artificial Sequence
  Description of Artificial Sequence: Synthetic oligonucleotide
ccagggacacugaaccuu

SEQ ID NO: 50709 - RNA, 18 nt, Artificial Sequence
  Description of Artificial Sequence: Synthetic oligonucleotide
cuaaaccagggacacuga

SEQ ID NO: 50710 - RNA, 18 nt, Artificial Sequence
  Description of Artificial Sequence: Synthetic oligonucleotide
uccuucuaaaccagggac

SEQ ID NO: 50711 - RNA, 18 nt, Artificial Sequence
  Description of Artificial Sequence: Synthetic oligonucleotide
accucuccuucuaaacca

SEQ ID NO: 50712 - RNA, 18 nt, Artificial Sequence
  Description of Artificial Sequence: Synthetic oligonucleotide
acaccaccucuccuucua

SEQ ID NO: 50713 - RNA, 18 nt, Artificial Sequence
  Description of Artificial Sequence: Synthetic oligonucleotide
gccucacaccaccucucc

SEQ ID NO: 50714 - RNA, 18 nt, Artificial Sequence
  Description of Artificial Sequence: Synthetic oligonucleotide
ugcuugccucacaccacc

SEQ ID NO: 50715 - RNA, 18 nt, Artificial Sequence
  Description of Artificial Sequence: Synthetic oligonucleotide
cuucuugcuugccucaca

SEQ ID NO: 50716 - RNA, 18 nt, Artificial Sequence
  Description of Artificial Sequence: Synthetic oligonucleotide
ggcaucuucuugcuugcc

SEQ ID NO: 50717 - RNA, 18 nt, Artificial Sequence
  Description of Artificial Sequence: Synthetic oligonucleotide
gcagaggcaucuucuugc

SEQ ID NO: 50718 - RNA, 18 nt, Artificial Sequence
  Description of Artificial Sequence: Synthetic oligonucleotide
gugcagcagaggcaucuu

SEQ ID NO: 50719 - RNA, 18 nt, Artificial Sequence
  Description of Artificial Sequence: Synthetic oligonucleotide
cuggagugcagcagaggc

SEQ ID NO: 50720 - RNA, 18 nt, Artificial Sequence
  Description of Artificial Sequence: Synthetic oligonucleotide
ccaggcuggagugcagca

SEQ ID NO: 50721 - RNA, 18 nt, Artificial Sequence
  Description of Artificial Sequence: Synthetic oligonucleotide
ucacaccaccucuccuuc

SEQ ID NO: 50722 - RNA, 18 nt, Artificial Sequence
  Description of Artificial Sequence: Synthetic oligonucleotide
uugccucacaccaccucu

SEQ ID NO: 50723 - RNA, 18 nt, Artificial Sequence
  Description of Artificial Sequence: Synthetic oligonucleotide
cuugcuugccucacacca

SEQ ID NO: 50724 - RNA, 18 nt, Artificial Sequence
  Description of Artificial Sequence: Synthetic oligonucleotide
aucuucuugcuugccuca

SEQ ID NO: 50725 - RNA, 18 nt, Artificial Sequence
  Description of Artificial Sequence: Synthetic oligonucleotide
gaggcaucuucuugcuug

SEQ ID NO: 50726 - RNA, 18 nt, Artificial Sequence
  Description of Artificial Sequence: Synthetic oligonucleotide
cagcagaggcaucuucuu

SEQ ID NO: 50727 - RNA, 18 nt, Artificial Sequence
  Description of Artificial Sequence: Synthetic oligonucleotide
gagugcagcagaggcauc

SEQ ID NO: 50728 - RNA, 18 nt, Artificial Sequence
  Description of Artificial Sequence: Synthetic oligonucleotide
ggcuggagugcagcagag

SEQ ID NO: 50729 - RNA, 18 nt, Artificial Sequence
  Description of Artificial Sequence: Synthetic oligonucleotide
gcccaggcuggagugcag

SEQ ID NO: 50730 - RNA, 18 nt, Artificial Sequence
  Description of Artificial Sequence: Synthetic oligonucleotide
cugucgcccaggcuggag

SEQ ID NO: 50731 - RNA, 18 nt, Artificial Sequence
  Description of Artificial Sequence: Synthetic oligonucleotide
ucacucugucgcccaggc

SEQ ID NO: 50732 - RNA, 18 nt, Artificial Sequence
  Description of Artificial Sequence: Synthetic oligonucleotide
gagucucacucugucgcc

SEQ ID NO: 50733 - RNA, 18 nt, Artificial Sequence
  Description of Artificial Sequence: Synthetic oligonucleotide
agauggagucucacucug

SEQ ID NO: 50734 - RNA, 18 nt, Artificial Sequence
  Description of Artificial Sequence: Synthetic oligonucleotide
uuuugagauggagucuca

SEQ ID NO: 50735 - RNA, 18 nt, Artificial Sequence
  Description of Artificial Sequence: Synthetic oligonucleotide
uuuuuuuuugagauggag

SEQ ID NO: 50736 - RNA, 18 nt, Artificial Sequence
  Description of Artificial Sequence: Synthetic oligonucleotide
uuuuuuuuuuuuuugaga

SEQ ID NO: 50737 - RNA, 18 nt, Artificial Sequence
  Description of Artificial Sequence: Synthetic oligonucleotide
uuuuuuuuuuuuuuuuuu

SEQ ID NO: 50738 - RNA, 18 nt, Artificial Sequence
  Description of Artificial Sequence: Synthetic oligonucleotide
cuuuuuuuuuuuuuuuuu

SEQ ID NO: 50739 - RNA, 18 nt, Artificial Sequence
  Description of Artificial Sequence: Synthetic oligonucleotide
ggcaucuuuuuuuuuuuu

SEQ ID NO: 50740 - RNA, 18 nt, Artificial Sequence
  Description of Artificial Sequence: Synthetic oligonucleotide
gcagaggcaucuuuuuuu

SEQ ID NO: 50741 - RNA, 18 nt, Artificial Sequence
  Description of Artificial Sequence: Synthetic oligonucleotide
auggagcagaggcaucuu

SEQ ID NO: 50742 - RNA, 18 nt, Artificial Sequence
  Description of Artificial Sequence: Synthetic oligonucleotide
gcuguauggagcagaggc

SEQ ID NO: 50743 - RNA, 18 nt, Artificial Sequence
  Description of Artificial Sequence: Synthetic oligonucleotide
gaccugcuguauggagca

SEQ ID NO: 50744 - RNA, 18 nt, Artificial Sequence
  Description of Artificial Sequence: Synthetic oligonucleotide
guacagaccugcuguaug

SEQ ID NO: 50745 - RNA, 18 nt, Artificial Sequence
  Description of Artificial Sequence: Synthetic oligonucleotide
ccuguguacagaccugcu

SEQ ID NO: 50746 - RNA, 18 nt, Artificial Sequence
  Description of Artificial Sequence: Synthetic oligonucleotide
cagauccuguguacagac

SEQ ID NO: 50747 - RNA, 18 nt, Artificial Sequence
  Description of Artificial Sequence: Synthetic oligonucleotide
ugagccagauccugugua

SEQ ID NO: 50748 - RNA, 18 nt, Artificial Sequence
  Description of Artificial Sequence: Synthetic oligonucleotide
ccacaugagccagauccu

SEQ ID NO: 50749 - RNA, 18 nt, Artificial Sequence
  Description of Artificial Sequence: Synthetic oligonucleotide
uaaaaccacaugagccag

SEQ ID NO: 50750 - RNA, 18 nt, Artificial Sequence
  Description of Artificial Sequence: Synthetic oligonucleotide
uuaacuaaaaccacauga

SEQ ID NO: 50751 - RNA, 18 nt, Artificial Sequence
  Description of Artificial Sequence: Synthetic oligonucleotide
cuaacuuaacuaaaacca

SEQ ID NO: 50752 - RNA, 18 nt, Artificial Sequence
  Description of Artificial Sequence: Synthetic oligonucleotide
uguggcuaacuuaacuaa

SEQ ID NO: 50753 - RNA, 18 nt, Artificial Sequence
  Description of Artificial Sequence: Synthetic oligonucleotide
guauuuguggcuaacuua

SEQ ID NO: 50754 - RNA, 18 nt, Artificial Sequence
  Description of Artificial Sequence: Synthetic oligonucleotide
acccuguauuuguggcua

SEQ ID NO: 50755 - RNA, 18 nt, Artificial Sequence
  Description of Artificial Sequence: Synthetic oligonucleotide
ggcagacccuguauuugu

SEQ ID NO: 50756 - RNA, 18 nt, Artificial Sequence
  Description of Artificial Sequence: Synthetic oligonucleotide
augugggcagacccugua

SEQ ID NO: 50757 - RNA, 18 nt, Artificial Sequence
  Description of Artificial Sequence: Synthetic oligonucleotide
caaagaugugggcagacc

SEQ ID NO: 50758 - RNA, 18 nt, Artificial Sequence
  Description of Artificial Sequence: Synthetic oligonucleotide
caaagcaaagaugugggc

SEQ ID NO: 50759 - RNA, 18 nt, Artificial Sequence
  Description of Artificial Sequence: Synthetic oligonucleotide
cuguucaaagcaaagaug

SEQ ID NO: 50760 - RNA, 18 nt, Artificial Sequence
  Description of Artificial Sequence: Synthetic oligonucleotide
cucaucuguucaaagcaa

SEQ ID NO: 50761 - RNA, 18 nt, Artificial Sequence
  Description of Artificial Sequence: Synthetic oligonucleotide
cauggcucaucuguucaa

SEQ ID NO: 50762 - RNA, 18 nt, Artificial Sequence
  Description of Artificial Sequence: Synthetic oligonucleotide
ccaaccauggcucaucug

SEQ ID NO: 50763 - RNA, 18 nt, Artificial Sequence
  Description of Artificial Sequence: Synthetic oligonucleotide
auuggccaaccauggcuc

SEQ ID NO: 50764 - RNA, 18 nt, Artificial Sequence
  Description of Artificial Sequence: Synthetic oligonucleotide
agauaauuggccaaccau

SEQ ID NO: 50765 - RNA, 18 nt, Artificial Sequence
  Description of Artificial Sequence: Synthetic oligonucleotide
uuggcagauaauuggcca

SEQ ID NO: 50766 - RNA, 18 nt, Artificial Sequence
  Description of Artificial Sequence: Synthetic oligonucleotide
ucugguuggcagauaauu

SEQ ID NO: 50767 - RNA, 18 nt, Artificial Sequence
  Description of Artificial Sequence: Synthetic oligonucleotide
aauuaucugguuggcaga

SEQ ID NO: 50768 - RNA, 18 nt, Artificial Sequence
  Description of Artificial Sequence: Synthetic oligonucleotide
ugagaaauuaucugguug

SEQ ID NO: 50769 - RNA, 18 nt, Artificial Sequence
  Description of Artificial Sequence: Synthetic oligonucleotide
cauauugagaaauuaucu

SEQ ID NO: 50770 - RNA, 18 nt, Artificial Sequence
  Description of Artificial Sequence: Synthetic oligonucleotide
gugagcauauugagaaau

SEQ ID NO: 50771 - RNA, 18 nt, Artificial Sequence
  Description of Artificial Sequence: Synthetic oligonucleotide
cuggugugagcauauuga

SEQ ID NO: 50772 - RNA, 18 nt, Artificial Sequence
  Description of Artificial Sequence: Synthetic oligonucleotide
agcaucuggugugagcau

SEQ ID NO: 50773 - RNA, 18 nt, Artificial Sequence
  Description of Artificial Sequence: Synthetic oligonucleotide
cuggaagcaucuggugug

SEQ ID NO: 50774 - RNA, 18 nt, Artificial Sequence
  Description of Artificial Sequence: Synthetic oligonucleotide
ccuagcuggaagcaucug

SEQ ID NO: 50775 - RNA, 18 nt, Artificial Sequence
  Description of Artificial Sequence: Synthetic oligonucleotide
cccucccuagcuggaagc

SEQ ID NO: 50776 - RNA, 18 nt, Artificial Sequence
  Description of Artificial Sequence: Synthetic oligonucleotide
uaauacccucccuagcug

SEQ ID NO: 50777 - RNA, 18 nt, Artificial Sequence
  Description of Artificial Sequence: Synthetic oligonucleotide
uccccuaauacccucccu

SEQ ID NO: 50778 - RNA, 18 nt, Artificial Sequence
  Description of Artificial Sequence: Synthetic oligonucleotide
cccuuuccccuaauaccc

SEQ ID NO: 50779 - RNA, 18 nt, Artificial Sequence
  Description of Artificial Sequence: Synthetic oligonucleotide
ucaagcccuuuccccuaa

SEQ ID NO: 50780 - RNA, 18 nt, Artificial Sequence
  Description of Artificial Sequence: Synthetic oligonucleotide
ggcccucaagcccuuucc

SEQ ID NO: 50781 - RNA, 18 nt, Artificial Sequence
  Description of Artificial Sequence: Synthetic oligonucleotide
acuguggcccucaagccc

SEQ ID NO: 50782 - RNA, 18 nt, Artificial Sequence
  Description of Artificial Sequence: Synthetic oligonucleotide
aguuuacuguggcccuca

SEQ ID NO: 50783 - RNA, 18 nt, Artificial Sequence
  Description of Artificial Sequence: Synthetic oligonucleotide
uguccaguuuacuguggc

SEQ ID NO: 50784 - RNA, 18 nt, Artificial Sequence
  Description of Artificial Sequence: Synthetic oligonucleotide
cuacagguggcagccuag

SEQ ID NO: 50785 - RNA, 18 nt, Artificial Sequence
  Description of Artificial Sequence: Synthetic oligonucleotide
gugaccuacagguggcag

SEQ ID NO: 50786 - RNA, 18 nt, Artificial Sequence
  Description of Artificial Sequence: Synthetic oligonucleotide
cccaagugaccuacaggu

SEQ ID NO: 50787 - RNA, 18 nt, Artificial Sequence
  Description of Artificial Sequence: Synthetic oligonucleotide
uggagcccaagugaccua

SEQ ID NO: 50788 - RNA, 18 nt, Artificial Sequence
  Description of Artificial Sequence: Synthetic oligonucleotide
auagcuggagcccaagug

SEQ ID NO: 50789 - RNA, 18 nt, Artificial Sequence
  Description of Artificial Sequence: Synthetic oligonucleotide
gccacauagcuggagccc

SEQ ID NO: 50790 - RNA, 18 nt, Artificial Sequence
  Description of Artificial Sequence: Synthetic oligonucleotide
aggcagccacauagcugg

SEQ ID NO: 50791 - RNA, 18 nt, Artificial Sequence
  Description of Artificial Sequence: Synthetic oligonucleotide
agaagaggcagccacaua

SEQ ID NO: 50792 - RNA, 18 nt, Artificial Sequence
  Description of Artificial Sequence: Synthetic oligonucleotide
ccagcagaagaggcagcc

SEQ ID NO: 50793 - RNA, 18 nt, Artificial Sequence
  Description of Artificial Sequence: Synthetic oligonucleotide
ggcacccagcagaagagg

SEQ ID NO: 50794 - RNA, 18 nt, Artificial Sequence
  Description of Artificial Sequence: Synthetic oligonucleotide
aguaaggcacccagcaga

SEQ ID NO: 50795 - RNA, 18 nt, Artificial Sequence
  Description of Artificial Sequence: Synthetic oligonucleotide
cccagaguaaggcaccca

SEQ ID NO: 50796 - RNA, 18 nt, Artificial Sequence
  Description of Artificial Sequence: Synthetic oligonucleotide
cacugcccagaguaaggc

SEQ ID NO: 50797 - RNA, 18 nt, Artificial Sequence
  Description of Artificial Sequence: Synthetic oligonucleotide
cacagcacugcccagagu

SEQ ID NO: 50798 - RNA, 18 nt, Artificial Sequence
  Description of Artificial Sequence: Synthetic oligonucleotide
gcaaccacagcacugccc

SEQ ID NO: 50799 - RNA, 18 nt, Artificial Sequence
  Description of Artificial Sequence: Synthetic oligonucleotide
ccugagcaaccacagcac

SEQ ID NO: 50800 - RNA, 18 nt, Artificial Sequence
  Description of Artificial Sequence: Synthetic oligonucleotide
cggucccugagcaaccac

SEQ ID NO: 50801 - RNA, 18 nt, Artificial Sequence
  Description of Artificial Sequence: Synthetic oligonucleotide
ucugccggucccugagca

SEQ ID NO: 50802 - RNA, 18 nt, Artificial Sequence
  Description of Artificial Sequence: Synthetic oligonucleotide
caggcucugccggucccu

SEQ ID NO: 50803 - RNA, 18 nt, Artificial Sequence
  Description of Artificial Sequence: Synthetic oligonucleotide
gcgggcaggcucugccgg

SEQ ID NO: 50804 - RNA, 18 nt, Artificial Sequence
  Description of Artificial Sequence: Synthetic oligonucleotide
ugcuggcgggcaggcucu

SEQ ID NO: 50805 - RNA, 18 nt, Artificial Sequence
  Description of Artificial Sequence: Synthetic oligonucleotide
ggcauugcuggcgggcag

SEQ ID NO: 50806 - RNA, 18 nt, Artificial Sequence
  Description of Artificial Sequence: Synthetic oligonucleotide
acaaaggcauugcuggcg

SEQ ID NO: 50807 - RNA, 18 nt, Artificial Sequence
  Description of Artificial Sequence: Synthetic oligonucleotide
ugaagacaaaggcauugc

SEQ ID NO: 50808 - RNA, 18 nt, Artificial Sequence
  Description of Artificial Sequence: Synthetic oligonucleotide
ggugaugaagacaaaggc

SEQ ID NO: 50809 - RNA, 18 nt, Artificial Sequence
  Description of Artificial Sequence: Synthetic oligonucleotide
cagccggugaugaagaca

SEQ ID NO: 50810 - RNA, 18 nt, Artificial Sequence
  Description of Artificial Sequence: Synthetic oligonucleotide
agucacagccggugauga

SEQ ID NO: 50811 - RNA, 18 nt, Artificial Sequence
  Description of Artificial Sequence: Synthetic oligonucleotide
gccugagucacagccggu

SEQ ID NO: 50812 - RNA, 18 nt, Artificial Sequence
  Description of Artificial Sequence: Synthetic oligonucleotide
ccaaagccugagucacag

SEQ ID NO: 50813 - RNA, 18 nt, Artificial Sequence
  Description of Artificial Sequence: Synthetic oligonucleotide
ggcgcccaaagccugagu

SEQ ID NO: 50814 - RNA, 18 nt, Artificial Sequence
  Description of Artificial Sequence: Synthetic oligonucleotide
cagaaggcgcccaaagcc

SEQ ID NO: 50815 - RNA, 18 nt, Artificial Sequence
  Description of Artificial Sequence: Synthetic oligonucleotide
agugccagaaggcgccca

SEQ ID NO: 50816 - RNA, 18 nt, Artificial Sequence
  Description of Artificial Sequence: Synthetic oligonucleotide
gcugcagugccagaaggc

SEQ ID NO: 50817 - RNA, 18 nt, Artificial Sequence
  Description of Artificial Sequence: Synthetic oligonucleotide
guccagcugcagugccag

SEQ ID NO: 50818 - RNA, 18 nt, Artificial Sequence
  Description of Artificial Sequence: Synthetic oligonucleotide
cucugguccagcugcagu

SEQ ID NO: 50819 - RNA, 18 nt, Artificial Sequence
  Description of Artificial Sequence: Synthetic oligonucleotide
agccucucugguccagcu

SEQ ID NO: 50820 - RNA, 18 nt, Artificial Sequence
  Description of Artificial Sequence: Synthetic oligonucleotide
ucggaagccucucugguc

SEQ ID NO: 50821 - RNA, 18 nt, Artificial Sequence
  Description of Artificial Sequence: Synthetic oligonucleotide
aggacucggaagccucuc

SEQ ID NO: 50822 - RNA, 18 nt, Artificial Sequence
  Description of Artificial Sequence: Synthetic oligonucleotide
uggccaggacucggaagc

SEQ ID NO: 50823 - RNA, 18 nt, Artificial Sequence
  Description of Artificial Sequence: Synthetic oligonucleotide
gcagcuggccaggacucg

SEQ ID NO: 50824 - RNA, 18 nt, Artificial Sequence
  Description of Artificial Sequence: Synthetic oligonucleotide
gucaggcagcuggccagg

SEQ ID NO: 50825 - RNA, 18 nt, Artificial Sequence
  Description of Artificial Sequence: Synthetic oligonucleotide
gggucaggcagcuggcca

SEQ ID NO: 50826 - RNA, 18 nt, Artificial Sequence
  Description of Artificial Sequence: Synthetic oligonucleotide
guccucggccccggaggg

SEQ ID NO: 50827 - RNA, 18 nt, Artificial Sequence
  Description of Artificial Sequence: Synthetic oligonucleotide
ugcagguccucggccccg

SEQ ID NO: 50828 - RNA, 18 nt, Artificial Sequence
  Description of Artificial Sequence: Synthetic oligonucleotide
cccgcugcagguccucgg

SEQ ID NO: 50829 - RNA, 18 nt, Artificial Sequence
  Description of Artificial Sequence: Synthetic oligonucleotide
ggccacccgcugcagguc

SEQ ID NO: 50830 - RNA, 18 nt, Artificial Sequence
  Description of Artificial Sequence: Synthetic oligonucleotide
gaggaggccacccgcugc

SEQ ID NO: 50831 - RNA, 18 nt, Artificial Sequence
  Description of Artificial Sequence: Synthetic oligonucleotide
ggcgggaggaggccaccc

SEQ ID NO: 50832 - RNA, 18 nt, Artificial Sequence
  Description of Artificial Sequence: Synthetic oligonucleotide
guggaggcgggaggaggc

SEQ ID NO: 50833 - RNA, 18 nt, Artificial Sequence
  Description of Artificial Sequence: Synthetic oligonucleotide
gugguguggaggcgggag

SEQ ID NO: 50834 - RNA, 18 nt, Artificial Sequence
  Description of Artificial Sequence: Synthetic oligonucleotide
acagggugguguggaggc

SEQ ID NO: 50835 - RNA, 18 nt, Artificial Sequence
  Description of Artificial Sequence: Synthetic oligonucleotide
auccaacaggguggugug

SEQ ID NO: 50836 - RNA, 18 nt, Artificial Sequence
  Description of Artificial Sequence: Synthetic oligonucleotide
gugauauccaacagggug

SEQ ID NO: 50837 - RNA, 18 nt, Artificial Sequence
  Description of Artificial Sequence: Synthetic oligonucleotide
gaucagugauauccaaca

SEQ ID NO: 50838 - RNA, 18 nt, Artificial Sequence
  Description of Artificial Sequence: Synthetic oligonucleotide
gggaucagugauauccaa

SEQ ID NO: 50839 - RNA, 18 nt, Artificial Sequence
  Description of Artificial Sequence: Synthetic oligonucleotide
ccugcuggacgcucuggg

SEQ ID NO: 50840 - RNA, 18 nt, Artificial Sequence
  Description of Artificial Sequence: Synthetic oligonucleotide
ggcugccugcuggacgcu

SEQ ID NO: 50841 - RNA, 18 nt, Artificial Sequence
  Description of Artificial Sequence: Synthetic oligonucleotide
cacuuggcugccugcugg

SEQ ID NO: 50842 - RNA, 18 nt, Artificial Sequence
  Description of Artificial Sequence: Synthetic oligonucleotide
ccacccacuuggcugccu

SEQ ID NO: 50843 - RNA, 18 nt, Artificial Sequence
  Description of Artificial Sequence: Synthetic oligonucleotide
caucuccacccacuuggc

SEQ ID NO: 50844 - RNA, 18 nt, Artificial Sequence
  Description of Artificial Sequence: Synthetic oligonucleotide
acgugcaucuccacccac

SEQ ID NO: 50845 - RNA, 18 nt, Artificial Sequence
  Description of Artificial Sequence: Synthetic oligonucleotide
ccuuaacgugcaucucca

SEQ ID NO: 50846 - RNA, 18 nt, Artificial Sequence
  Description of Artificial Sequence: Synthetic oligonucleotide
ugcuuccuuaacgugcau

SEQ ID NO: 50847 - RNA, 18 nt, Artificial Sequence
  Description of Artificial Sequence: Synthetic oligonucleotide
accuacagguggcagccu

SEQ ID NO: 50848 - RNA, 18 nt, Artificial Sequence
  Description of Artificial Sequence: Synthetic oligonucleotide
aagugaccuacagguggc

SEQ ID NO: 50849 - RNA, 18 nt, Artificial Sequence
  Description of Artificial Sequence: Synthetic oligonucleotide
agcccaagugaccuacag

SEQ ID NO: 50850 - RNA, 18 nt, Artificial Sequence
  Description of Artificial Sequence: Synthetic oligonucleotide
gcuggagcccaagugacc

SEQ ID NO: 50851 - RNA, 18 nt, Artificial Sequence
  Description of Artificial Sequence: Synthetic oligonucleotide
acauagcuggagcccaag

SEQ ID NO: 50852 - RNA, 18 nt, Artificial Sequence
  Description of Artificial Sequence: Synthetic oligonucleotide
cagccacauagcuggagc

SEQ ID NO: 50853 - RNA, 18 nt, Artificial Sequence
  Description of Artificial Sequence: Synthetic oligonucleotide
agaggcagccacauagcu

SEQ ID NO: 50854 - RNA, 18 nt, Artificial Sequence
  Description of Artificial Sequence: Synthetic oligonucleotide
gcagaagaggcagccaca

SEQ ID NO: 50855 - RNA, 18 nt, Artificial Sequence
  Description of Artificial Sequence: Synthetic oligonucleotide
acccagcagaagaggcag

SEQ ID NO: 50856 - RNA, 18 nt, Artificial Sequence
  Description of Artificial Sequence: Synthetic oligonucleotide
aaggcacccagcagaaga

SEQ ID NO: 50857 - RNA, 18 nt, Artificial Sequence
  Description of Artificial Sequence: Synthetic oligonucleotide
agaguaaggcacccagca

SEQ ID NO: 50858 - RNA, 18 nt, Artificial Sequence
  Description of Artificial Sequence: Synthetic oligonucleotide
ugcccagaguaaggcacc

SEQ ID NO: 50859 - RNA, 18 nt, Artificial Sequence
  Description of Artificial Sequence: Synthetic oligonucleotide
agcacugcccagaguaag

SEQ ID NO: 50860 - RNA, 18 nt, Artificial Sequence
  Description of Artificial Sequence: Synthetic oligonucleotide
accacagcacugcccaga

SEQ ID NO: 50861 - RNA, 18 nt, Artificial Sequence
  Description of Artificial Sequence: Synthetic oligonucleotide
gagcaaccacagcacugc

SEQ ID NO: 50862 - RNA, 18 nt, Artificial Sequence
  Description of Artificial Sequence: Synthetic oligonucleotide
ucccugagcaaccacagc

SEQ ID NO: 50863 - RNA, 18 nt, Artificial Sequence
  Description of Artificial Sequence: Synthetic oligonucleotide
gccggucccugagcaacc

SEQ ID NO: 50864 - RNA, 18 nt, Artificial Sequence
  Description of Artificial Sequence: Synthetic oligonucleotide
gcucugccggucccugag

SEQ ID NO: 50865 - RNA, 18 nt, Artificial Sequence
  Description of Artificial Sequence: Synthetic oligonucleotide
ggcaggcucugccggucc

SEQ ID NO: 50866 - RNA, 18 nt, Artificial Sequence
  Description of Artificial Sequence: Synthetic oligonucleotide
uggcgggcaggcucugcc

SEQ ID NO: 50867 - RNA, 18 nt, Artificial Sequence
  Description of Artificial Sequence: Synthetic oligonucleotide
auugcuggcgggcaggcu

SEQ ID NO: 50868 - RNA, 18 nt, Artificial Sequence
  Description of Artificial Sequence: Synthetic oligonucleotide
aaggcauugcuggcgggc

SEQ ID NO: 50869 - RNA, 18 nt, Artificial Sequence
  Description of Artificial Sequence: Synthetic oligonucleotide
agacaaaggcauugcugg

SEQ ID NO: 50870 - RNA, 18 nt, Artificial Sequence
  Description of Artificial Sequence: Synthetic oligonucleotide
gaugaagacaaaggcauu

SEQ ID NO: 50871 - RNA, 18 nt, Artificial Sequence
  Description of Artificial Sequence: Synthetic oligonucleotide
ccggugaugaagacaaag

SEQ ID NO: 50872 - RNA, 18 nt, Artificial Sequence
  Description of Artificial Sequence: Synthetic oligonucleotide
cacagccggugaugaaga

SEQ ID NO: 50873 - RNA, 18 nt, Artificial Sequence
  Description of Artificial Sequence: Synthetic oligonucleotide
ugagucacagccggugau

SEQ ID NO: 50874 - RNA, 18 nt, Artificial Sequence
  Description of Artificial Sequence: Synthetic oligonucleotide
aagccugagucacagccg

SEQ ID NO: 50875 - RNA, 18 nt, Artificial Sequence
  Description of Artificial Sequence: Synthetic oligonucleotide
gcccaaagccugagucac

SEQ ID NO: 50876 - RNA, 18 nt, Artificial Sequence
  Description of Artificial Sequence: Synthetic oligonucleotide
aaggcgcccaaagccuga

SEQ ID NO: 50877 - RNA, 18 nt, Artificial Sequence
  Description of Artificial Sequence: Synthetic oligonucleotide
gccagaaggcgcccaaag

SEQ ID NO: 50878 - RNA, 18 nt, Artificial Sequence
  Description of Artificial Sequence: Synthetic oligonucleotide
gcagugccagaaggcgcc

SEQ ID NO: 50879 - RNA, 18 nt, Artificial Sequence
  Description of Artificial Sequence: Synthetic oligonucleotide
cagcugcagugccagaag

SEQ ID NO: 50880 - RNA, 18 nt, Artificial Sequence
  Description of Artificial Sequence: Synthetic oligonucleotide
ugguccagcugcagugcc

SEQ ID NO: 50881 - RNA, 18 nt, Artificial Sequence
  Description of Artificial Sequence: Synthetic oligonucleotide
cucucugguccagcugca

SEQ ID NO: 50882 - RNA, 18 nt, Artificial Sequence
  Description of Artificial Sequence: Synthetic oligonucleotide
gaagccucucugguccag

SEQ ID NO: 50883 - RNA, 18 nt, Artificial Sequence
  Description of Artificial Sequence: Synthetic oligonucleotide
acucggaagccucucugg

SEQ ID NO: 50884 - RNA, 18 nt, Artificial Sequence
  Description of Artificial Sequence: Synthetic oligonucleotide
ccaggacucggaagccuc

SEQ ID NO: 50885 - RNA, 18 nt, Artificial Sequence
  Description of Artificial Sequence: Synthetic oligonucleotide
gcuggccaggacucggaa

SEQ ID NO: 50886 - RNA, 18 nt, Artificial Sequence
  Description of Artificial Sequence: Synthetic oligonucleotide
aggcagcuggccaggacu

SEQ ID NO: 50887 - RNA, 18 nt, Artificial Sequence
  Description of Artificial Sequence: Synthetic oligonucleotide
gggucaggcagcuggcca

SEQ ID NO: 50888 - RNA, 18 nt, Artificial Sequence
  Description of Artificial Sequence: Synthetic oligonucleotide
guccucggccccggaggg

SEQ ID NO: 50889 - RNA, 18 nt, Artificial Sequence
  Description of Artificial Sequence: Synthetic oligonucleotide
agguccucggccccggag

SEQ ID NO: 50890 - RNA, 18 nt, Artificial Sequence
  Description of Artificial Sequence: Synthetic oligonucleotide
gcugcagguccucggccc

SEQ ID NO: 50891 - RNA, 18 nt, Artificial Sequence
  Description of Artificial Sequence: Synthetic oligonucleotide
cacccgcugcagguccuc

SEQ ID NO: 50892 - RNA, 18 nt, Artificial Sequence
  Description of Artificial Sequence: Synthetic oligonucleotide
gaggccacccgcugcagg

SEQ ID NO: 50893 - RNA, 18 nt, Artificial Sequence
  Description of Artificial Sequence: Synthetic oligonucleotide
gggaggaggccacccgcu

SEQ ID NO: 50894 - RNA, 18 nt, Artificial Sequence
  Description of Artificial Sequence: Synthetic oligonucleotide
gaggcgggaggaggccac

SEQ ID NO: 50895 - RNA, 18 nt, Artificial Sequence
  Description of Artificial Sequence: Synthetic oligonucleotide
guguggaggcgggaggag

SEQ ID NO: 50896 - RNA, 18 nt, Artificial Sequence
  Description of Artificial Sequence: Synthetic oligonucleotide
gggugguguggaggcggg

SEQ ID NO: 50897 - RNA, 18 nt, Artificial Sequence
  Description of Artificial Sequence: Synthetic oligonucleotide
caacagggugguguggag

SEQ ID NO: 50898 - RNA, 18 nt, Artificial Sequence
  Description of Artificial Sequence: Synthetic oligonucleotide
auauccaacaggguggug

SEQ ID NO: 50899 - RNA, 18 nt, Artificial Sequence
  Description of Artificial Sequence: Synthetic oligonucleotide
cagugauauccaacaggg

SEQ ID NO: 50900 - RNA, 18 nt, Artificial Sequence
  Description of Artificial Sequence: Synthetic oligonucleotide
gggaucagugauauccaa

SEQ ID NO: 50901 - RNA, 18 nt, Artificial Sequence
  Description of Artificial Sequence: Synthetic oligonucleotide
ccugcuggacgcucuggg

SEQ ID NO: 50902 - RNA, 18 nt, Artificial Sequence
  Description of Artificial Sequence: Synthetic oligonucleotide
cugccugcuggacgcucu

SEQ ID NO: 50903 - RNA, 18 nt, Artificial Sequence
  Description of Artificial Sequence: Synthetic oligonucleotide
cuuggcugccugcuggac

SEQ ID NO: 50904 - RNA, 18 nt, Artificial Sequence
  Description of Artificial Sequence: Synthetic oligonucleotide
acccacuuggcugccugc

SEQ ID NO: 50905 - RNA, 18 nt, Artificial Sequence
  Description of Artificial Sequence: Synthetic oligonucleotide
ucuccacccacuuggcug

SEQ ID NO: 50906 - RNA, 18 nt, Artificial Sequence
  Description of Artificial Sequence: Synthetic oligonucleotide
gugcaucuccacccacuu

SEQ ID NO: 50907 - RNA, 18 nt, Artificial Sequence
  Description of Artificial Sequence: Synthetic oligonucleotide
uuaacgugcaucuccacc

SEQ ID NO: 50908 - RNA, 18 nt, Artificial Sequence
  Description of Artificial Sequence: Synthetic oligonucleotide
cuuccuuaacgugcaucu

SEQ ID NO: 50909 - RNA, 18 nt, Artificial Sequence
  Description of Artificial Sequence: Synthetic oligonucleotide
uccugguggucuaccaua

SEQ ID NO: 50910 - RNA, 18 nt, Artificial Sequence
  Description of Artificial Sequence: Synthetic oligonucleotide
cauauuccugguggucua

SEQ ID NO: 50911 - RNA, 18 nt, Artificial Sequence
  Description of Artificial Sequence: Synthetic oligonucleotide
cacaccauauuccuggug

SEQ ID NO: 50912 - RNA, 18 nt, Artificial Sequence
  Description of Artificial Sequence: Synthetic oligonucleotide
caccccacaccauauucc

SEQ ID NO: 50913 - RNA, 18 nt, Artificial Sequence
  Description of Artificial Sequence: Synthetic oligonucleotide
caggacaccccacaccau

SEQ ID NO: 50914 - RNA, 18 nt, Artificial Sequence
  Description of Artificial Sequence: Synthetic oligonucleotide
gggaucaggacaccccac

SEQ ID NO: 50915 - RNA, 18 nt, Artificial Sequence
  Description of Artificial Sequence: Synthetic oligonucleotide
cccuugcaggugacuccu

SEQ ID NO: 50916 - RNA, 18 nt, Artificial Sequence
  Description of Artificial Sequence: Synthetic oligonucleotide
cacagcccuugcagguga

SEQ ID NO: 50917 - RNA, 18 nt, Artificial Sequence
  Description of Artificial Sequence: Synthetic oligonucleotide
cuuaccacagcccuugca

SEQ ID NO: 50918 - RNA, 18 nt, Artificial Sequence
  Description of Artificial Sequence: Synthetic oligonucleotide
uuuagcuuaccacagccc

SEQ ID NO: 50919 - RNA, 18 nt, Artificial Sequence
  Description of Artificial Sequence: Synthetic oligonucleotide
gucccuuuagcuuaccac

SEQ ID NO: 50920 - RNA, 18 nt, Artificial Sequence
  Description of Artificial Sequence: Synthetic oligonucleotide
aaauugucccuuuagcuu

SEQ ID NO: 50921 - RNA, 18 nt, Artificial Sequence
  Description of Artificial Sequence: Synthetic oligonucleotide
uccucaaauugucccuuu

SEQ ID NO: 50922 - RNA, 18 nt, Artificial Sequence
  Description of Artificial Sequence: Synthetic oligonucleotide
gcuucuccucaaauuguc

SEQ ID NO: 50923 - RNA, 18 nt, Artificial Sequence
  Description of Artificial Sequence: Synthetic oligonucleotide
aaacugcuucuccucaaa

SEQ ID NO: 50924 - RNA, 18 nt, Artificial Sequence
  Description of Artificial Sequence: Synthetic oligonucleotide
ucugaaaacugcuucucc

SEQ ID NO: 50925 - RNA, 18 nt, Artificial Sequence
  Description of Artificial Sequence: Synthetic oligonucleotide
gagcaucugaaaacugcu

SEQ ID NO: 50926 - RNA, 18 nt, Artificial Sequence
  Description of Artificial Sequence: Synthetic oligonucleotide
ccacagcccuugcaggug

SEQ ID NO: 50927 - RNA, 18 nt, Artificial Sequence
  Description of Artificial Sequence: Synthetic oligonucleotide
gcuuaccacagcccuugc

SEQ ID NO: 50928 - RNA, 18 nt, Artificial Sequence
  Description of Artificial Sequence: Synthetic oligonucleotide
cuuuagcuuaccacagcc

SEQ ID NO: 50929 - RNA, 18 nt, Artificial Sequence
  Description of Artificial Sequence: Synthetic oligonucleotide
ugucccuuuagcuuacca

SEQ ID NO: 50930 - RNA, 18 nt, Artificial Sequence
  Description of Artificial Sequence: Synthetic oligonucleotide
caaauugucccuuuagcu

SEQ ID NO: 50931 - RNA, 18 nt, Artificial Sequence
  Description of Artificial Sequence: Synthetic oligonucleotide
cuccucaaauugucccuu

SEQ ID NO: 50932 - RNA, 18 nt, Artificial Sequence
  Description of Artificial Sequence: Synthetic oligonucleotide
ugcuucuccucaaauugu

SEQ ID NO: 50933 - RNA, 18 nt, Artificial Sequence
  Description of Artificial Sequence: Synthetic oligonucleotide
aaaacugcuucuccucaa

SEQ ID NO: 50934 - RNA, 18 nt, Artificial Sequence
  Description of Artificial Sequence: Synthetic oligonucleotide
aucugaaaacugcuucuc

SEQ ID NO: 50935 - RNA, 18 nt, Artificial Sequence
  Description of Artificial Sequence: Synthetic oligonucleotide
ggagcaucugaaaacugc

SEQ ID NO: 50936 - RNA, 18 nt, Artificial Sequence
  Description of Artificial Sequence: Synthetic oligonucleotide
uccugggagcaucugaaa

SEQ ID NO: 50937 - RNA, 18 nt, Artificial Sequence
  Description of Artificial Sequence: Synthetic oligonucleotide
cuucuuccugggagcauc

SEQ ID NO: 50938 - RNA, 18 nt, Artificial Sequence
  Description of Artificial Sequence: Synthetic oligonucleotide
ucccucuucuuccuggga

SEQ ID NO: 50939 - RNA, 18 nt, Artificial Sequence
  Description of Artificial Sequence: Synthetic oligonucleotide
acagcucccucuucuucc

SEQ ID NO: 50940 - RNA, 18 nt, Artificial Sequence
  Description of Artificial Sequence: Synthetic oligonucleotide
cucccacagcucccucuu

SEQ ID NO: 50941 - RNA, 18 nt, Artificial Sequence
  Description of Artificial Sequence: Synthetic oligonucleotide
aggcacucccacagcucc

SEQ ID NO: 50942 - RNA, 18 nt, Artificial Sequence
  Description of Artificial Sequence: Synthetic oligonucleotide
aggugaggcacucccaca

SEQ ID NO: 50943 - RNA, 18 nt, Artificial Sequence
  Description of Artificial Sequence: Synthetic oligonucleotide
uucaccagaccaaaaagc

SEQ ID NO: 50944 - RNA, 18 nt, Artificial Sequence
  Description of Artificial Sequence: Synthetic oligonucleotide
cauuauucaccagaccaa

SEQ ID NO: 50945 - RNA, 18 nt, Artificial Sequence
  Description of Artificial Sequence: Synthetic oligonucleotide
accagcauuauucaccag

SEQ ID NO: 50946 - RNA, 18 nt, Artificial Sequence
  Description of Artificial Sequence: Synthetic oligonucleotide
gccacaccagcauuauuc

SEQ ID NO: 50947 - RNA, 18 nt, Artificial Sequence
  Description of Artificial Sequence: Synthetic oligonucleotide
uaccagccacaccagcau

SEQ ID NO: 50948 - RNA, 18 nt, Artificial Sequence
  Description of Artificial Sequence: Synthetic oligonucleotide
gaugauaccagccacacc

SEQ ID NO: 50949 - RNA, 18 nt, Artificial Sequence
  Description of Artificial Sequence: Synthetic oligonucleotide
gguccgaugauaccagcc

SEQ ID NO: 50950 - RNA, 18 nt, Artificial Sequence
  Description of Artificial Sequence: Synthetic oligonucleotide
guguggguccgaugauac

SEQ ID NO: 50951 - RNA, 18 nt, Artificial Sequence
  Description of Artificial Sequence: Synthetic oligonucleotide
ccaugguguggguccgau

SEQ ID NO: 50952 - RNA, 18 nt, Artificial Sequence
  Description of Artificial Sequence: Synthetic oligonucleotide
gucagccauggugugggu

SEQ ID NO: 50953 - RNA, 18 nt, Artificial Sequence
  Description of Artificial Sequence: Synthetic oligonucleotide
cccgggucagccauggug

SEQ ID NO: 50954 - RNA, 18 nt, Artificial Sequence
  Description of Artificial Sequence: Synthetic oligonucleotide
aucgucccgggucagcca

SEQ ID NO: 50955 - RNA, 18 nt, Artificial Sequence
  Description of Artificial Sequence: Synthetic oligonucleotide
uggaaaucgucccggguc

SEQ ID NO: 50956 - RNA, 18 nt, Artificial Sequence
  Description of Artificial Sequence: Synthetic oligonucleotide
cccgcuggaaaucguccc

SEQ ID NO: 50957 - RNA, 18 nt, Artificial Sequence
  Description of Artificial Sequence: Synthetic oligonucleotide
cagcacccgcuggaaauc

SEQ ID NO: 50958 - RNA, 18 nt, Artificial Sequence
  Description of Artificial Sequence: Synthetic oligonucleotide
acauucagcacccgcugg

SEQ ID NO: 50959 - RNA, 18 nt, Artificial Sequence
  Description of Artificial Sequence: Synthetic oligonucleotide
uguucacauucagcaccc

SEQ ID NO: 50960 - RNA, 18 nt, Artificial Sequence
  Description of Artificial Sequence: Synthetic oligonucleotide
cauuguguucacauucag

SEQ ID NO: 50961 - RNA, 18 nt, Artificial Sequence
  Description of Artificial Sequence: Synthetic oligonucleotide
ggacccauuguguucaca

SEQ ID NO: 50962 - RNA, 18 nt, Artificial Sequence
  Description of Artificial Sequence: Synthetic oligonucleotide
cgaugggacccauugugu

SEQ ID NO: 50963 - RNA, 18 nt, Artificial Sequence
  Description of Artificial Sequence: Synthetic oligonucleotide
gaccccgaugggacccau

SEQ ID NO: 50964 - RNA, 18 nt, Artificial Sequence
  Description of Artificial Sequence: Synthetic oligonucleotide
agggugaccccgauggga

SEQ ID NO: 50965 - RNA, 18 nt, Artificial Sequence
  Description of Artificial Sequence: Synthetic oligonucleotide
gggcaagggugaccccga

SEQ ID NO: 50966 - RNA, 18 nt, Artificial Sequence
  Description of Artificial Sequence: Synthetic oligonucleotide
cagcagggcaagggugac

SEQ ID NO: 50967 - RNA, 18 nt, Artificial Sequence
  Description of Artificial Sequence: Synthetic oligonucleotide
agaggcagcagggcaagg

SEQ ID NO: 50968 - RNA, 18 nt, Artificial Sequence
  Description of Artificial Sequence: Synthetic oligonucleotide
gcagcagaggcagcaggg

SEQ ID NO: 50969 - RNA, 18 nt, Artificial Sequence
  Description of Artificial Sequence: Synthetic oligonucleotide
uugcugcagcagaggcag

SEQ ID NO: 50970 - RNA, 18 nt, Artificial Sequence
  Description of Artificial Sequence: Synthetic oligonucleotide
cgggcuugcugcagcaga

SEQ ID NO: 50971 - RNA, 18 nt, Artificial Sequence
  Description of Artificial Sequence: Synthetic oligonucleotide
ggccccgggcuugcugca

SEQ ID NO: 50972 - RNA, 18 nt, Artificial Sequence
  Description of Artificial Sequence: Synthetic oligonucleotide
cacccggccccgggcuug

SEQ ID NO: 50973 - RNA, 18 nt, Artificial Sequence
  Description of Artificial Sequence: Synthetic oligonucleotide
uugaucacccggccccgg

SEQ ID NO: 50974 - RNA, 18 nt, Artificial Sequence
  Description of Artificial Sequence: Synthetic oligonucleotide
ugauguugaucacccggc

SEQ ID NO: 50975 - RNA, 18 nt, Artificial Sequence
  Description of Artificial Sequence: Synthetic oligonucleotide
gcuggugauguugaucac

SEQ ID NO: 50976 - RNA, 18 nt, Artificial Sequence
  Description of Artificial Sequence: Synthetic oligonucleotide
aggacgcuggugauguug

SEQ ID NO: 50977 - RNA, 18 nt, Artificial Sequence
  Description of Artificial Sequence: Synthetic oligonucleotide
gacccaggacgcugguga

SEQ ID NO: 50978 - RNA, 18 nt, Artificial Sequence
  Description of Artificial Sequence: Synthetic oligonucleotide
caggcgacccaggacgcu

SEQ ID NO: 50979 - RNA, 18 nt, Artificial Sequence
  Description of Artificial Sequence: Synthetic oligonucleotide
gcugccaggcgacccagg

SEQ ID NO: 50980 - RNA, 18 nt, Artificial Sequence
  Description of Artificial Sequence: Synthetic oligonucleotide
cauuggcugccaggcgac

SEQ ID NO: 50981 - RNA, 18 nt, Artificial Sequence
  Description of Artificial Sequence: Synthetic oligonucleotide
cccaccauuggcugccag

SEQ ID NO: 50982 - RNA, 18 nt, Artificial Sequence
  Description of Artificial Sequence: Synthetic oligonucleotide
uagcccccaccauuggcu

SEQ ID NO: 50983 - RNA, 18 nt, Artificial Sequence
  Description of Artificial Sequence: Synthetic oligonucleotide
cacaguagcccccaccau

SEQ ID NO: 50984 - RNA, 18 nt, Artificial Sequence
  Description of Artificial Sequence: Synthetic oligonucleotide
ggagacacaguagccccc

SEQ ID NO: 50985 - RNA, 18 nt, Artificial Sequence
  Description of Artificial Sequence: Synthetic oligonucleotide
aauuuggagacacaguag

SEQ ID NO: 50986 - RNA, 18 nt, Artificial Sequence
  Description of Artificial Sequence: Synthetic oligonucleotide
ggccaaauuuggagacac

SEQ ID NO: 50987 - RNA, 18 nt, Artificial Sequence
  Description of Artificial Sequence: Synthetic oligonucleotide
cuccaggccaaauuugga

SEQ ID NO: 50988 - RNA, 18 nt, Artificial Sequence
  Description of Artificial Sequence: Synthetic oligonucleotide
aaggccuccaggccaaau

SEQ ID NO: 50989 - RNA, 18 nt, Artificial Sequence
  Description of Artificial Sequence: Synthetic oligonucleotide
cagagaaggccuccaggc

SEQ ID NO: 50990 - RNA, 18 nt, Artificial Sequence
  Description of Artificial Sequence: Synthetic oligonucleotide
gcugucagagaaggccuc

SEQ ID NO: 50991 - RNA, 18 nt, Artificial Sequence
  Description of Artificial Sequence: Synthetic oligonucleotide
cucaggcugucagagaag

SEQ ID NO: 50992 - RNA, 18 nt, Artificial Sequence
  Description of Artificial Sequence: Synthetic oligonucleotide
agguaggugaggaggaag

SEQ ID NO: 50993 - RNA, 18 nt, Artificial Sequence
  Description of Artificial Sequence: Synthetic oligonucleotide
ggagcagguaggugagga

SEQ ID NO: 50994 - RNA, 18 nt, Artificial Sequence
  Description of Artificial Sequence: Synthetic oligonucleotide
cuccaggagcagguaggu

SEQ ID NO: 50995 - RNA, 18 nt, Artificial Sequence
  Description of Artificial Sequence: Synthetic oligonucleotide
agccgcuccaggagcagg

SEQ ID NO: 50996 - RNA, 18 nt, Artificial Sequence
  Description of Artificial Sequence: Synthetic oligonucleotide
ccuuuagccgcuccagga

SEQ ID NO: 50997 - RNA, 18 nt, Artificial Sequence
  Description of Artificial Sequence: Synthetic oligonucleotide
agacaccuuuagccgcuc

SEQ ID NO: 50998 - RNA, 18 nt, Artificial Sequence
  Description of Artificial Sequence: Synthetic oligonucleotide
uuaaccacccgugcaggg

SEQ ID NO: 50999 - RNA, 18 nt, Artificial Sequence
  Description of Artificial Sequence: Synthetic oligonucleotide
acacauuaaccacccgug

SEQ ID NO: 51000 - RNA, 18 nt, Artificial Sequence
  Description of Artificial Sequence: Synthetic oligonucleotide
cgaggacacauuaaccac

SEQ ID NO: 51001 - RNA, 18 nt, Artificial Sequence
  Description of Artificial Sequence: Synthetic oligonucleotide
gccaccgaggacacauua

SEQ ID NO: 51002 - RNA, 18 nt, Artificial Sequence
  Description of Artificial Sequence: Synthetic oligonucleotide
ggugagccaccgaggaca

SEQ ID NO: 51003 - RNA, 18 nt, Artificial Sequence
  Description of Artificial Sequence: Synthetic oligonucleotide
aauguggugagccaccga

SEQ ID NO: 51004 - RNA, 18 nt, Artificial Sequence
  Description of Artificial Sequence: Synthetic oligonucleotide
uugccaauguggugagcc

SEQ ID NO: 51005 - RNA, 18 nt, Artificial Sequence
  Description of Artificial Sequence: Synthetic oligonucleotide
gaaucuugccaauguggu

SEQ ID NO: 51006 - RNA, 18 nt, Artificial Sequence
  Description of Artificial Sequence: Synthetic oligonucleotide
gaagggaaucuugccaau

SEQ ID NO: 51007 - RNA, 18 nt, Artificial Sequence
  Description of Artificial Sequence: Synthetic oligonucleotide
ucguggaagggaaucuug

SEQ ID NO: 51008 - RNA, 18 nt, Artificial Sequence
  Description of Artificial Sequence: Synthetic oligonucleotide
ggaggucguggaagggaa

SEQ ID NO: 51009 - RNA, 18 nt, Artificial Sequence
  Description of Artificial Sequence: Synthetic oligonucleotide
gcucuggaggucguggaa

SEQ ID NO: 51010 - RNA, 18 nt, Artificial Sequence
  Description of Artificial Sequence: Synthetic oligonucleotide
uucucgcucuggaggucg

SEQ ID NO: 51011 - RNA, 18 nt, Artificial Sequence
  Description of Artificial Sequence: Synthetic oligonucleotide
agcgcuucucgcucugga

SEQ ID NO: 51012 - RNA, 18 nt, Artificial Sequence
  Description of Artificial Sequence: Synthetic oligonucleotide
gcuguagcgcuucucgcu

SEQ ID NO: 51013 - RNA, 18 nt, Artificial Sequence
  Description of Artificial Sequence: Synthetic oligonucleotide
ccccugcuguagcgcuuc

SEQ ID NO: 51014 - RNA, 18 nt, Artificial Sequence
  Description of Artificial Sequence: Synthetic oligonucleotide
caaaaccccugcuguagc

SEQ ID NO: 51015 - RNA, 18 nt, Artificial Sequence
  Description of Artificial Sequence: Synthetic oligonucleotide
auaggcaaaaccccugcu

SEQ ID NO: 51016 - RNA, 18 nt, Artificial Sequence
  Description of Artificial Sequence: Synthetic oligonucleotide
uggcaauaggcaaaaccc

SEQ ID NO: 51017 - RNA, 18 nt, Artificial Sequence
  Description of Artificial Sequence: Synthetic oligonucleotide
ugcuguggcaauaggcaa

SEQ ID NO: 51018 - RNA, 18 nt, Artificial Sequence
  Description of Artificial Sequence: Synthetic oligonucleotide
cagcuugcuguggcaaua

SEQ ID NO: 51019 - RNA, 18 nt, Artificial Sequence
  Description of Artificial Sequence: Synthetic oligonucleotide
uuggccagcuugcugugg

SEQ ID NO: 51020 - RNA, 18 nt, Artificial Sequence
  Description of Artificial Sequence: Synthetic oligonucleotide
gcacauuggccagcuugc

SEQ ID NO: 51021 - RNA, 18 nt, Artificial Sequence
  Description of Artificial Sequence: Synthetic oligonucleotide
aaaaagcacauuggccag

SEQ ID NO: 51022 - RNA, 18 nt, Artificial Sequence
  Description of Artificial Sequence: Synthetic oligonucleotide
cgaguaaaaagcacauug

SEQ ID NO: 51023 - RNA, 18 nt, Artificial Sequence
  Description of Artificial Sequence: Synthetic oligonucleotide
gcucacgaguaaaaagca

SEQ ID NO: 51024 - RNA, 18 nt, Artificial Sequence
  Description of Artificial Sequence: Synthetic oligonucleotide
ggccagcucacgaguaaa

SEQ ID NO: 51025 - RNA, 18 nt, Artificial Sequence
  Description of Artificial Sequence: Synthetic oligonucleotide
cucuuggccagcucacga

SEQ ID NO: 51026 - RNA, 18 nt, Artificial Sequence
  Description of Artificial Sequence: Synthetic oligonucleotide
ggagccucuuggccagcu

SEQ ID NO: 51027 - RNA, 18 nt, Artificial Sequence
  Description of Artificial Sequence: Synthetic oligonucleotide
uauuccucuuucuccaga

SEQ ID NO: 51028 - RNA, 18 nt, Artificial Sequence
  Description of Artificial Sequence: Synthetic oligonucleotide
uuugcuauuccucuuucu

SEQ ID NO: 51029 - RNA, 18 nt, Artificial Sequence
  Description of Artificial Sequence: Synthetic oligonucleotide
ccauuuuugcuauuccuc

SEQ ID NO: 51030 - RNA, 18 nt, Artificial Sequence
  Description of Artificial Sequence: Synthetic oligonucleotide
gaggaccauuuuugcuau

SEQ ID NO: 51031 - RNA, 18 nt, Artificial Sequence
  Description of Artificial Sequence: Synthetic oligonucleotide
ggucugaggaccauuuuu

SEQ ID NO: 51032 - RNA, 18 nt, Artificial Sequence
  Description of Artificial Sequence: Synthetic oligonucleotide
aauuuggucugaggacca

SEQ ID NO: 51033 - RNA, 18 nt, Artificial Sequence
  Description of Artificial Sequence: Synthetic oligonucleotide
ccucuaauuuggucugag

SEQ ID NO: 51034 - RNA, 18 nt, Artificial Sequence
  Description of Artificial Sequence: Synthetic oligonucleotide
guggaccucuaauuuggu

SEQ ID NO: 51035 - RNA, 18 nt, Artificial Sequence
  Description of Artificial Sequence: Synthetic oligonucleotide
uugcuguggaccucuaau

SEQ ID NO: 51036 - RNA, 18 nt, Artificial Sequence
  Description of Artificial Sequence: Synthetic oligonucleotide
ccaaguugcuguggaccu

SEQ ID NO: 51037 - RNA, 18 nt, Artificial Sequence
  Description of Artificial Sequence: Synthetic oligonucleotide
acuucccaaguugcugug

SEQ ID NO: 51038 - RNA, 18 nt, Artificial Sequence
  Description of Artificial Sequence: Synthetic oligonucleotide
gccugacuucccaaguug

SEQ ID NO: 51039 - RNA, 18 nt, Artificial Sequence
  Description of Artificial Sequence: Synthetic oligonucleotide
ugacagccugacuuccca

SEQ ID NO: 51040 - RNA, 18 nt, Artificial Sequence
  Description of Artificial Sequence: Synthetic oligonucleotide
auguuugacagccugacu

SEQ ID NO: 51041 - RNA, 18 nt, Artificial Sequence
  Description of Artificial Sequence: Synthetic oligonucleotide
cgugcauguuugacagcc

SEQ ID NO: 51042 - RNA, 18 nt, Artificial Sequence
  Description of Artificial Sequence: Synthetic oligonucleotide
ugacacgugcauguuuga

SEQ ID NO: 51043 - RNA, 18 nt, Artificial Sequence
  Description of Artificial Sequence: Synthetic oligonucleotide
auuacugacacgugcaug

SEQ ID NO: 51044 - RNA, 18 nt, Artificial Sequence
  Description of Artificial Sequence: Synthetic oligonucleotide
gagauauuacugacacgu

SEQ ID NO: 51045 - RNA, 18 nt, Artificial Sequence
  Description of Artificial Sequence: Synthetic oligonucleotide
ccacagagauauuacuga

SEQ ID NO: 51046 - RNA, 18 nt, Artificial Sequence
  Description of Artificial Sequence: Synthetic oligonucleotide
uuaguccacagagauauu

SEQ ID NO: 51047 - RNA, 18 nt, Artificial Sequence
  Description of Artificial Sequence: Synthetic oligonucleotide
ucuccuuaguccacagag

SEQ ID NO: 51048 - RNA, 18 nt, Artificial Sequence
  Description of Artificial Sequence: Synthetic oligonucleotide
uucauucuccuuagucca

SEQ ID NO: 51049 - RNA, 18 nt, Artificial Sequence
  Description of Artificial Sequence: Synthetic oligonucleotide
auaauuucauucuccuua

SEQ ID NO: 51050 - RNA, 18 nt, Artificial Sequence
  Description of Artificial Sequence: Synthetic oligonucleotide
cauucauaauuucauucu

SEQ ID NO: 51051 - RNA, 18 nt, Artificial Sequence
  Description of Artificial Sequence: Synthetic oligonucleotide
uauuccauucauaauuuc

SEQ ID NO: 51052 - RNA, 18 nt, Artificial Sequence
  Description of Artificial Sequence: Synthetic oligonucleotide
guuuuuauuccauucaua

SEQ ID NO: 51053 - RNA, 18 nt, Artificial Sequence
  Description of Artificial Sequence: Synthetic oligonucleotide
acucuguuuuuauuccau

SEQ ID NO: 51054 - RNA, 18 nt, Artificial Sequence
  Description of Artificial Sequence: Synthetic oligonucleotide
caagcacucuguuuuuau

SEQ ID NO: 51055 - RNA, 18 nt, Artificial Sequence
  Description of Artificial Sequence: Synthetic oligonucleotide
gggcaagcacucuguuuu

SEQ ID NO: 51056 - RNA, 18 nt, Artificial Sequence
  Description of Artificial Sequence: Synthetic oligonucleotide
gauuuuaagcucccuggg

SEQ ID NO: 51057 - RNA, 18 nt, Artificial Sequence
  Description of Artificial Sequence: Synthetic oligonucleotide
uauuugauuuuaagcucc

SEQ ID NO: 51058 - RNA, 18 nt, Artificial Sequence
  Description of Artificial Sequence: Synthetic oligonucleotide
accccuauuugauuuuaa

SEQ ID NO: 51059 - RNA, 18 nt, Artificial Sequence
  Description of Artificial Sequence: Synthetic oligonucleotide
ucuuaaccccuauuugau

SEQ ID NO: 51060 - RNA, 18 nt, Artificial Sequence
  Description of Artificial Sequence: Synthetic oligonucleotide
gagguucuuaaccccuau

SEQ ID NO: 51061 - RNA, 18 nt, Artificial Sequence
  Description of Artificial Sequence: Synthetic oligonucleotide
uuuuugagguucuuaacc

SEQ ID NO: 51062 - RNA, 18 nt, Artificial Sequence
  Description of Artificial Sequence: Synthetic oligonucleotide
guaacuuuuugagguucu

SEQ ID NO: 51063 - RNA, 18 nt, Artificial Sequence
  Description of Artificial Sequence: Synthetic oligonucleotide
acaagguaacuuuuugag

SEQ ID NO: 51064 - RNA, 18 nt, Artificial Sequence
  Description of Artificial Sequence: Synthetic oligonucleotide
caaauacaagguaacuuu

SEQ ID NO: 51065 - RNA, 18 nt, Artificial Sequence
  Description of Artificial Sequence: Synthetic oligonucleotide
ugacacaaauacaaggua

SEQ ID NO: 51066 - RNA, 18 nt, Artificial Sequence
  Description of Artificial Sequence: Synthetic oligonucleotide
agaugugacacaaauaca

SEQ ID NO: 51067 - RNA, 18 nt, Artificial Sequence
  Description of Artificial Sequence: Synthetic oligonucleotide
agauaagaugugacacaa

SEQ ID NO: 51068 - RNA, 18 nt, Artificial Sequence
  Description of Artificial Sequence: Synthetic oligonucleotide
auaagagauaagauguga

SEQ ID NO: 51069 - RNA, 18 nt, Artificial Sequence
  Description of Artificial Sequence: Synthetic oligonucleotide
augagauaagagauaaga

SEQ ID NO: 51070 - RNA, 18 nt, Artificial Sequence
  Description of Artificial Sequence: Synthetic oligonucleotide
aucaaaugagauaagaga

SEQ ID NO: 51071 - RNA, 18 nt, Artificial Sequence
  Description of Artificial Sequence: Synthetic oligonucleotide
ugaaaaucaaaugagaua

SEQ ID NO: 51072 - RNA, 18 nt, Artificial Sequence
  Description of Artificial Sequence: Synthetic oligonucleotide
uacugugaaaaucaaaug

SEQ ID NO: 51073 - RNA, 18 nt, Artificial Sequence
  Description of Artificial Sequence: Synthetic oligonucleotide
aaagcuacugugaaaauc

SEQ ID NO: 51074 - RNA, 18 nt, Artificial Sequence
  Description of Artificial Sequence: Synthetic oligonucleotide
ugcaaaaagcuacuguga

SEQ ID NO: 51075 - RNA, 18 nt, Artificial Sequence
  Description of Artificial Sequence: Synthetic oligonucleotide
ucuguugcaaaaagcuac

SEQ ID NO: 51076 - RNA, 18 nt, Artificial Sequence
  Description of Artificial Sequence: Synthetic oligonucleotide
cucugucuguugcaaaaa

SEQ ID NO: 51077 - RNA, 18 nt, Artificial Sequence
  Description of Artificial Sequence: Synthetic oligonucleotide
aaagccucugucuguugc

SEQ ID NO: 51078 - RNA, 18 nt, Artificial Sequence
  Description of Artificial Sequence: Synthetic oligonucleotide
aacaaaaagccucugucu

SEQ ID NO: 51079 - RNA, 18 nt, Artificial Sequence
  Description of Artificial Sequence: Synthetic oligonucleotide
aaaaaaacaaaaagccuc

SEQ ID NO: 51080 - RNA, 18 nt, Artificial Sequence
  Description of Artificial Sequence: Synthetic oligonucleotide
aaacaaaaaaaacaaaaa

SEQ ID NO: 51081 - RNA, 18 nt, Artificial Sequence
  Description of Artificial Sequence: Synthetic oligonucleotide
aaaaaaaacaaaaaaaac

SEQ ID NO: 51082 - RNA, 18 nt, Artificial Sequence
  Description of Artificial Sequence: Synthetic oligonucleotide
aaaaaaaaaaaaacaaaa

SEQ ID NO: 51083 - RNA, 18 nt, Artificial Sequence
  Description of Artificial Sequence: Synthetic oligonucleotide
gucucaaaaaaaaaaaaa

SEQ ID NO: 51084 - RNA, 18 nt, Artificial Sequence
  Description of Artificial Sequence: Synthetic oligonucleotide
cucaagucucaaaaaaaa

SEQ ID NO: 51085 - RNA, 18 nt, Artificial Sequence
  Description of Artificial Sequence: Synthetic oligonucleotide
cgaaacucaagucucaaa

SEQ ID NO: 51086 - RNA, 18 nt, Artificial Sequence
  Description of Artificial Sequence: Synthetic oligonucleotide
aagagcgaaacucaaguc

SEQ ID NO: 51087 - RNA, 18 nt, Artificial Sequence
  Description of Artificial Sequence: Synthetic oligonucleotide
gcgacaagagcgaaacuc

SEQ ID NO: 51088 - RNA, 18 nt, Artificial Sequence
  Description of Artificial Sequence: Synthetic oligonucleotide
ccugggcgacaagagcga

SEQ ID NO: 51089 - RNA, 18 nt, Artificial Sequence
  Description of Artificial Sequence: Synthetic oligonucleotide
uccagccugggcgacaag

SEQ ID NO: 51090 - RNA, 18 nt, Artificial Sequence
  Description of Artificial Sequence: Synthetic oligonucleotide
ugcacuccagccugggcg

SEQ ID NO: 51091 - RNA, 18 nt, Artificial Sequence
  Description of Artificial Sequence: Synthetic oligonucleotide
acuacugcacuccagccu

SEQ ID NO: 51092 - RNA, 18 nt, Artificial Sequence
  Description of Artificial Sequence: Synthetic oligonucleotide
aucgcacuacugcacucc

SEQ ID NO: 51093 - RNA, 18 nt, Artificial Sequence
  Description of Artificial Sequence: Synthetic oligonucleotide
ccaagaucgcacuacugc

SEQ ID NO: 51094 - RNA, 18 nt, Artificial Sequence
  Description of Artificial Sequence: Synthetic oligonucleotide
gugagccaagaucgcacu

SEQ ID NO: 51095 - RNA, 18 nt, Artificial Sequence
  Description of Artificial Sequence: Synthetic oligonucleotide
ucgcagugagccaagauc

SEQ ID NO: 51096 - RNA, 18 nt, Artificial Sequence
  Description of Artificial Sequence: Synthetic oligonucleotide
agaggucgcagugagcca

SEQ ID NO: 51097 - RNA, 18 nt, Artificial Sequence
  Description of Artificial Sequence: Synthetic oligonucleotide
gaggcagaggucgcagug

SEQ ID NO: 51098 - RNA, 18 nt, Artificial Sequence
  Description of Artificial Sequence: Synthetic oligonucleotide
cccaggaggcagaggucg

SEQ ID NO: 51099 - RNA, 18 nt, Artificial Sequence
  Description of Artificial Sequence: Synthetic oligonucleotide
uugaacccaggaggcaga

SEQ ID NO: 51100 - RNA, 18 nt, Artificial Sequence
  Description of Artificial Sequence: Synthetic oligonucleotide
aucacuugaacccaggag

SEQ ID NO: 51101 - RNA, 18 nt, Artificial Sequence
  Description of Artificial Sequence: Synthetic oligonucleotide
ggagaaucacuugaaccc

SEQ ID NO: 51102 - RNA, 18 nt, Artificial Sequence
  Description of Artificial Sequence: Synthetic oligonucleotide
augcaggagaaucacuug

SEQ ID NO: 51103 - RNA, 18 nt, Artificial Sequence
  Description of Artificial Sequence: Synthetic oligonucleotide
ggcugaugcaggagaauc

SEQ ID NO: 51104 - RNA, 18 nt, Artificial Sequence
  Description of Artificial Sequence: Synthetic oligonucleotide
caagaggcugaugcagga

SEQ ID NO: 51105 - RNA, 18 nt, Artificial Sequence
  Description of Artificial Sequence: Synthetic oligonucleotide
cuacucaagaggcugaug

SEQ ID NO: 51106 - RNA, 18 nt, Artificial Sequence
  Description of Artificial Sequence: Synthetic oligonucleotide
cccaacuacucaagaggc

SEQ ID NO: 51107 - RNA, 18 nt, Artificial Sequence
  Description of Artificial Sequence: Synthetic oligonucleotide
guaaucccaacuacucaa

SEQ ID NO: 51108 - RNA, 18 nt, Artificial Sequence
  Description of Artificial Sequence: Synthetic oligonucleotide
ugcuuguaaucccaacua

SEQ ID NO: 51109 - RNA, 18 nt, Artificial Sequence
  Description of Artificial Sequence: Synthetic oligonucleotide
uugcgugcuuguaauccc

SEQ ID NO: 51110 - RNA, 18 nt, Artificial Sequence
  Description of Artificial Sequence: Synthetic oligonucleotide
ugauauugcgugcuugua

SEQ ID NO: 51111 - RNA, 18 nt, Artificial Sequence
  Description of Artificial Sequence: Synthetic oligonucleotide
aggcgugauauugcgugc

SEQ ID NO: 51112 - RNA, 18 nt, Artificial Sequence
  Description of Artificial Sequence: Synthetic oligonucleotide
uagccaggcgugauauug

SEQ ID NO: 51113 - RNA, 18 nt, Artificial Sequence
  Description of Artificial Sequence: Synthetic oligonucleotide
aaaauuagccaggcguga

SEQ ID NO: 51114 - RNA, 18 nt, Artificial Sequence
  Description of Artificial Sequence: Synthetic oligonucleotide
aauacaaaauuagccagg

SEQ ID NO: 51115 - RNA, 18 nt, Artificial Sequence
  Description of Artificial Sequence: Synthetic oligonucleotide
cuaaaaauacaaaauuag

SEQ ID NO: 51116 - RNA, 18 nt, Artificial Sequence
  Description of Artificial Sequence: Synthetic oligonucleotide
cucuucuaaaaauacaaa

SEQ ID NO: 51117 - RNA, 18 nt, Artificial Sequence
  Description of Artificial Sequence: Synthetic oligonucleotide
cucgucucuucuaaaaau

SEQ ID NO: 51118 - RNA, 18 nt, Artificial Sequence
  Description of Artificial Sequence: Synthetic oligonucleotide
gaaagcucgucucuucua

SEQ ID NO: 51119 - RNA, 18 nt, Artificial Sequence
  Description of Artificial Sequence: Synthetic oligonucleotide
auggugaaagcucgucuc

SEQ ID NO: 51120 - RNA, 18 nt, Artificial Sequence
  Description of Artificial Sequence: Synthetic oligonucleotide
acaacauggugaaagcuc

SEQ ID NO: 51121 - RNA, 18 nt, Artificial Sequence
  Description of Artificial Sequence: Synthetic oligonucleotide
ccuggacaacauggugaa

SEQ ID NO: 51122 - RNA, 18 nt, Artificial Sequence
  Description of Artificial Sequence: Synthetic oligonucleotide
accaaccuggacaacaug

SEQ ID NO: 51123 - RNA, 18 nt, Artificial Sequence
  Description of Artificial Sequence: Synthetic oligonucleotide
uugagaccaaccuggaca

SEQ ID NO: 51124 - RNA, 18 nt, Artificial Sequence
  Description of Artificial Sequence: Synthetic oligonucleotide
ccuggugcggucacuauu

SEQ ID NO: 51125 - RNA, 18 nt, Artificial Sequence
  Description of Artificial Sequence: Synthetic oligonucleotide
auaucccuggugcgguca

SEQ ID NO: 51126 - RNA, 18 nt, Artificial Sequence
  Description of Artificial Sequence: Synthetic oligonucleotide
acaagauaucccuggugc

SEQ ID NO: 51127 - RNA, 18 nt, Artificial Sequence
  Description of Artificial Sequence: Synthetic oligonucleotide
cccccacaagauaucccu

SEQ ID NO: 51128 - RNA, 18 nt, Artificial Sequence
  Description of Artificial Sequence: Synthetic oligonucleotide
ccccccccccacaagaua

SEQ ID NO: 51129 - RNA, 18 nt, Artificial Sequence
  Description of Artificial Sequence: Synthetic oligonucleotide
uaacaccccccccccaca

SEQ ID NO: 51130 - RNA, 18 nt, Artificial Sequence
  Description of Artificial Sequence: Synthetic oligonucleotide
gggauuaacacccccccc

SEQ ID NO: 51131 - RNA, 18 nt, Artificial Sequence
  Description of Artificial Sequence: Synthetic oligonucleotide
ggugaugcagauuguggg

SEQ ID NO: 51132 - RNA, 18 nt, Artificial Sequence
  Description of Artificial Sequence: Synthetic oligonucleotide
gauggugaugcagauugu

SEQ ID NO: 51133 - RNA, 18 nt, Artificial Sequence
  Description of Artificial Sequence: Synthetic oligonucleotide
ugagggauggugaugcag

SEQ ID NO: 51134 - RNA, 18 nt, Artificial Sequence
  Description of Artificial Sequence: Synthetic oligonucleotide
uagauugagggaugguga

SEQ ID NO: 51135 - RNA, 18 nt, Artificial Sequence
  Description of Artificial Sequence: Synthetic oligonucleotide
agguauagauugagggau

SEQ ID NO: 51136 - RNA, 18 nt, Artificial Sequence
  Description of Artificial Sequence: Synthetic oligonucleotide
ucaugagguauagauuga

SEQ ID NO: 51137 - RNA, 18 nt, Artificial Sequence
  Description of Artificial Sequence: Synthetic oligonucleotide
acauuucaugagguauag

SEQ ID NO: 51138 - RNA, 18 nt, Artificial Sequence
  Description of Artificial Sequence: Synthetic oligonucleotide
caagcacauuucaugagg

SEQ ID NO: 51139 - RNA, 18 nt, Artificial Sequence
  Description of Artificial Sequence: Synthetic oligonucleotide
ccuggcaagcacauuuca

SEQ ID NO: 51140 - RNA, 18 nt, Artificial Sequence
  Description of Artificial Sequence: Synthetic oligonucleotide
auuugccuggcaagcaca

SEQ ID NO: 51141 - RNA, 18 nt, Artificial Sequence
  Description of Artificial Sequence: Synthetic oligonucleotide
gcugcauuugccuggcaa

SEQ ID NO: 51142 - RNA, 18 nt, Artificial Sequence
  Description of Artificial Sequence: Synthetic oligonucleotide
uuugagcugcauuugccu

SEQ ID NO: 51143 - RNA, 18 nt, Artificial Sequence
  Description of Artificial Sequence: Synthetic oligonucleotide
uuuauuuugagcugcauu

SEQ ID NO: 51144 - RNA, 18 nt, Artificial Sequence
  Description of Artificial Sequence: Synthetic oligonucleotide
aggacuuuauuuugagcu

SEQ ID NO: 51145 - RNA, 18 nt, Artificial Sequence
  Description of Artificial Sequence: Synthetic oligonucleotide
uggguaggacuuuauuuu

SEQ ID NO: 51146 - RNA, 18 nt, Artificial Sequence
  Description of Artificial Sequence: Synthetic oligonucleotide
ggugguggguaggacuuu

SEQ ID NO: 51147 - RNA, 18 nt, Artificial Sequence
  Description of Artificial Sequence: Synthetic oligonucleotide
uggaaggugguggguagg

SEQ ID NO: 51148 - RNA, 18 nt, Artificial Sequence
  Description of Artificial Sequence: Synthetic oligonucleotide
cugauuggaagguggugg

SEQ ID NO: 51149 - RNA, 18 nt, Artificial Sequence
  Description of Artificial Sequence: Synthetic oligonucleotide
gcgaucugauuggaaggu

SEQ ID NO: 51150 - RNA, 18 nt, Artificial Sequence
  Description of Artificial Sequence: Synthetic oligonucleotide
ggguagcgaucugauugg

SEQ ID NO: 51151 - RNA, 18 nt, Artificial Sequence
  Description of Artificial Sequence: Synthetic oligonucleotide
uaaaggaggaguuuaggg

SEQ ID NO: 51152 - RNA, 18 nt, Artificial Sequence
  Description of Artificial Sequence: Synthetic oligonucleotide
cuaaaggaggaguuuagg

SEQ ID NO: 51153 - RNA, 18 nt, Artificial Sequence
  Description of Artificial Sequence: Synthetic oligonucleotide
cauuucuaaaggaggagu

SEQ ID NO: 51154 - RNA, 18 nt, Artificial Sequence
  Description of Artificial Sequence: Synthetic oligonucleotide
uuuaucauuucuaaagga

SEQ ID NO: 51155 - RNA, 18 nt, Artificial Sequence
  Description of Artificial Sequence: Synthetic oligonucleotide
guaucuuuaucauuucua

SEQ ID NO: 51156 - RNA, 18 nt, Artificial Sequence
  Description of Artificial Sequence: Synthetic oligonucleotide
cagugguaucuuuaucau

SEQ ID NO: 51157 - RNA, 18 nt, Artificial Sequence
  Description of Artificial Sequence: Synthetic oligonucleotide
auugacagugguaucuuu

SEQ ID NO: 51158 - RNA, 18 nt, Artificial Sequence
  Description of Artificial Sequence: Synthetic oligonucleotide
caaucauugacaguggua

SEQ ID NO: 51159 - RNA, 18 nt, Artificial Sequence
  Description of Artificial Sequence: Synthetic oligonucleotide
aguaucaaucauugacag

SEQ ID NO: 51160 - RNA, 18 nt, Artificial Sequence
  Description of Artificial Sequence: Synthetic oligonucleotide
ugaguaguaucaaucauu

SEQ ID NO: 51161 - RNA, 18 nt, Artificial Sequence
  Description of Artificial Sequence: Synthetic oligonucleotide
uguagugaguaguaucaa

SEQ ID NO: 51162 - RNA, 18 nt, Artificial Sequence
  Description of Artificial Sequence: Synthetic oligonucleotide
caacauguagugaguagu

SEQ ID NO: 51163 - RNA, 18 nt, Artificial Sequence
  Description of Artificial Sequence: Synthetic oligonucleotide
caugacaacauguaguga

SEQ ID NO: 51164 - RNA, 18 nt, Artificial Sequence
  Description of Artificial Sequence: Synthetic oligonucleotide
auaaacaugacaacaugu

SEQ ID NO: 51165 - RNA, 18 nt, Artificial Sequence
  Description of Artificial Sequence: Synthetic oligonucleotide
uacuaauaaacaugacaa

SEQ ID NO: 51166 - RNA, 18 nt, Artificial Sequence
  Description of Artificial Sequence: Synthetic oligonucleotide
aguacuacuaauaaacau

SEQ ID NO: 51167 - RNA, 18 nt, Artificial Sequence
  Description of Artificial Sequence: Synthetic oligonucleotide
gcuuuaguacuacuaaua

SEQ ID NO: 51168 - RNA, 18 nt, Artificial Sequence
  Description of Artificial Sequence: Synthetic oligonucleotide
cuguggcuuuaguacuac

SEQ ID NO: 51169 - RNA, 18 nt, Artificial Sequence
  Description of Artificial Sequence: Synthetic oligonucleotide
uuauacuguggcuuuagu

SEQ ID NO: 51170 - RNA, 18 nt, Artificial Sequence
  Description of Artificial Sequence: Synthetic oligonucleotide
cguuuuuauacuguggcu

SEQ ID NO: 51171 - RNA, 18 nt, Artificial Sequence
  Description of Artificial Sequence: Synthetic oligonucleotide
aaugucguuuuuauacug

SEQ ID NO: 51172 - RNA, 18 nt, Artificial Sequence
  Description of Artificial Sequence: Synthetic oligonucleotide
auuucaaugucguuuuua

SEQ ID NO: 51173 - RNA, 18 nt, Artificial Sequence
  Description of Artificial Sequence: Synthetic oligonucleotide
cuucuauuucaaugucgu

SEQ ID NO: 51174 - RNA, 18 nt, Artificial Sequence
  Description of Artificial Sequence: Synthetic oligonucleotide
agguccuucuauuucaau

SEQ ID NO: 51175 - RNA, 18 nt, Artificial Sequence
  Description of Artificial Sequence: Synthetic oligonucleotide
guucgagguccuucuauu

SEQ ID NO: 51176 - RNA, 18 nt, Artificial Sequence
  Description of Artificial Sequence: Synthetic oligonucleotide
gccugguucgagguccuu

SEQ ID NO: 51177 - RNA, 18 nt, Artificial Sequence
  Description of Artificial Sequence: Synthetic oligonucleotide
ggagugccugguucgagg

SEQ ID NO: 51178 - RNA, 18 nt, Artificial Sequence
  Description of Artificial Sequence: Synthetic oligonucleotide
caaaaggagugccugguu

SEQ ID NO: 51179 - RNA, 18 nt, Artificial Sequence
  Description of Artificial Sequence: Synthetic oligonucleotide
uguuccaaaaggagugcc

SEQ ID NO: 51180 - RNA, 18 nt, Artificial Sequence
  Description of Artificial Sequence: Synthetic oligonucleotide
uucuauguuccaaaagga

SEQ ID NO: 51181 - RNA, 18 nt, Artificial Sequence
  Description of Artificial Sequence: Synthetic oligonucleotide
cagccuucuauguuccaa

SEQ ID NO: 51182 - RNA, 18 nt, Artificial Sequence
  Description of Artificial Sequence: Synthetic oligonucleotide
cuucucagccuucuaugu

SEQ ID NO: 51183 - RNA, 18 nt, Artificial Sequence
  Description of Artificial Sequence: Synthetic oligonucleotide
auagccuucucagccuuc

SEQ ID NO: 51184 - RNA, 18 nt, Artificial Sequence
  Description of Artificial Sequence: Synthetic oligonucleotide
gaucuauagccuucucag

SEQ ID NO: 51185 - RNA, 18 nt, Artificial Sequence
  Description of Artificial Sequence: Synthetic oligonucleotide
agaaagaucuauagccuu

SEQ ID NO: 51186 - RNA, 18 nt, Artificial Sequence
  Description of Artificial Sequence: Synthetic oligonucleotide
cuuucagaaagaucuaua

SEQ ID NO: 51187 - RNA, 18 nt, Artificial Sequence
  Description of Artificial Sequence: Synthetic oligonucleotide
uugaucuuucagaaagau

SEQ ID NO: 51188 - RNA, 18 nt, Artificial Sequence
  Description of Artificial Sequence: Synthetic oligonucleotide
augaauugaucuuucaga

SEQ ID NO: 51189 - RNA, 18 nt, Artificial Sequence
  Description of Artificial Sequence: Synthetic oligonucleotide
caggaaugaauugaucuu

SEQ ID NO: 51190 - RNA, 18 nt, Artificial Sequence
  Description of Artificial Sequence: Synthetic oligonucleotide
uugaacaggaaugaauug

SEQ ID NO: 51191 - RNA, 18 nt, Artificial Sequence
  Description of Artificial Sequence: Synthetic oligonucleotide
ggaauuugaacaggaaug

SEQ ID NO: 51192 - RNA, 18 nt, Artificial Sequence
  Description of Artificial Sequence: Synthetic oligonucleotide
caggcggaauuugaacag

SEQ ID NO: 51193 - RNA, 18 nt, Artificial Sequence
  Description of Artificial Sequence: Synthetic oligonucleotide
cuggccaggcggaauuug

SEQ ID NO: 51194 - RNA, 18 nt, Artificial Sequence
  Description of Artificial Sequence: Synthetic oligonucleotide
cacuccuggccaggcgga

SEQ ID NO: 51195 - RNA, 18 nt, Artificial Sequence
  Description of Artificial Sequence: Synthetic oligonucleotide
gguaccacuccuggccag

SEQ ID NO: 51196 - RNA, 18 nt, Artificial Sequence
  Description of Artificial Sequence: Synthetic oligonucleotide
cagcagguaccacuccug

SEQ ID NO: 51197 - RNA, 18 nt, Artificial Sequence
  Description of Artificial Sequence: Synthetic oligonucleotide
ggauucagcagguaccac

SEQ ID NO: 51198 - RNA, 18 nt, Artificial Sequence
  Description of Artificial Sequence: Synthetic oligonucleotide
ccccaggauucagcaggu

SEQ ID NO: 51199 - RNA, 18 nt, Artificial Sequence
  Description of Artificial Sequence: Synthetic oligonucleotide
cauaaccccaggauucag

SEQ ID NO: 51200 - RNA, 18 nt, Artificial Sequence
  Description of Artificial Sequence: Synthetic oligonucleotide
ggaaacauaaccccagga

SEQ ID NO: 51201 - RNA, 18 nt, Artificial Sequence
  Description of Artificial Sequence: Synthetic oligonucleotide
acucaggaaacauaaccc

SEQ ID NO: 51202 - RNA, 18 nt, Artificial Sequence
  Description of Artificial Sequence: Synthetic oligonucleotide
gagggacucaggaaacau

SEQ ID NO: 51203 - RNA, 18 nt, Artificial Sequence
  Description of Artificial Sequence: Synthetic oligonucleotide
agaaggagggacucagga

SEQ ID NO: 51204 - RNA, 18 nt, Artificial Sequence
  Description of Artificial Sequence: Synthetic oligonucleotide
aagugagaaggagggacu

SEQ ID NO: 51205 - RNA, 18 nt, Artificial Sequence
  Description of Artificial Sequence: Synthetic oligonucleotide
uacacaagugagaaggag

SEQ ID NO: 51206 - RNA, 18 nt, Artificial Sequence
  Description of Artificial Sequence: Synthetic oligonucleotide
caaaauacacaagugaga

SEQ ID NO: 51207 - RNA, 18 nt, Artificial Sequence
  Description of Artificial Sequence: Synthetic oligonucleotide
ugcagcaaaauacacaag

SEQ ID NO: 51208 - RNA, 18 nt, Artificial Sequence
  Description of Artificial Sequence: Synthetic oligonucleotide
ucuccugcagcaaaauac

SEQ ID NO: 51209 - RNA, 18 nt, Artificial Sequence
  Description of Artificial Sequence: Synthetic oligonucleotide
gcuuaucuccugcagcaa

SEQ ID NO: 51210 - RNA, 18 nt, Artificial Sequence
  Description of Artificial Sequence: Synthetic oligonucleotide
aaacagcuuaucuccugc

SEQ ID NO: 51211 - RNA, 18 nt, Artificial Sequence
  Description of Artificial Sequence: Synthetic oligonucleotide
caggaaaacagcuuaucu

SEQ ID NO: 51212 - RNA, 18 nt, Artificial Sequence
  Description of Artificial Sequence: Synthetic oligonucleotide
gagcccaggaaaacagcu

SEQ ID NO: 51213 - RNA, 18 nt, Artificial Sequence
  Description of Artificial Sequence: Synthetic oligonucleotide
acucugagcccaggaaaa

SEQ ID NO: 51214 - RNA, 18 nt, Artificial Sequence
  Description of Artificial Sequence: Synthetic oligonucleotide
gacacacucugagcccag

SEQ ID NO: 51215 - RNA, 18 nt, Artificial Sequence
  Description of Artificial Sequence: Synthetic oligonucleotide
ucagggacacacucugag

SEQ ID NO: 51216 - RNA, 18 nt, Artificial Sequence
  Description of Artificial Sequence: Synthetic oligonucleotide
uuagaucagggacacacu

SEQ ID NO: 51217 - RNA, 18 nt, Artificial Sequence
  Description of Artificial Sequence: Synthetic oligonucleotide
cacaauuagaucagggac

SEQ ID NO: 51218 - RNA, 18 nt, Artificial Sequence
  Description of Artificial Sequence: Synthetic oligonucleotide
uagguggugaccccggug

SEQ ID NO: 51219 - RNA, 18 nt, Artificial Sequence
  Description of Artificial Sequence: Synthetic oligonucleotide
cugcguagguggugaccc

SEQ ID NO: 51220 - RNA, 18 nt, Artificial Sequence
  Description of Artificial Sequence: Synthetic oligonucleotide
gugcacugcguagguggu

SEQ ID NO: 51221 - RNA, 18 nt, Artificial Sequence
  Description of Artificial Sequence: Synthetic oligonucleotide
ccugggugcacugcguag

SEQ ID NO: 51222 - RNA, 18 nt, Artificial Sequence
  Description of Artificial Sequence: Synthetic oligonucleotide
cgacgccugggugcacug

SEQ ID NO: 51223 - RNA, 18 nt, Artificial Sequence
  Description of Artificial Sequence: Synthetic oligonucleotide
gcggacgacgccugggug

SEQ ID NO: 51224 - RNA, 18 nt, Artificial Sequence
  Description of Artificial Sequence: Synthetic oligonucleotide
ucagagcggacgacgccu

SEQ ID NO: 51225 - RNA, 18 nt, Artificial Sequence
  Description of Artificial Sequence: Synthetic oligonucleotide
ccagcucagagcggacga

SEQ ID NO: 51226 - RNA, 18 nt, Artificial Sequence
  Description of Artificial Sequence: Synthetic oligonucleotide
ccggaccagcucagagcg

SEQ ID NO: 51227 - RNA, 18 nt, Artificial Sequence
  Description of Artificial Sequence: Synthetic oligonucleotide
gagugccggaccagcuca

SEQ ID NO: 51228 - RNA, 18 nt, Artificial Sequence
  Description of Artificial Sequence: Synthetic oligonucleotide
gggaggagugccggacca

SEQ ID NO: 51229 - RNA, 18 nt, Artificial Sequence
  Description of Artificial Sequence: Synthetic oligonucleotide
gagcagggaggagugccg

SEQ ID NO: 51230 - RNA, 18 nt, Artificial Sequence
  Description of Artificial Sequence: Synthetic oligonucleotide
aggcagagcagggaggag

SEQ ID NO: 51231 - RNA, 18 nt, Artificial Sequence
  Description of Artificial Sequence: Synthetic oligonucleotide
agagcaggcagagcaggg

SEQ ID NO: 51232 - RNA, 18 nt, Artificial Sequence
  Description of Artificial Sequence: Synthetic oligonucleotide
ccgccagagcaggcagag

SEQ ID NO: 51233 - RNA, 18 nt, Artificial Sequence
  Description of Artificial Sequence: Synthetic oligonucleotide
aagagccgccagagcagg

SEQ ID NO: 51234 - RNA, 18 nt, Artificial Sequence
  Description of Artificial Sequence: Synthetic oligonucleotide
gggagaagagccgccaga

SEQ ID NO: 51235 - RNA, 18 nt, Artificial Sequence
  Description of Artificial Sequence: Synthetic oligonucleotide
ccgugccgucuugacaaa

SEQ ID NO: 51236 - RNA, 18 nt, Artificial Sequence
  Description of Artificial Sequence: Synthetic oligonucleotide
cccucccgugccgucuug

SEQ ID NO: 51237 - RNA, 18 nt, Artificial Sequence
  Description of Artificial Sequence: Synthetic oligonucleotide
gcgcccccucccgugccg

SEQ ID NO: 51238 - RNA, 18 nt, Artificial Sequence
  Description of Artificial Sequence: Synthetic oligonucleotide
ggucugcgcccccucccg

SEQ ID NO: 51239 - RNA, 18 nt, Artificial Sequence
  Description of Artificial Sequence: Synthetic oligonucleotide
aggcuggucugcgccccc

SEQ ID NO: 51240 - RNA, 18 nt, Artificial Sequence
  Description of Artificial Sequence: Synthetic oligonucleotide
agugcaggcuggucugcg

SEQ ID NO: 51241 - RNA, 18 nt, Artificial Sequence
  Description of Artificial Sequence: Synthetic oligonucleotide
ggcgcagugcaggcuggu

SEQ ID NO: 51242 - RNA, 18 nt, Artificial Sequence
  Description of Artificial Sequence: Synthetic oligonucleotide
gccagggcgcagugcagg

SEQ ID NO: 51243 - RNA, 18 nt, Artificial Sequence
  Description of Artificial Sequence: Synthetic oligonucleotide
ccucagccagggcgcagu

SEQ ID NO: 51244 - RNA, 18 nt, Artificial Sequence
  Description of Artificial Sequence: Synthetic oligonucleotide
caggcccucagccagggc

SEQ ID NO: 51245 - RNA, 18 nt, Artificial Sequence
  Description of Artificial Sequence: Synthetic oligonucleotide
ggcuccaggcccucagcc

SEQ ID NO: 51246 - RNA, 18 nt, Artificial Sequence
  Description of Artificial Sequence: Synthetic oligonucleotide
gggcuccaggcccucagc

SEQ ID NO: 51247 - RNA, 18 nt, Artificial Sequence
  Description of Artificial Sequence: Synthetic oligonucleotide
aguacuugccacucaggg

SEQ ID NO: 51248 - RNA, 18 nt, Artificial Sequence
  Description of Artificial Sequence: Synthetic oligonucleotide
cuugaggagauuucuccc

SEQ ID NO: 51249 - RNA, 18 nt, Artificial Sequence
  Description of Artificial Sequence: Synthetic oligonucleotide
ucuggcuugaggagauuu

SEQ ID NO: 51250 - RNA, 18 nt, Artificial Sequence
  Description of Artificial Sequence: Synthetic oligonucleotide
caggcucuggcuugagga

SEQ ID NO: 51251 - RNA, 18 nt, Artificial Sequence
  Description of Artificial Sequence: Synthetic oligonucleotide
cagcacaggcucuggcuu

SEQ ID NO: 51252 - RNA, 18 nt, Artificial Sequence
  Description of Artificial Sequence: Synthetic oligonucleotide
ccucacagcacaggcucu

SEQ ID NO: 51253 - RNA, 18 nt, Artificial Sequence
  Description of Artificial Sequence: Synthetic oligonucleotide
aagccccucacagcacag

SEQ ID NO: 51254 - RNA, 18 nt, Artificial Sequence
  Description of Artificial Sequence: Synthetic oligonucleotide
ucccgaagccccucacag

SEQ ID NO: 51255 - RNA, 18 nt, Artificial Sequence
  Description of Artificial Sequence: Synthetic oligonucleotide
caaggucccgaagccccu

SEQ ID NO: 51256 - RNA, 18 nt, Artificial Sequence
  Description of Artificial Sequence: Synthetic oligonucleotide
ugccccaaggucccgaag

SEQ ID NO: 51257 - RNA, 18 nt, Artificial Sequence
  Description of Artificial Sequence: Synthetic oligonucleotide
ggagcugccccaaggucc

SEQ ID NO: 51258 - RNA, 18 nt, Artificial Sequence
  Description of Artificial Sequence: Synthetic oligonucleotide
acucaggagcugccccaa

SEQ ID NO: 51259 - RNA, 18 nt, Artificial Sequence
  Description of Artificial Sequence: Synthetic oligonucleotide
ucugaacucaggagcugc

SEQ ID NO: 51260 - RNA, 18 nt, Artificial Sequence
  Description of Artificial Sequence: Synthetic oligonucleotide
cucugucugaacucagga

SEQ ID NO: 51261 - RNA, 18 nt, Artificial Sequence
  Description of Artificial Sequence: Synthetic oligonucleotide
cugaacucugucugaacu

SEQ ID NO: 51262 - RNA, 18 nt, Artificial Sequence
  Description of Artificial Sequence: Synthetic oligonucleotide
ccuuccugaacucugucu

SEQ ID NO: 51263 - RNA, 18 nt, Artificial Sequence
  Description of Artificial Sequence: Synthetic oligonucleotide
gucucccuuccugaacuc

SEQ ID NO: 51264 - RNA, 18 nt, Artificial Sequence
  Description of Artificial Sequence: Synthetic oligonucleotide
ccccugucucccuuccug

SEQ ID NO: 51265 - RNA, 18 nt, Artificial Sequence
  Description of Artificial Sequence: Synthetic oligonucleotide
cugugccccugucucccu

SEQ ID NO: 51266 - RNA, 18 nt, Artificial Sequence
  Description of Artificial Sequence: Synthetic oligonucleotide
ucucucugugccccuguc

SEQ ID NO: 51267 - RNA, 18 nt, Artificial Sequence
  Description of Artificial Sequence: Synthetic oligonucleotide
cucugucucucugugccc

SEQ ID NO: 51268 - RNA, 18 nt, Artificial Sequence
  Description of Artificial Sequence: Synthetic oligonucleotide
ugaaccucugucucucug

SEQ ID NO: 51269 - RNA, 18 nt, Artificial Sequence
  Description of Artificial Sequence: Synthetic oligonucleotide
guccaugaaccucugucu

SEQ ID NO: 51270 - RNA, 18 nt, Artificial Sequence
  Description of Artificial Sequence: Synthetic oligonucleotide
ccucaguccaugaaccuc

SEQ ID NO: 51271 - RNA, 18 nt, Artificial Sequence
  Description of Artificial Sequence: Synthetic oligonucleotide
cuuugccucaguccauga

SEQ ID NO: 51272 - RNA, 18 nt, Artificial Sequence
  Description of Artificial Sequence: Synthetic oligonucleotide
ccagccuuugccucaguc

SEQ ID NO: 51273 - RNA, 18 nt, Artificial Sequence
  Description of Artificial Sequence: Synthetic oligonucleotide
cuggcccagccuuugccu

SEQ ID NO: 51274 - RNA, 18 nt, Artificial Sequence
  Description of Artificial Sequence: Synthetic oligonucleotide
ugagccuggcccagccuu

SEQ ID NO: 51275 - RNA, 18 nt, Artificial Sequence
  Description of Artificial Sequence: Synthetic oligonucleotide
guugcugagccuggccca

SEQ ID NO: 51276 - RNA, 18 nt, Artificial Sequence
  Description of Artificial Sequence: Synthetic oligonucleotide
ccuggguugcugagccug

SEQ ID NO: 51277 - RNA, 18 nt, Artificial Sequence
  Description of Artificial Sequence: Synthetic oligonucleotide
ggaggccuggguugcuga

SEQ ID NO: 51278 - RNA, 18 nt, Artificial Sequence
  Description of Artificial Sequence: Synthetic oligonucleotide
cugcgggaggccuggguu

SEQ ID NO: 51279 - RNA, 18 nt, Artificial Sequence
  Description of Artificial Sequence: Synthetic oligonucleotide
ccugccugcgggaggccu

SEQ ID NO: 51280 - RNA, 18 nt, Artificial Sequence
  Description of Artificial Sequence: Synthetic oligonucleotide
cucugccugccugcggga

SEQ ID NO: 51281 - RNA, 18 nt, Artificial Sequence
  Description of Artificial Sequence: Synthetic oligonucleotide
gcagccucugccugccug

SEQ ID NO: 51282 - RNA, 18 nt, Artificial Sequence
  Description of Artificial Sequence: Synthetic oligonucleotide
acagggcagccucugccu

SEQ ID NO: 51283 - RNA, 18 nt, Artificial Sequence
  Description of Artificial Sequence: Synthetic oligonucleotide
ggguuacagggcagccuc

SEQ ID NO: 51284 - RNA, 18 nt, Artificial Sequence
  Description of Artificial Sequence: Synthetic oligonucleotide
uccauggguuacagggca

SEQ ID NO: 51285 - RNA, 18 nt, Artificial Sequence
  Description of Artificial Sequence: Synthetic oligonucleotide
uggucuccauggguuaca

SEQ ID NO: 51286 - RNA, 18 nt, Artificial Sequence
  Description of Artificial Sequence: Synthetic oligonucleotide
uggucuggucuccauggg

SEQ ID NO: 51287 - RNA, 18 nt, Artificial Sequence
  Description of Artificial Sequence: Synthetic oligonucleotide
gcuguuggucuggucucc

SEQ ID NO: 51288 - RNA, 18 nt, Artificial Sequence
  Description of Artificial Sequence: Synthetic oligonucleotide
ucagagcuguuggucugg

SEQ ID NO: 51289 - RNA, 18 nt, Artificial Sequence
  Description of Artificial Sequence: Synthetic oligonucleotide
gcucaucagagcuguugg

SEQ ID NO: 51290 - RNA, 18 nt, Artificial Sequence
  Description of Artificial Sequence: Synthetic oligonucleotide
guggagcucaucagagcu

SEQ ID NO: 51291 - RNA, 18 nt, Artificial Sequence
  Description of Artificial Sequence: Synthetic oligonucleotide
ccacuguggagcucauca

SEQ ID NO: 51292 - RNA, 18 nt, Artificial Sequence
  Description of Artificial Sequence: Synthetic oligonucleotide
ugcagccacuguggagcu

SEQ ID NO: 51293 - RNA, 18 nt, Artificial Sequence
  Description of Artificial Sequence: Synthetic oligonucleotide
gcagcugcagccacugug

SEQ ID NO: 51294 - RNA, 18 nt, Artificial Sequence
  Description of Artificial Sequence: Synthetic oligonucleotide
caggcgcagcugcagcca

SEQ ID NO: 51295 - RNA, 18 nt, Artificial Sequence
  Description of Artificial Sequence: Synthetic oligonucleotide
agcugcaggcgcagcugc

SEQ ID NO: 51296 - RNA, 18 nt, Artificial Sequence
  Description of Artificial Sequence: Synthetic oligonucleotide
gccccagcugcaggcgca

SEQ ID NO: 51297 - RNA, 18 nt, Artificial Sequence
  Description of Artificial Sequence: Synthetic oligonucleotide
aggcagccccagcugcag

SEQ ID NO: 51298 - RNA, 18 nt, Artificial Sequence
  Description of Artificial Sequence: Synthetic oligonucleotide
ccuggaggcagccccagc

SEQ ID NO: 51299 - RNA, 18 nt, Artificial Sequence
  Description of Artificial Sequence: Synthetic oligonucleotide
uccuuccuggaggcagcc

SEQ ID NO: 51300 - RNA, 18 nt, Artificial Sequence
  Description of Artificial Sequence: Synthetic oligonucleotide
gagacuccuuccuggagg

SEQ ID NO: 51301 - RNA, 18 nt, Artificial Sequence
  Description of Artificial Sequence: Synthetic oligonucleotide
gccuggagacuccuuccu

SEQ ID NO: 51302 - RNA, 18 nt, Artificial Sequence
  Description of Artificial Sequence: Synthetic oligonucleotide
caucugccuggagacucc

SEQ ID NO: 51303 - RNA, 18 nt, Artificial Sequence
  Description of Artificial Sequence: Synthetic oligonucleotide
ggccccaucugccuggag

SEQ ID NO: 51304 - RNA, 18 nt, Artificial Sequence
  Description of Artificial Sequence: Synthetic oligonucleotide
ccccaggccccaucugcc

SEQ ID NO: 51305 - RNA, 18 nt, Artificial Sequence
  Description of Artificial Sequence: Synthetic oligonucleotide
uccucccccaggccccau

SEQ ID NO: 51306 - RNA, 18 nt, Artificial Sequence
  Description of Artificial Sequence: Synthetic oligonucleotide
ugggauccucccccaggc

SEQ ID NO: 51307 - RNA, 18 nt, Artificial Sequence
  Description of Artificial Sequence: Synthetic oligonucleotide
ccuaccuccaggagaagc

SEQ ID NO: 51308 - RNA, 18 nt, Artificial Sequence
  Description of Artificial Sequence: Synthetic oligonucleotide
ccaacccuaccuccagga

SEQ ID NO: 51309 - RNA, 18 nt, Artificial Sequence
  Description of Artificial Sequence: Synthetic oligonucleotide
cagacccaacccuaccuc

SEQ ID NO: 51310 - RNA, 18 nt, Artificial Sequence
  Description of Artificial Sequence: Synthetic oligonucleotide
gggcccagacccaacccu

SEQ ID NO: 51311 - RNA, 18 nt, Artificial Sequence
  Description of Artificial Sequence: Synthetic oligonucleotide
cccaagggcccagaccca

SEQ ID NO: 51312 - RNA, 18 nt, Artificial Sequence
  Description of Artificial Sequence: Synthetic oligonucleotide
ugcuccccaagggcccag

SEQ ID NO: 51313 - RNA, 18 nt, Artificial Sequence
  Description of Artificial Sequence: Synthetic oligonucleotide
uacccugcuccccaaggg

SEQ ID NO: 51314 - RNA, 18 nt, Artificial Sequence
  Description of Artificial Sequence: Synthetic oligonucleotide
gcccuuacccugcucccc

SEQ ID NO: 51315 - RNA, 18 nt, Artificial Sequence
  Description of Artificial Sequence: Synthetic oligonucleotide
cucuggcccuuacccugc

SEQ ID NO: 51316 - RNA, 18 nt, Artificial Sequence
  Description of Artificial Sequence: Synthetic oligonucleotide
cgaaccucuggcccuuac

SEQ ID NO: 51317 - RNA, 18 nt, Artificial Sequence
  Description of Artificial Sequence: Synthetic oligonucleotide
cccugcgaaccucuggcc

SEQ ID NO: 51318 - RNA, 18 nt, Artificial Sequence
  Description of Artificial Sequence: Synthetic oligonucleotide
auggucccugcgaaccuc

SEQ ID NO: 51319 - RNA, 18 nt, Artificial Sequence
  Description of Artificial Sequence: Synthetic oligonucleotide
cuuccauggucccugcga

SEQ ID NO: 51320 - RNA, 18 nt, Artificial Sequence
  Description of Artificial Sequence: Synthetic oligonucleotide
ggcuccuuccaugguccc

SEQ ID NO: 51321 - RNA, 18 nt, Artificial Sequence
  Description of Artificial Sequence: Synthetic oligonucleotide
guucuggcuccuuccaug

SEQ ID NO: 51322 - RNA, 18 nt, Artificial Sequence
  Description of Artificial Sequence: Synthetic oligonucleotide
gaguuguucuggcuccuu

SEQ ID NO: 51323 - RNA, 18 nt, Artificial Sequence
  Description of Artificial Sequence: Synthetic oligonucleotide
ggucugaguuguucuggc

SEQ ID NO: 51324 - RNA, 18 nt, Artificial Sequence
  Description of Artificial Sequence: Synthetic oligonucleotide
ggcugggucugaguuguu

SEQ ID NO: 51325 - RNA, 18 nt, Artificial Sequence
  Description of Artificial Sequence: Synthetic oligonucleotide
gggcugggucugaguugu

SEQ ID NO: 51326 - RNA, 18 nt, Artificial Sequence
  Description of Artificial Sequence: Synthetic oligonucleotide
uugcccacagccggcggg

SEQ ID NO: 51327 - RNA, 18 nt, Artificial Sequence
  Description of Artificial Sequence: Synthetic oligonucleotide
cacccuugcccacagccg

SEQ ID NO: 51328 - RNA, 18 nt, Artificial Sequence
  Description of Artificial Sequence: Synthetic oligonucleotide
uaccccacccuugcccac

SEQ ID NO: 51329 - RNA, 18 nt, Artificial Sequence
  Description of Artificial Sequence: Synthetic oligonucleotide
caggcuaccccacccuug

SEQ ID NO: 51330 - RNA, 18 nt, Artificial Sequence
  Description of Artificial Sequence: Synthetic oligonucleotide
acccacaggcuaccccac

SEQ ID NO: 51331 - RNA, 18 nt, Artificial Sequence
  Description of Artificial Sequence: Synthetic oligonucleotide
gguuuacccacaggcuac

SEQ ID NO: 51332 - RNA, 18 nt, Artificial Sequence
  Description of Artificial Sequence: Synthetic oligonucleotide
uucuggguuuacccacag

SEQ ID NO: 51333 - RNA, 18 nt, Artificial Sequence
  Description of Artificial Sequence: Synthetic oligonucleotide
uaggauucuggguuuacc

SEQ ID NO: 51334 - RNA, 18 nt, Artificial Sequence
  Description of Artificial Sequence: Synthetic oligonucleotide
guuucuaggauucugggu

SEQ ID NO: 51335 - RNA, 18 nt, Artificial Sequence
  Description of Artificial Sequence: Synthetic oligonucleotide
accguguuucuaggauuc

SEQ ID NO: 51336 - RNA, 18 nt, Artificial Sequence
  Description of Artificial Sequence: Synthetic oligonucleotide
gccccaccguguuucuag

SEQ ID NO: 51337 - RNA, 18 nt, Artificial Sequence
  Description of Artificial Sequence: Synthetic oligonucleotide
uccccgccccaccguguu

SEQ ID NO: 51338 - RNA, 18 nt, Artificial Sequence
  Description of Artificial Sequence: Synthetic oligonucleotide
ccccauccccgccccacc

SEQ ID NO: 51339 - RNA, 18 nt, Artificial Sequence
  Description of Artificial Sequence: Synthetic oligonucleotide
ccaacccccauccccgcc

SEQ ID NO: 51340 - RNA, 18 nt, Artificial Sequence
  Description of Artificial Sequence: Synthetic oligonucleotide
cgcccccaacccccaucc

SEQ ID NO: 51341 - RNA, 18 nt, Artificial Sequence
  Description of Artificial Sequence: Synthetic oligonucleotide
cugcccgcccccaacccc

SEQ ID NO: 51342 - RNA, 18 nt, Artificial Sequence
  Description of Artificial Sequence: Synthetic oligonucleotide
gcagccugcccgccccca

SEQ ID NO: 51343 - RNA, 18 nt, Artificial Sequence
  Description of Artificial Sequence: Synthetic oligonucleotide
gcucugcagccugcccgc

SEQ ID NO: 51344 - RNA, 18 nt, Artificial Sequence
  Description of Artificial Sequence: Synthetic oligonucleotide
uccuggcucugcagccug

SEQ ID NO: 51345 - RNA, 18 nt, Artificial Sequence
  Description of Artificial Sequence: Synthetic oligonucleotide
uccuguccuggcucugca

SEQ ID NO: 51346 - RNA, 18 nt, Artificial Sequence
  Description of Artificial Sequence: Synthetic oligonucleotide
ggcuguccuguccuggcu

SEQ ID NO: 51347 - RNA, 18 nt, Artificial Sequence
  Description of Artificial Sequence: Synthetic oligonucleotide
ggcuaggcuguccugucc

SEQ ID NO: 51348 - RNA, 18 nt, Artificial Sequence
  Description of Artificial Sequence: Synthetic oligonucleotide
ccaucggcuaggcugucc

SEQ ID NO: 51349 - RNA, 18 nt, Artificial Sequence
  Description of Artificial Sequence: Synthetic oligonucleotide
cuuccccaucggcuaggc

SEQ ID NO: 51350 - RNA, 18 nt, Artificial Sequence
  Description of Artificial Sequence: Synthetic oligonucleotide
cuuuccuuccccaucggc

SEQ ID NO: 51351 - RNA, 18 nt, Artificial Sequence
  Description of Artificial Sequence: Synthetic oligonucleotide
cuguucuuuccuucccca

SEQ ID NO: 51352 - RNA, 18 nt, Artificial Sequence
  Description of Artificial Sequence: Synthetic oligonucleotide
cuucucuguucuuuccuu

SEQ ID NO: 51353 - RNA, 18 nt, Artificial Sequence
  Description of Artificial Sequence: Synthetic oligonucleotide
gggcgcuucucuguucuu

SEQ ID NO: 51354 - RNA, 18 nt, Artificial Sequence
  Description of Artificial Sequence: Synthetic oligonucleotide
ccuaagggcgcuucucug

SEQ ID NO: 51355 - RNA, 18 nt, Artificial Sequence
  Description of Artificial Sequence: Synthetic oligonucleotide
uaagcccuaagggcgcuu

SEQ ID NO: 51356 - RNA, 18 nt, Artificial Sequence
  Description of Artificial Sequence: Synthetic oligonucleotide
gcuguuaagcccuaaggg

SEQ ID NO: 51357 - RNA, 18 nt, Artificial Sequence
  Description of Artificial Sequence: Synthetic oligonucleotide
ucugugcuguuaagcccu

SEQ ID NO: 51358 - RNA, 18 nt, Artificial Sequence
  Description of Artificial Sequence: Synthetic oligonucleotide
ggaccucugugcuguuaa

SEQ ID NO: 51359 - RNA, 18 nt, Artificial Sequence
  Description of Artificial Sequence: Synthetic oligonucleotide
acuagggaccucugugcu

SEQ ID NO: 51360 - RNA, 18 nt, Artificial Sequence
  Description of Artificial Sequence: Synthetic oligonucleotide
acgccacuagggaccucu

SEQ ID NO: 51361 - RNA, 18 nt, Artificial Sequence
  Description of Artificial Sequence: Synthetic oligonucleotide
ugucaacgccacuaggga

SEQ ID NO: 51362 - RNA, 18 nt, Artificial Sequence
  Description of Artificial Sequence: Synthetic oligonucleotide
auucuugucaacgccacu

SEQ ID NO: 51363 - RNA, 18 nt, Artificial Sequence
  Description of Artificial Sequence: Synthetic oligonucleotide
gaaacauucuugucaacg

SEQ ID NO: 51364 - RNA, 18 nt, Artificial Sequence
  Description of Artificial Sequence: Synthetic oligonucleotide
ccacagaaacauucuugu

SEQ ID NO: 51365 - RNA, 18 nt, Artificial Sequence
  Description of Artificial Sequence: Synthetic oligonucleotide
ucaucccacagaaacauu

SEQ ID NO: 51366 - RNA, 18 nt, Artificial Sequence
  Description of Artificial Sequence: Synthetic oligonucleotide
cuccaucaucccacagaa

SEQ ID NO: 51367 - RNA, 18 nt, Artificial Sequence
  Description of Artificial Sequence: Synthetic oligonucleotide
ucaggcuccaucauccca

SEQ ID NO: 51368 - RNA, 18 nt, Artificial Sequence
  Description of Artificial Sequence: Synthetic oligonucleotide
uggcuucaggcuccauca

SEQ ID NO: 51369 - RNA, 18 nt, Artificial Sequence
  Description of Artificial Sequence: Synthetic oligonucleotide
guggguggcuucaggcuc

SEQ ID NO: 51370 - RNA, 18 nt, Artificial Sequence
  Description of Artificial Sequence: Synthetic oligonucleotide
caacgccacuagggaccu

SEQ ID NO: 51371 - RNA, 18 nt, Artificial Sequence
  Description of Artificial Sequence: Synthetic oligonucleotide
cuugucaacgccacuagg

SEQ ID NO: 51372 - RNA, 18 nt, Artificial Sequence
  Description of Artificial Sequence: Synthetic oligonucleotide
acauucuugucaacgcca

SEQ ID NO: 51373 - RNA, 18 nt, Artificial Sequence
  Description of Artificial Sequence: Synthetic oligonucleotide
cagaaacauucuugucaa

SEQ ID NO: 51374 - RNA, 18 nt, Artificial Sequence
  Description of Artificial Sequence: Synthetic oligonucleotide
ucccacagaaacauucuu

SEQ ID NO: 51375 - RNA, 18 nt, Artificial Sequence
  Description of Artificial Sequence: Synthetic oligonucleotide
caucaucccacagaaaca

SEQ ID NO: 51376 - RNA, 18 nt, Artificial Sequence
  Description of Artificial Sequence: Synthetic oligonucleotide
ggcuccaucaucccacag

SEQ ID NO: 51377 - RNA, 18 nt, Artificial Sequence
  Description of Artificial Sequence: Synthetic oligonucleotide
cuucaggcuccaucaucc

SEQ ID NO: 51378 - RNA, 18 nt, Artificial Sequence
  Description of Artificial Sequence: Synthetic oligonucleotide
gguggcuucaggcuccau

SEQ ID NO: 51379 - RNA, 18 nt, Artificial Sequence
  Description of Artificial Sequence: Synthetic oligonucleotide
cuguggguggcuucaggc

SEQ ID NO: 51380 - RNA, 18 nt, Artificial Sequence
  Description of Artificial Sequence: Synthetic oligonucleotide
cuucucuguggguggcuu

SEQ ID NO: 51381 - RNA, 18 nt, Artificial Sequence
  Description of Artificial Sequence: Synthetic oligonucleotide
caucccuucucugugggu

SEQ ID NO: 51382 - RNA, 18 nt, Artificial Sequence
  Description of Artificial Sequence: Synthetic oligonucleotide
gcucccaucccuucucug

SEQ ID NO: 51383 - RNA, 18 nt, Artificial Sequence
  Description of Artificial Sequence: Synthetic oligonucleotide
ucccagcucccaucccuu

SEQ ID NO: 51384 - RNA, 18 nt, Artificial Sequence
  Description of Artificial Sequence: Synthetic oligonucleotide
cacuuucccagcucccau

SEQ ID NO: 51385 - RNA, 18 nt, Artificial Sequence
  Description of Artificial Sequence: Synthetic oligonucleotide
agcuccacuuucccagcu

SEQ ID NO: 51386 - RNA, 18 nt, Artificial Sequence
  Description of Artificial Sequence: Synthetic oligonucleotide
gcccuagcuccacuuucc

SEQ ID NO: 51387 - RNA, 18 nt, Artificial Sequence
  Description of Artificial Sequence: Synthetic oligonucleotide
uccgagcccuagcuccac

SEQ ID NO: 51388 - RNA, 18 nt, Artificial Sequence
  Description of Artificial Sequence: Synthetic oligonucleotide
aagaguccgagcccuagc

SEQ ID NO: 51389 - RNA, 18 nt, Artificial Sequence
  Description of Artificial Sequence: Synthetic oligonucleotide
ucagcaagaguccgagcc

SEQ ID NO: 51390 - RNA, 18 nt, Artificial Sequence
  Description of Artificial Sequence: Synthetic oligonucleotide
aauuuucagcaagagucc

SEQ ID NO: 51391 - RNA, 18 nt, Artificial Sequence
  Description of Artificial Sequence: Synthetic oligonucleotide
uggccaauuuucagcaag

SEQ ID NO: 51392 - RNA, 18 nt, Artificial Sequence
  Description of Artificial Sequence: Synthetic oligonucleotide
cucaauggccaauuuuca

SEQ ID NO: 51393 - RNA, 18 nt, Artificial Sequence
  Description of Artificial Sequence: Synthetic oligonucleotide
ccucccucaauggccaau

SEQ ID NO: 51394 - RNA, 18 nt, Artificial Sequence
  Description of Artificial Sequence: Synthetic oligonucleotide
ucucuccucccucaaugg

SEQ ID NO: 51395 - RNA, 18 nt, Artificial Sequence
  Description of Artificial Sequence: Synthetic oligonucleotide
ugcccucucuccucccuc

SEQ ID NO: 51396 - RNA, 18 nt, Artificial Sequence
  Description of Artificial Sequence: Synthetic oligonucleotide
uuccuugcccucucuccu

SEQ ID NO: 51397 - RNA, 18 nt, Artificial Sequence
  Description of Artificial Sequence: Synthetic oligonucleotide
ccccauuccuugcccucu

SEQ ID NO: 51398 - RNA, 18 nt, Artificial Sequence
  Description of Artificial Sequence: Synthetic oligonucleotide
cccacccccauuccuugc

SEQ ID NO: 51399 - RNA, 18 nt, Artificial Sequence
  Description of Artificial Sequence: Synthetic oligonucleotide
cagcccccacccccauuc

SEQ ID NO: 51400 - RNA, 18 nt, Artificial Sequence
  Description of Artificial Sequence: Synthetic oligonucleotide
caccccagcccccacccc

SEQ ID NO: 51401 - RNA, 18 nt, Artificial Sequence
  Description of Artificial Sequence: Synthetic oligonucleotide
auccacaccccagccccc

SEQ ID NO: 51402 - RNA, 18 nt, Artificial Sequence
  Description of Artificial Sequence: Synthetic oligonucleotide
ugugcauccacaccccag

SEQ ID NO: 51403 - RNA, 18 nt, Artificial Sequence
  Description of Artificial Sequence: Synthetic oligonucleotide
cucacugugcauccacac

SEQ ID NO: 51404 - RNA, 18 nt, Artificial Sequence
  Description of Artificial Sequence: Synthetic oligonucleotide
ucucccucacugugcauc

SEQ ID NO: 51405 - RNA, 18 nt, Artificial Sequence
  Description of Artificial Sequence: Synthetic oligonucleotide
aagugucucccucacugu

SEQ ID NO: 51406 - RNA, 18 nt, Artificial Sequence
  Description of Artificial Sequence: Synthetic oligonucleotide
uggagaagugucucccuc

SEQ ID NO: 51407 - RNA, 18 nt, Artificial Sequence
  Description of Artificial Sequence: Synthetic oligonucleotide
ccaucuggagaagugucu

SEQ ID NO: 51408 - RNA, 18 nt, Artificial Sequence
  Description of Artificial Sequence: Synthetic oligonucleotide
cucuuccaucuggagaag

SEQ ID NO: 51409 - RNA, 18 nt, Artificial Sequence
  Description of Artificial Sequence: Synthetic oligonucleotide
cgugacucuuccaucugg

SEQ ID NO: 51410 - RNA, 18 nt, Artificial Sequence
  Description of Artificial Sequence: Synthetic oligonucleotide
ccacgcgugacucuucca

SEQ ID NO: 51411 - RNA, 18 nt, Artificial Sequence
  Description of Artificial Sequence: Synthetic oligonucleotide
cgaacccacgcgugacuc

SEQ ID NO: 51412 - RNA, 18 nt, Artificial Sequence
  Description of Artificial Sequence: Synthetic oligonucleotide
uugaacgaacccacgcgu

SEQ ID NO: 51413 - RNA, 18 nt, Artificial Sequence
  Description of Artificial Sequence: Synthetic oligonucleotide
cgcauuugaacgaaccca

SEQ ID NO: 51414 - RNA, 18 nt, Artificial Sequence
  Description of Artificial Sequence: Synthetic oligonucleotide
ucacccgcauuugaacga

SEQ ID NO: 51415 - RNA, 18 nt, Artificial Sequence
  Description of Artificial Sequence: Synthetic oligonucleotide
cccgcucacccgcauuug

SEQ ID NO: 51416 - RNA, 18 nt, Artificial Sequence
  Description of Artificial Sequence: Synthetic oligonucleotide
caggccccgcucacccgc

SEQ ID NO: 51417 - RNA, 18 nt, Artificial Sequence
  Description of Artificial Sequence: Synthetic oligonucleotide
guccucaggccccgcuca

SEQ ID NO: 51418 - RNA, 18 nt, Artificial Sequence
  Description of Artificial Sequence: Synthetic oligonucleotide
ucccaguccucaggcccc

SEQ ID NO: 51419 - RNA, 18 nt, Artificial Sequence
  Description of Artificial Sequence: Synthetic oligonucleotide
cccuuucccaguccucag

SEQ ID NO: 51420 - RNA, 18 nt, Artificial Sequence
  Description of Artificial Sequence: Synthetic oligonucleotide
cgggucccuuucccaguc

SEQ ID NO: 51421 - RNA, 18 nt, Artificial Sequence
  Description of Artificial Sequence: Synthetic oligonucleotide
ucccucgggucccuuucc

SEQ ID NO: 51422 - RNA, 18 nt, Artificial Sequence
  Description of Artificial Sequence: Synthetic oligonucleotide
cuccuucccucggguccc

SEQ ID NO: 51423 - RNA, 18 nt, Artificial Sequence
  Description of Artificial Sequence: Synthetic oligonucleotide
cuccccuccuucccucgg

SEQ ID NO: 51424 - RNA, 18 nt, Artificial Sequence
  Description of Artificial Sequence: Synthetic oligonucleotide
gcacgcuccccuccuucc

SEQ ID NO: 51425 - RNA, 18 nt, Artificial Sequence
  Description of Artificial Sequence: Synthetic oligonucleotide
gggcugcacgcuccccuc

SEQ ID NO: 51426 - RNA, 18 nt, Artificial Sequence
  Description of Artificial Sequence: Synthetic oligonucleotide
gggcagggcugcacgcuc

SEQ ID NO: 51427 - RNA, 18 nt, Artificial Sequence
  Description of Artificial Sequence: Synthetic oligonucleotide
gggcagggcugggccggg

SEQ ID NO: 51428 - RNA, 18 nt, Artificial Sequence
  Description of Artificial Sequence: Synthetic oligonucleotide
ccagggcagggcugggcc

SEQ ID NO: 51429 - RNA, 18 nt, Artificial Sequence
  Description of Artificial Sequence: Synthetic oligonucleotide
cugggccagggcagggcu

SEQ ID NO: 51430 - RNA, 18 nt, Artificial Sequence
  Description of Artificial Sequence: Synthetic oligonucleotide
cagggcugggccagggca

SEQ ID NO: 51431 - RNA, 18 nt, Artificial Sequence
  Description of Artificial Sequence: Synthetic oligonucleotide
cacgcggcacuggagcga

SEQ ID NO: 51432 - RNA, 18 nt, Artificial Sequence
  Description of Artificial Sequence: Synthetic oligonucleotide
ccgcacacgcggcacugg

SEQ ID NO: 51433 - RNA, 18 nt, Artificial Sequence
  Description of Artificial Sequence: Synthetic oligonucleotide
ugucuccgcacacgcggc

SEQ ID NO: 51434 - RNA, 18 nt, Artificial Sequence
  Description of Artificial Sequence: Synthetic oligonucleotide
gcugcugucuccgcacac

SEQ ID NO: 51435 - RNA, 18 nt, Artificial Sequence
  Description of Artificial Sequence: Synthetic oligonucleotide
ccgcugcugcugucuccg

SEQ ID NO: 51436 - RNA, 18 nt, Artificial Sequence
  Description of Artificial Sequence: Synthetic oligonucleotide
gcuucccgcugcugcugu

SEQ ID NO: 51437 - RNA, 18 nt, Artificial Sequence
  Description of Artificial Sequence: Synthetic oligonucleotide
auagugcuucccgcugcu

SEQ ID NO: 51438 - RNA, 18 nt, Artificial Sequence
  Description of Artificial Sequence: Synthetic oligonucleotide
augccauagugcuucccg

SEQ ID NO: 51439 - RNA, 18 nt, Artificial Sequence
  Description of Artificial Sequence: Synthetic oligonucleotide
cauagaugccauagugcu

SEQ ID NO: 51440 - RNA, 18 nt, Artificial Sequence
  Description of Artificial Sequence: Synthetic oligonucleotide
gcaggcauagaugccaua

SEQ ID NO: 51441 - RNA, 18 nt, Artificial Sequence
  Description of Artificial Sequence: Synthetic oligonucleotide
ccguugcaggcauagaug

SEQ ID NO: 51442 - RNA, 18 nt, Artificial Sequence
  Description of Artificial Sequence: Synthetic oligonucleotide
ugcagccguugcaggcau

SEQ ID NO: 51443 - RNA, 18 nt, Artificial Sequence
  Description of Artificial Sequence: Synthetic oligonucleotide
gccgcugcagccguugca

SEQ ID NO: 51444 - RNA, 18 nt, Artificial Sequence
  Description of Artificial Sequence: Synthetic oligonucleotide
aagaagccgcugcagccg

SEQ ID NO: 51445 - RNA, 18 nt, Artificial Sequence
  Description of Artificial Sequence: Synthetic oligonucleotide
ucuugaagaagccgcugc

SEQ ID NO: 51446 - RNA, 18 nt, Artificial Sequence
  Description of Artificial Sequence: Synthetic oligonucleotide
gcuccucuugaagaagcc

SEQ ID NO: 51447 - RNA, 18 nt, Artificial Sequence
  Description of Artificial Sequence: Synthetic oligonucleotide
cguacgcuccucuugaag

SEQ ID NO: 51448 - RNA, 18 nt, Artificial Sequence
  Description of Artificial Sequence: Synthetic oligonucleotide
uccgccguacgcuccucu

SEQ ID NO: 51449 - RNA, 18 nt, Artificial Sequence
  Description of Artificial Sequence: Synthetic oligonucleotide
gagccuccgccguacgcu

SEQ ID NO: 51450 - RNA, 18 nt, Artificial Sequence
  Description of Artificial Sequence: Synthetic oligonucleotide
uagaugagccuccgccgu

SEQ ID NO: 51451 - RNA, 18 nt, Artificial Sequence
  Description of Artificial Sequence: Synthetic oligonucleotide
gcggcacuggagcgaggg

SEQ ID NO: 51452 - RNA, 18 nt, Artificial Sequence
  Description of Artificial Sequence: Synthetic oligonucleotide
cacgcggcacuggagcga

SEQ ID NO: 51453 - RNA, 18 nt, Artificial Sequence
  Description of Artificial Sequence: Synthetic oligonucleotide
ccgcacacgcggcacugg

SEQ ID NO: 51454 - RNA, 18 nt, Artificial Sequence
  Description of Artificial Sequence: Synthetic oligonucleotide
ugucuccgcacacgcggc

SEQ ID NO: 51455 - RNA, 18 nt, Artificial Sequence
  Description of Artificial Sequence: Synthetic oligonucleotide
gcugcugucuccgcacac

SEQ ID NO: 51456 - RNA, 18 nt, Artificial Sequence
  Description of Artificial Sequence: Synthetic oligonucleotide
ccgcugcugcugucuccg

SEQ ID NO: 51457 - RNA, 18 nt, Artificial Sequence
  Description of Artificial Sequence: Synthetic oligonucleotide
gcuucccgcugcugcugu

SEQ ID NO: 51458 - RNA, 18 nt, Artificial Sequence
  Description of Artificial Sequence: Synthetic oligonucleotide
auagugcuucccgcugcu

SEQ ID NO: 51459 - RNA, 18 nt, Artificial Sequence
  Description of Artificial Sequence: Synthetic oligonucleotide
augccauagugcuucccg

SEQ ID NO: 51460 - RNA, 18 nt, Artificial Sequence
  Description of Artificial Sequence: Synthetic oligonucleotide
cauagaugccauagugcu

SEQ ID NO: 51461 - RNA, 18 nt, Artificial Sequence
  Description of Artificial Sequence: Synthetic oligonucleotide
gcaggcauagaugccaua

SEQ ID NO: 51462 - RNA, 18 nt, Artificial Sequence
  Description of Artificial Sequence: Synthetic oligonucleotide
ccguugcaggcauagaug

SEQ ID NO: 51463 - RNA, 18 nt, Artificial Sequence
  Description of Artificial Sequence: Synthetic oligonucleotide
ugcagccguugcaggcau

SEQ ID NO: 51464 - RNA, 18 nt, Artificial Sequence
  Description of Artificial Sequence: Synthetic oligonucleotide
gccgcugcagccguugca

SEQ ID NO: 51465 - RNA, 18 nt, Artificial Sequence
  Description of Artificial Sequence: Synthetic oligonucleotide
aagaagccgcugcagccg

SEQ ID NO: 51466 - RNA, 18 nt, Artificial Sequence
  Description of Artificial Sequence: Synthetic oligonucleotide
ucuugaagaagccgcugc

SEQ ID NO: 51467 - RNA, 18 nt, Artificial Sequence
  Description of Artificial Sequence: Synthetic oligonucleotide
gcuccucuugaagaagcc

SEQ ID NO: 51468 - RNA, 18 nt, Artificial Sequence
  Description of Artificial Sequence: Synthetic oligonucleotide
cguacgcuccucuugaag

SEQ ID NO: 51469 - RNA, 18 nt, Artificial Sequence
  Description of Artificial Sequence: Synthetic oligonucleotide
uccgccguacgcuccucu

SEQ ID NO: 51470 - RNA, 18 nt, Artificial Sequence
  Description of Artificial Sequence: Synthetic oligonucleotide
gagccuccgccguacgcu

SEQ ID NO: 51471 - RNA, 18 nt, Artificial Sequence
  Description of Artificial Sequence: Synthetic oligonucleotide
uagaugagccuccgccgu

SEQ ID NO: 51472 - RNA, 18 nt, Artificial Sequence
  Description of Artificial Sequence: Synthetic oligonucleotide
ccagcagggcccaccgca

SEQ ID NO: 51473 - RNA, 18 nt, Artificial Sequence
  Description of Artificial Sequence: Synthetic oligonucleotide
gacgcccagcagggccca

SEQ ID NO: 51474 - RNA, 18 nt, Artificial Sequence
  Description of Artificial Sequence: Synthetic oligonucleotide
gggcagacgcccagcagg

SEQ ID NO: 51475 - RNA, 18 nt, Artificial Sequence
  Description of Artificial Sequence: Synthetic oligonucleotide
accccuccagaaccccuc

SEQ ID NO: 51476 - RNA, 18 nt, Artificial Sequence
  Description of Artificial Sequence: Synthetic oligonucleotide
cccucaccccuccagaac

SEQ ID NO: 51477 - RNA, 18 nt, Artificial Sequence
  Description of Artificial Sequence: Synthetic oligonucleotide
gcacccccucaccccucc

SEQ ID NO: 51478 - RNA, 18 nt, Artificial Sequence
  Description of Artificial Sequence: Synthetic oligonucleotide
ccugagcacccccucacc

SEQ ID NO: 51479 - RNA, 18 nt, Artificial Sequence
  Description of Artificial Sequence: Synthetic oligonucleotide
cuuccccugagcaccccc

SEQ ID NO: 51480 - RNA, 18 nt, Artificial Sequence
  Description of Artificial Sequence: Synthetic oligonucleotide
ccccucuuccccugagca

SEQ ID NO: 51481 - RNA, 18 nt, Artificial Sequence
  Description of Artificial Sequence: Synthetic oligonucleotide
ccaagccccucuuccccu

SEQ ID NO: 51482 - RNA, 18 nt, Artificial Sequence
  Description of Artificial Sequence: Synthetic oligonucleotide
uuugcccaagccccucuu

SEQ ID NO: 51483 - RNA, 18 nt, Artificial Sequence
  Description of Artificial Sequence: Synthetic oligonucleotide
acauuuuugcccaagccc

SEQ ID NO: 51484 - RNA, 18 nt, Artificial Sequence
  Description of Artificial Sequence: Synthetic oligonucleotide
cuuggacauuuuugccca

SEQ ID NO: 51485 - RNA, 18 nt, Artificial Sequence
  Description of Artificial Sequence: Synthetic oligonucleotide
augggcuuggacauuuuu

SEQ ID NO: 51486 - RNA, 18 nt, Artificial Sequence
  Description of Artificial Sequence: Synthetic oligonucleotide
gagccaugggcuuggaca

SEQ ID NO: 51487 - RNA, 18 nt, Artificial Sequence
  Description of Artificial Sequence: Synthetic oligonucleotide
ugagcacccccucacccc

SEQ ID NO: 51488 - RNA, 18 nt, Artificial Sequence
  Description of Artificial Sequence: Synthetic oligonucleotide
uccccugagcacccccuc

SEQ ID NO: 51489 - RNA, 18 nt, Artificial Sequence
  Description of Artificial Sequence: Synthetic oligonucleotide
ccucuuccccugagcacc

SEQ ID NO: 51490 - RNA, 18 nt, Artificial Sequence
  Description of Artificial Sequence: Synthetic oligonucleotide
aagccccucuuccccuga

SEQ ID NO: 51491 - RNA, 18 nt, Artificial Sequence
  Description of Artificial Sequence: Synthetic oligonucleotide
ugcccaagccccucuucc

SEQ ID NO: 51492 - RNA, 18 nt, Artificial Sequence
  Description of Artificial Sequence: Synthetic oligonucleotide
auuuuugcccaagccccu

SEQ ID NO: 51493 - RNA, 18 nt, Artificial Sequence
  Description of Artificial Sequence: Synthetic oligonucleotide
uggacauuuuugcccaag

SEQ ID NO: 51494 - RNA, 18 nt, Artificial Sequence
  Description of Artificial Sequence: Synthetic oligonucleotide
gggcuuggacauuuuugc

SEQ ID NO: 51495 - RNA, 18 nt, Artificial Sequence
  Description of Artificial Sequence: Synthetic oligonucleotide
gccaugggcuuggacauu

SEQ ID NO: 51496 - RNA, 18 nt, Artificial Sequence
  Description of Artificial Sequence: Synthetic oligonucleotide
ccugagccaugggcuugg

SEQ ID NO: 51497 - RNA, 18 nt, Artificial Sequence
  Description of Artificial Sequence: Synthetic oligonucleotide
caugcccugagccauggg

SEQ ID NO: 51498 - RNA, 18 nt, Artificial Sequence
  Description of Artificial Sequence: Synthetic oligonucleotide
ccucccaugcccugagcc

SEQ ID NO: 51499 - RNA, 18 nt, Artificial Sequence
  Description of Artificial Sequence: Synthetic oligonucleotide
gugucccucccaugcccu

SEQ ID NO: 51500 - RNA, 18 nt, Artificial Sequence
  Description of Artificial Sequence: Synthetic oligonucleotide
ggucagugucccucccau

SEQ ID NO: 51501 - RNA, 18 nt, Artificial Sequence
  Description of Artificial Sequence: Synthetic oligonucleotide
cccugcccccaccuggca

SEQ ID NO: 51502 - RNA, 18 nt, Artificial Sequence
  Description of Artificial Sequence: Synthetic oligonucleotide
cacaucccugcccccacc

SEQ ID NO: 51503 - RNA, 18 nt, Artificial Sequence
  Description of Artificial Sequence: Synthetic oligonucleotide
gggcacaucccugccccc

SEQ ID NO: 51504 - RNA, 18 nt, Artificial Sequence
  Description of Artificial Sequence: Synthetic oligonucleotide
gugggccuuguccacggg

SEQ ID NO: 51505 - RNA, 18 nt, Artificial Sequence
  Description of Artificial Sequence: Synthetic oligonucleotide
uugcggugggccuugucc

SEQ ID NO: 51506 - RNA, 18 nt, Artificial Sequence
  Description of Artificial Sequence: Synthetic oligonucleotide
acugguugcggugggccu

SEQ ID NO: 51507 - RNA, 18 nt, Artificial Sequence
  Description of Artificial Sequence: Synthetic oligonucleotide
cuggcacugguugcggug

SEQ ID NO: 51508 - RNA, 18 nt, Artificial Sequence
  Description of Artificial Sequence: Synthetic oligonucleotide
caggccuggcacugguug

SEQ ID NO: 51509 - RNA, 18 nt, Artificial Sequence
  Description of Artificial Sequence: Synthetic oligonucleotide
gccggcaggccuggcacu

SEQ ID NO: 51510 - RNA, 18 nt, Artificial Sequence
  Description of Artificial Sequence: Synthetic oligonucleotide
cuucagccggcaggccug

SEQ ID NO: 51511 - RNA, 18 nt, Artificial Sequence
  Description of Artificial Sequence: Synthetic oligonucleotide
cacuucuucagccggcag

SEQ ID NO: 51512 - RNA, 18 nt, Artificial Sequence
  Description of Artificial Sequence: Synthetic oligonucleotide
gcaggcacuucuucagcc

SEQ ID NO: 51513 - RNA, 18 nt, Artificial Sequence
  Description of Artificial Sequence: Synthetic oligonucleotide
cgccugcaggcacuucuu

SEQ ID NO: 51514 - RNA, 18 nt, Artificial Sequence
  Description of Artificial Sequence: Synthetic oligonucleotide
auccccgccugcaggcac

SEQ ID NO: 51515 - RNA, 18 nt, Artificial Sequence
  Description of Artificial Sequence: Synthetic oligonucleotide
gguucauccccgccugca

SEQ ID NO: 51516 - RNA, 18 nt, Artificial Sequence
  Description of Artificial Sequence: Synthetic oligonucleotide
guccugguucauccccgc

SEQ ID NO: 51517 - RNA, 18 nt, Artificial Sequence
  Description of Artificial Sequence: Synthetic oligonucleotide
caucccugcccccaccug

SEQ ID NO: 51518 - RNA, 18 nt, Artificial Sequence
  Description of Artificial Sequence: Synthetic oligonucleotide
gggcacaucccugccccc

SEQ ID NO: 51519 - RNA, 18 nt, Artificial Sequence
  Description of Artificial Sequence: Synthetic oligonucleotide
gugggccuuguccacggg

SEQ ID NO: 51520 - RNA, 18 nt, Artificial Sequence
  Description of Artificial Sequence: Synthetic oligonucleotide
gcggugggccuuguccac

SEQ ID NO: 51521 - RNA, 18 nt, Artificial Sequence
  Description of Artificial Sequence: Synthetic oligonucleotide
ugguugcggugggccuug

SEQ ID NO: 51522 - RNA, 18 nt, Artificial Sequence
  Description of Artificial Sequence: Synthetic oligonucleotide
ggcacugguugcgguggg

SEQ ID NO: 51523 - RNA, 18 nt, Artificial Sequence
  Description of Artificial Sequence: Synthetic oligonucleotide
ggccuggcacugguugcg

SEQ ID NO: 51524 - RNA, 18 nt, Artificial Sequence
  Description of Artificial Sequence: Synthetic oligonucleotide
cggcaggccuggcacugg

SEQ ID NO: 51525 - RNA, 18 nt, Artificial Sequence
  Description of Artificial Sequence: Synthetic oligonucleotide
ucagccggcaggccuggc

SEQ ID NO: 51526 - RNA, 18 nt, Artificial Sequence
  Description of Artificial Sequence: Synthetic oligonucleotide
cuucuucagccggcaggc

SEQ ID NO: 51527 - RNA, 18 nt, Artificial Sequence
  Description of Artificial Sequence: Synthetic oligonucleotide
aggcacuucuucagccgg

SEQ ID NO: 51528 - RNA, 18 nt, Artificial Sequence
  Description of Artificial Sequence: Synthetic oligonucleotide
ccugcaggcacuucuuca

SEQ ID NO: 51529 - RNA, 18 nt, Artificial Sequence
  Description of Artificial Sequence: Synthetic oligonucleotide
ccccgccugcaggcacuu

SEQ ID NO: 51530 - RNA, 18 nt, Artificial Sequence
  Description of Artificial Sequence: Synthetic oligonucleotide
uucauccccgccugcagg

SEQ ID NO: 51531 - RNA, 18 nt, Artificial Sequence
  Description of Artificial Sequence: Synthetic oligonucleotide
ccugguucauccccgccu

SEQ ID NO: 51532 - RNA, 18 nt, Artificial Sequence
  Description of Artificial Sequence: Synthetic oligonucleotide
ccccgggccagcccccgc

SEQ ID NO: 51533 - RNA, 18 nt, Artificial Sequence
  Description of Artificial Sequence: Synthetic oligonucleotide
ccuccccccgggccagcc

SEQ ID NO: 51534 - RNA, 18 nt, Artificial Sequence
  Description of Artificial Sequence: Synthetic oligonucleotide
ugucaccuccccccgggc

SEQ ID NO: 51535 - RNA, 18 nt, Artificial Sequence
  Description of Artificial Sequence: Synthetic oligonucleotide
uuucuugucaccuccccc

SEQ ID NO: 51536 - RNA, 18 nt, Artificial Sequence
  Description of Artificial Sequence: Synthetic oligonucleotide
gcccauuucuugucaccu

SEQ ID NO: 51537 - RNA, 18 nt, Artificial Sequence
  Description of Artificial Sequence: Synthetic oligonucleotide
ccgcugcccauuucuugu

SEQ ID NO: 51538 - RNA, 18 nt, Artificial Sequence
  Description of Artificial Sequence: Synthetic oligonucleotide
cagucccgcugcccauuu

SEQ ID NO: 51539 - RNA, 18 nt, Artificial Sequence
  Description of Artificial Sequence: Synthetic oligonucleotide
cacgccagucccgcugcc

SEQ ID NO: 51540 - RNA, 18 nt, Artificial Sequence
  Description of Artificial Sequence: Synthetic oligonucleotide
gacgacacgccagucccg

SEQ ID NO: 51541 - RNA, 18 nt, Artificial Sequence
  Description of Artificial Sequence: Synthetic oligonucleotide
gucaggacgacacgccag

SEQ ID NO: 51542 - RNA, 18 nt, Artificial Sequence
  Description of Artificial Sequence: Synthetic oligonucleotide
gaagggucaggacgacac

SEQ ID NO: 51543 - RNA, 18 nt, Artificial Sequence
  Description of Artificial Sequence: Synthetic oligonucleotide
caccuccccccgggccag

SEQ ID NO: 51544 - RNA, 18 nt, Artificial Sequence
  Description of Artificial Sequence: Synthetic oligonucleotide
cuugucaccuccccccgg

SEQ ID NO: 51545 - RNA, 18 nt, Artificial Sequence
  Description of Artificial Sequence: Synthetic oligonucleotide
cauuucuugucaccuccc

SEQ ID NO: 51546 - RNA, 18 nt, Artificial Sequence
  Description of Artificial Sequence: Synthetic oligonucleotide
cugcccauuucuugucac

SEQ ID NO: 51547 - RNA, 18 nt, Artificial Sequence
  Description of Artificial Sequence: Synthetic oligonucleotide
ucccgcugcccauuucuu

SEQ ID NO: 51548 - RNA, 18 nt, Artificial Sequence
  Description of Artificial Sequence: Synthetic oligonucleotide
gccagucccgcugcccau

SEQ ID NO: 51549 - RNA, 18 nt, Artificial Sequence
  Description of Artificial Sequence: Synthetic oligonucleotide
gacacgccagucccgcug

SEQ ID NO: 51550 - RNA, 18 nt, Artificial Sequence
  Description of Artificial Sequence: Synthetic oligonucleotide
aggacgacacgccagucc

SEQ ID NO: 51551 - RNA, 18 nt, Artificial Sequence
  Description of Artificial Sequence: Synthetic oligonucleotide
gggucaggacgacacgcc

SEQ ID NO: 51552 - RNA, 18 nt, Artificial Sequence
  Description of Artificial Sequence: Synthetic oligonucleotide
uggcgcucguucugcacg

SEQ ID NO: 51553 - RNA, 18 nt, Artificial Sequence
  Description of Artificial Sequence: Synthetic oligonucleotide
gcggcuggcgcucguucu

SEQ ID NO: 51554 - RNA, 18 nt, Artificial Sequence
  Description of Artificial Sequence: Synthetic oligonucleotide
gcuucgcggcuggcgcuc

SEQ ID NO: 51555 - RNA, 18 nt, Artificial Sequence
  Description of Artificial Sequence: Synthetic oligonucleotide
gcugugcuucgcggcugg

SEQ ID NO: 51556 - RNA, 18 nt, Artificial Sequence
  Description of Artificial Sequence: Synthetic oligonucleotide
ccugggcugugcuucgcg

SEQ ID NO: 51557 - RNA, 18 nt, Artificial Sequence
  Description of Artificial Sequence: Synthetic oligonucleotide
guggaccugggcugugcu

SEQ ID NO: 51558 - RNA, 18 nt, Artificial Sequence
  Description of Artificial Sequence: Synthetic oligonucleotide
uccagguggaccugggcu

SEQ ID NO: 51559 - RNA, 18 nt, Artificial Sequence
  Description of Artificial Sequence: Synthetic oligonucleotide
ugcuguccagguggaccu

SEQ ID NO: 51560 - RNA, 18 nt, Artificial Sequence
  Description of Artificial Sequence: Synthetic oligonucleotide
cuccaugcuguccaggug

SEQ ID NO: 51561 - RNA, 18 nt, Artificial Sequence
  Description of Artificial Sequence: Synthetic oligonucleotide
uuggacuccaugcugucc

SEQ ID NO: 51562 - RNA, 18 nt, Artificial Sequence
  Description of Artificial Sequence: Synthetic oligonucleotide
caguguuggacuccaugc

SEQ ID NO: 51563 - RNA, 18 nt, Artificial Sequence
  Description of Artificial Sequence: Synthetic oligonucleotide
ggacucaguguuggacuc

SEQ ID NO: 51564 - RNA, 18 nt, Artificial Sequence
  Description of Artificial Sequence: Synthetic oligonucleotide
ggccgggacucaguguug

SEQ ID NO: 51565 - RNA, 18 nt, Artificial Sequence
  Description of Artificial Sequence: Synthetic oligonucleotide
acuccggccgggacucag

SEQ ID NO: 51566 - RNA, 18 nt, Artificial Sequence
  Description of Artificial Sequence: Synthetic oligonucleotide
cagggacuccggccggga

SEQ ID NO: 51567 - RNA, 18 nt, Artificial Sequence
  Description of Artificial Sequence: Synthetic oligonucleotide
gccaccagggacuccggc

SEQ ID NO: 51568 - RNA, 18 nt, Artificial Sequence
  Description of Artificial Sequence: Synthetic oligonucleotide
gggagccaccagggacuc

SEQ ID NO: 51569 - RNA, 18 nt, Artificial Sequence
  Description of Artificial Sequence: Synthetic oligonucleotide
gggcugcgcccugccggg

SEQ ID NO: 51570 - RNA, 18 nt, Artificial Sequence
  Description of Artificial Sequence: Synthetic oligonucleotide
cccgugggcugcgcccug

SEQ ID NO: 51571 - RNA, 18 nt, Artificial Sequence
  Description of Artificial Sequence: Synthetic oligonucleotide
gggccccgugggcugcgc

SEQ ID NO: 51572 - RNA, 18 nt, Artificial Sequence
  Description of Artificial Sequence: Synthetic oligonucleotide
ugcagacauggguguggg

SEQ ID NO: 51573 - RNA, 18 nt, Artificial Sequence
  Description of Artificial Sequence: Synthetic oligonucleotide
cuggcugcagacaugggu

SEQ ID NO: 51574 - RNA, 18 nt, Artificial Sequence
  Description of Artificial Sequence: Synthetic oligonucleotide
gggcucuggcugcagaca

SEQ ID NO: 51575 - RNA, 18 nt, Artificial Sequence
  Description of Artificial Sequence: Synthetic oligonucleotide
gcccagggcucuggcugc

SEQ ID NO: 51576 - RNA, 18 nt, Artificial Sequence
  Description of Artificial Sequence: Synthetic oligonucleotide
ugguggcccagggcucug

SEQ ID NO: 51577 - RNA, 18 nt, Artificial Sequence
  Description of Artificial Sequence: Synthetic oligonucleotide
ugaagugguggcccaggg

SEQ ID NO: 51578 - RNA, 18 nt, Artificial Sequence
  Description of Artificial Sequence: Synthetic oligonucleotide
ggccaugaagugguggcc

SEQ ID NO: 51579 - RNA, 18 nt, Artificial Sequence
  Description of Artificial Sequence: Synthetic oligonucleotide
aggcuggccaugaagugg

SEQ ID NO: 51580 - RNA, 18 nt, Artificial Sequence
  Description of Artificial Sequence: Synthetic oligonucleotide
uuauaaggcuggccauga

SEQ ID NO: 51581 - RNA, 18 nt, Artificial Sequence
  Description of Artificial Sequence: Synthetic oligonucleotide
agcuguuauaaggcuggc

SEQ ID NO: 51582 - RNA, 18 nt, Artificial Sequence
  Description of Artificial Sequence: Synthetic oligonucleotide
guuucagcuguuauaagg

SEQ ID NO: 51583 - RNA, 18 nt, Artificial Sequence
  Description of Artificial Sequence: Synthetic oligonucleotide
cacagguuucagcuguua

SEQ ID NO: 51584 - RNA, 18 nt, Artificial Sequence
  Description of Artificial Sequence: Synthetic oligonucleotide
cuuagcacagguuucagc

SEQ ID NO: 51585 - RNA, 18 nt, Artificial Sequence
  Description of Artificial Sequence: Synthetic oligonucleotide
uccagcuuagcacagguu

SEQ ID NO: 51586 - RNA, 18 nt, Artificial Sequence
  Description of Artificial Sequence: Synthetic oligonucleotide
cuggcuccagcuuagcac

SEQ ID NO: 51587 - RNA, 18 nt, Artificial Sequence
  Description of Artificial Sequence: Synthetic oligonucleotide
auccucuggcuccagcuu

SEQ ID NO: 51588 - RNA, 18 nt, Artificial Sequence
  Description of Artificial Sequence: Synthetic oligonucleotide
ggcgcucguucugcacgg

SEQ ID NO: 51589 - RNA, 18 nt, Artificial Sequence
  Description of Artificial Sequence: Synthetic oligonucleotide
cggcuggcgcucguucug

SEQ ID NO: 51590 - RNA, 18 nt, Artificial Sequence
  Description of Artificial Sequence: Synthetic oligonucleotide
cuucgcggcuggcgcucg

SEQ ID NO: 51591 - RNA, 18 nt, Artificial Sequence
  Description of Artificial Sequence: Synthetic oligonucleotide
cugugcuucgcggcuggc

SEQ ID NO: 51592 - RNA, 18 nt, Artificial Sequence
  Description of Artificial Sequence: Synthetic oligonucleotide
cugggcugugcuucgcgg

SEQ ID NO: 51593 - RNA, 18 nt, Artificial Sequence
  Description of Artificial Sequence: Synthetic oligonucleotide
uggaccugggcugugcuu

SEQ ID NO: 51594 - RNA, 18 nt, Artificial Sequence
  Description of Artificial Sequence: Synthetic oligonucleotide
ccagguggaccugggcug

SEQ ID NO: 51595 - RNA, 18 nt, Artificial Sequence
  Description of Artificial Sequence: Synthetic oligonucleotide
gcuguccagguggaccug

SEQ ID NO: 51596 - RNA, 18 nt, Artificial Sequence
  Description of Artificial Sequence: Synthetic oligonucleotide
uccaugcuguccaggugg

SEQ ID NO: 51597 - RNA, 18 nt, Artificial Sequence
  Description of Artificial Sequence: Synthetic oligonucleotide
uggacuccaugcugucca

SEQ ID NO: 51598 - RNA, 18 nt, Artificial Sequence
  Description of Artificial Sequence: Synthetic oligonucleotide
aguguuggacuccaugcu

SEQ ID NO: 51599 - RNA, 18 nt, Artificial Sequence
  Description of Artificial Sequence: Synthetic oligonucleotide
gacucaguguuggacucc

SEQ ID NO: 51600 - RNA, 18 nt, Artificial Sequence
  Description of Artificial Sequence: Synthetic oligonucleotide
gccgggacucaguguugg

SEQ ID NO: 51601 - RNA, 18 nt, Artificial Sequence
  Description of Artificial Sequence: Synthetic oligonucleotide
cuccggccgggacucagu

SEQ ID NO: 51602 - RNA, 18 nt, Artificial Sequence
  Description of Artificial Sequence: Synthetic oligonucleotide
agggacuccggccgggac

SEQ ID NO: 51603 - RNA, 18 nt, Artificial Sequence
  Description of Artificial Sequence: Synthetic oligonucleotide
ccaccagggacuccggcc

SEQ ID NO: 51604 - RNA, 18 nt, Artificial Sequence
  Description of Artificial Sequence: Synthetic oligonucleotide
gggagccaccagggacuc

SEQ ID NO: 51605 - RNA, 18 nt, Artificial Sequence
  Description of Artificial Sequence: Synthetic oligonucleotide
gggcugcgcccugccggg

SEQ ID NO: 51606 - RNA, 18 nt, Artificial Sequence
  Description of Artificial Sequence: Synthetic oligonucleotide
ccgugggcugcgcccugc

SEQ ID NO: 51607 - RNA, 18 nt, Artificial Sequence
  Description of Artificial Sequence: Synthetic oligonucleotide
gggccccgugggcugcgc

SEQ ID NO: 51608 - RNA, 18 nt, Artificial Sequence
  Description of Artificial Sequence: Synthetic oligonucleotide
ugcagacauggguguggg

SEQ ID NO: 51609 - RNA, 18 nt, Artificial Sequence
  Description of Artificial Sequence: Synthetic oligonucleotide
ggcugcagacaugggugu

SEQ ID NO: 51610 - RNA, 18 nt, Artificial Sequence
  Description of Artificial Sequence: Synthetic oligonucleotide
gcucuggcugcagacaug

SEQ ID NO: 51611 - RNA, 18 nt, Artificial Sequence
  Description of Artificial Sequence: Synthetic oligonucleotide
ccagggcucuggcugcag

SEQ ID NO: 51612 - RNA, 18 nt, Artificial Sequence
  Description of Artificial Sequence: Synthetic oligonucleotide
guggcccagggcucuggc

SEQ ID NO: 51613 - RNA, 18 nt, Artificial Sequence
  Description of Artificial Sequence: Synthetic oligonucleotide
aagugguggcccagggcu

SEQ ID NO: 51614 - RNA, 18 nt, Artificial Sequence
  Description of Artificial Sequence: Synthetic oligonucleotide
ccaugaagugguggccca

SEQ ID NO: 51615 - RNA, 18 nt, Artificial Sequence
  Description of Artificial Sequence: Synthetic oligonucleotide
gcuggccaugaaguggug

SEQ ID NO: 51616 - RNA, 18 nt, Artificial Sequence
  Description of Artificial Sequence: Synthetic oligonucleotide
auaaggcuggccaugaag

SEQ ID NO: 51617 - RNA, 18 nt, Artificial Sequence
  Description of Artificial Sequence: Synthetic oligonucleotide
cuguuauaaggcuggcca

SEQ ID NO: 51618 - RNA, 18 nt, Artificial Sequence
  Description of Artificial Sequence: Synthetic oligonucleotide
uucagcuguuauaaggcu

SEQ ID NO: 51619 - RNA, 18 nt, Artificial Sequence
  Description of Artificial Sequence: Synthetic oligonucleotide
cagguuucagcuguuaua

SEQ ID NO: 51620 - RNA, 18 nt, Artificial Sequence
  Description of Artificial Sequence: Synthetic oligonucleotide
uagcacagguuucagcug

SEQ ID NO: 51621 - RNA, 18 nt, Artificial Sequence
  Description of Artificial Sequence: Synthetic oligonucleotide
cagcuuagcacagguuuc

SEQ ID NO: 51622 - RNA, 18 nt, Artificial Sequence
  Description of Artificial Sequence: Synthetic oligonucleotide
ggcuccagcuuagcacag

SEQ ID NO: 51623 - RNA, 18 nt, Artificial Sequence
  Description of Artificial Sequence: Synthetic oligonucleotide
ccucuggcuccagcuuag

SEQ ID NO: 51624 - RNA, 18 nt, Artificial Sequence
  Description of Artificial Sequence: Synthetic oligonucleotide
cccucagcugcucuccca

SEQ ID NO: 51625 - RNA, 18 nt, Artificial Sequence
  Description of Artificial Sequence: Synthetic oligonucleotide
cugugcccucagcugcuc

SEQ ID NO: 51626 - RNA, 18 nt, Artificial Sequence
  Description of Artificial Sequence: Synthetic oligonucleotide
cccugcugugcccucagc

SEQ ID NO: 51627 - RNA, 18 nt, Artificial Sequence
  Description of Artificial Sequence: Synthetic oligonucleotide
ccaagcccugcugugccc

SEQ ID NO: 51628 - RNA, 18 nt, Artificial Sequence
  Description of Artificial Sequence: Synthetic oligonucleotide
ggaagccaagcccugcug

SEQ ID NO: 51629 - RNA, 18 nt, Artificial Sequence
  Description of Artificial Sequence: Synthetic oligonucleotide
acccgggaagccaagccc

SEQ ID NO: 51630 - RNA, 18 nt, Artificial Sequence
  Description of Artificial Sequence: Synthetic oligonucleotide
cugugacccgggaagcca

SEQ ID NO: 51631 - RNA, 18 nt, Artificial Sequence
  Description of Artificial Sequence: Synthetic oligonucleotide
cccugcugugacccggga

SEQ ID NO: 51632 - RNA, 18 nt, Artificial Sequence
  Description of Artificial Sequence: Synthetic oligonucleotide
ugcagcccugcugugacc

SEQ ID NO: 51633 - RNA, 18 nt, Artificial Sequence
  Description of Artificial Sequence: Synthetic oligonucleotide
ggcgcugcagcccugcug

SEQ ID NO: 51634 - RNA, 18 nt, Artificial Sequence
  Description of Artificial Sequence: Synthetic oligonucleotide
ggcaaggcgcugcagccc

SEQ ID NO: 51635 - RNA, 18 nt, Artificial Sequence
  Description of Artificial Sequence: Synthetic oligonucleotide
aucaaggcaaggcgcugc

SEQ ID NO: 51636 - RNA, 18 nt, Artificial Sequence
  Description of Artificial Sequence: Synthetic oligonucleotide
ggaggaucaaggcaaggc

SEQ ID NO: 51637 - RNA, 18 nt, Artificial Sequence
  Description of Artificial Sequence: Synthetic oligonucleotide
gggagggaggaucaaggc

SEQ ID NO: 51638 - RNA, 18 nt, Artificial Sequence
  Description of Artificial Sequence: Synthetic oligonucleotide
gggaguacuuggagcccc

SEQ ID NO: 51639 - RNA, 18 nt, Artificial Sequence
  Description of Artificial Sequence: Synthetic oligonucleotide
ggcgcugcagcccugcug

SEQ ID NO: 51640 - RNA, 18 nt, Artificial Sequence
  Description of Artificial Sequence: Synthetic oligonucleotide
ggcaaggcgcugcagccc

SEQ ID NO: 51641 - RNA, 18 nt, Artificial Sequence
  Description of Artificial Sequence: Synthetic oligonucleotide
aucaaggcaaggcgcugc

SEQ ID NO: 51642 - RNA, 18 nt, Artificial Sequence
  Description of Artificial Sequence: Synthetic oligonucleotide
ggaggaucaaggcaaggc

SEQ ID NO: 51643 - RNA, 18 nt, Artificial Sequence
  Description of Artificial Sequence: Synthetic oligonucleotide
gggagggaggaucaaggc

SEQ ID NO: 51644 - RNA, 18 nt, Artificial Sequence
  Description of Artificial Sequence: Synthetic oligonucleotide
aguacuuggagccccggg

SEQ ID NO: 51645 - RNA, 18 nt, Artificial Sequence
  Description of Artificial Sequence: Synthetic oligonucleotide
agggaguacuuggagccc

SEQ ID NO: 51646 - RNA, 18 nt, Artificial Sequence
  Description of Artificial Sequence: Synthetic oligonucleotide
guggcagggaguacuugg

SEQ ID NO: 51647 - RNA, 18 nt, Artificial Sequence
  Description of Artificial Sequence: Synthetic oligonucleotide
gggagguggcagggagua

SEQ ID NO: 51648 - RNA, 18 nt, Artificial Sequence
  Description of Artificial Sequence: Synthetic oligonucleotide
uucucgggagguggcagg

SEQ ID NO: 51649 - RNA, 18 nt, Artificial Sequence
  Description of Artificial Sequence: Synthetic oligonucleotide
ccugcuucucgggaggug

SEQ ID NO: 51650 - RNA, 18 nt, Artificial Sequence
  Description of Artificial Sequence: Synthetic oligonucleotide
uagcgccugcuucucggg

SEQ ID NO: 51651 - RNA, 18 nt, Artificial Sequence
  Description of Artificial Sequence: Synthetic oligonucleotide
gaucuuagcgccugcuuc

SEQ ID NO: 51652 - RNA, 18 nt, Artificial Sequence
  Description of Artificial Sequence: Synthetic oligonucleotide
guugugaucuuagcgccu

SEQ ID NO: 51653 - RNA, 18 nt, Artificial Sequence
  Description of Artificial Sequence: Synthetic oligonucleotide
acaucaauauucucauca

SEQ ID NO: 51654 - RNA, 18 nt, Artificial Sequence
  Description of Artificial Sequence: Synthetic oligonucleotide
uggugacaucaauauucu

SEQ ID NO: 51655 - RNA, 18 nt, Artificial Sequence
  Description of Artificial Sequence: Synthetic oligonucleotide
auugcuggugacaucaau

SEQ ID NO: 51656 - RNA, 18 nt, Artificial Sequence
  Description of Artificial Sequence: Synthetic oligonucleotide
gggucauugcuggugaca

SEQ ID NO: 51657 - RNA, 18 nt, Artificial Sequence
  Description of Artificial Sequence: Synthetic oligonucleotide
acucagggucauugcugg

SEQ ID NO: 51658 - RNA, 18 nt, Artificial Sequence
  Description of Artificial Sequence: Synthetic oligonucleotide
gggaacucagggucauug

SEQ ID NO: 51659 - RNA, 18 nt, Artificial Sequence
  Description of Artificial Sequence: Synthetic oligonucleotide
ggaguauggagaggaggg

SEQ ID NO: 51660 - RNA, 18 nt, Artificial Sequence
  Description of Artificial Sequence: Synthetic oligonucleotide
gaagaggaguauggagag

SEQ ID NO: 51661 - RNA, 18 nt, Artificial Sequence
  Description of Artificial Sequence: Synthetic oligonucleotide
gggaggaagaggaguaug

SEQ ID NO: 51662 - RNA, 18 nt, Artificial Sequence
  Description of Artificial Sequence: Synthetic oligonucleotide
gaugcuguccaggccgca

SEQ ID NO: 51663 - RNA, 18 nt, Artificial Sequence
  Description of Artificial Sequence: Synthetic oligonucleotide
ucauggaugcuguccagg

SEQ ID NO: 51664 - RNA, 18 nt, Artificial Sequence
  Description of Artificial Sequence: Synthetic oligonucleotide
aggucucauggaugcugu

SEQ ID NO: 51665 - RNA, 18 nt, Artificial Sequence
  Description of Artificial Sequence: Synthetic oligonucleotide
agccgaggucucauggau

SEQ ID NO: 51666 - RNA, 18 nt, Artificial Sequence
  Description of Artificial Sequence: Synthetic oligonucleotide
aggcgagccgaggucuca

SEQ ID NO: 51667 - RNA, 18 nt, Artificial Sequence
  Description of Artificial Sequence: Synthetic oligonucleotide
agaguaggcgagccgagg

SEQ ID NO: 51668 - RNA, 18 nt, Artificial Sequence
  Description of Artificial Sequence: Synthetic oligonucleotide
caugaagaguaggcgagc

SEQ ID NO: 51669 - RNA, 18 nt, Artificial Sequence
  Description of Artificial Sequence: Synthetic oligonucleotide
acggccaugaagaguagg

SEQ ID NO: 51670 - RNA, 18 nt, Artificial Sequence
  Description of Artificial Sequence: Synthetic oligonucleotide
acuugacggccaugaaga

SEQ ID NO: 51671 - RNA, 18 nt, Artificial Sequence
  Description of Artificial Sequence: Synthetic oligonucleotide
ggcccacuugacggccau

SEQ ID NO: 51672 - RNA, 18 nt, Artificial Sequence
  Description of Artificial Sequence: Synthetic oligonucleotide
uucuuggcccacuugacg

SEQ ID NO: 51673 - RNA, 18 nt, Artificial Sequence
  Description of Artificial Sequence: Synthetic oligonucleotide
gcagguucuuggcccacu

SEQ ID NO: 51674 - RNA, 18 nt, Artificial Sequence
  Description of Artificial Sequence: Synthetic oligonucleotide
cacaggcagguucuuggc

SEQ ID NO: 51675 - RNA, 18 nt, Artificial Sequence
  Description of Artificial Sequence: Synthetic oligonucleotide
gagaacacaggcagguuc

SEQ ID NO: 51676 - RNA, 18 nt, Artificial Sequence
  Description of Artificial Sequence: Synthetic oligonucleotide
ggcuggagaacacaggca

SEQ ID NO: 51677 - RNA, 18 nt, Artificial Sequence
  Description of Artificial Sequence: Synthetic oligonucleotide
gggcaggcuggagaacac

SEQ ID NO: 51678 - RNA, 18 nt, Artificial Sequence
  Description of Artificial Sequence: Synthetic oligonucleotide
cggaagggcaggcuggag

SEQ ID NO: 51679 - RNA, 18 nt, Artificial Sequence
  Description of Artificial Sequence: Synthetic oligonucleotide
gaucccggaagggcaggc

SEQ ID NO: 51680 - RNA, 18 nt, Artificial Sequence
  Description of Artificial Sequence: Synthetic oligonucleotide
acaucaauauucucauca

SEQ ID NO: 51681 - RNA, 18 nt, Artificial Sequence
  Description of Artificial Sequence: Synthetic oligonucleotide
uggugacaucaauauucu

SEQ ID NO: 51682 - RNA, 18 nt, Artificial Sequence
  Description of Artificial Sequence: Synthetic oligonucleotide
auugcuggugacaucaau

SEQ ID NO: 51683 - RNA, 18 nt, Artificial Sequence
  Description of Artificial Sequence: Synthetic oligonucleotide
gggucauugcuggugaca

SEQ ID NO: 51684 - RNA, 18 nt, Artificial Sequence
  Description of Artificial Sequence: Synthetic oligonucleotide
acucagggucauugcugg

SEQ ID NO: 51685 - RNA, 18 nt, Artificial Sequence
  Description of Artificial Sequence: Synthetic oligonucleotide
ggaguauggagaggaggg

SEQ ID NO: 51686 - RNA, 18 nt, Artificial Sequence
  Description of Artificial Sequence: Synthetic oligonucleotide
gaagaggaguauggagag

SEQ ID NO: 51687 - RNA, 18 nt, Artificial Sequence
  Description of Artificial Sequence: Synthetic oligonucleotide
gggaggaagaggaguaug

SEQ ID NO: 51688 - RNA, 18 nt, Artificial Sequence
  Description of Artificial Sequence: Synthetic oligonucleotide
gcuguccaggccgcaggg

SEQ ID NO: 51689 - RNA, 18 nt, Artificial Sequence
  Description of Artificial Sequence: Synthetic oligonucleotide
augcuguccaggccgcag

SEQ ID NO: 51690 - RNA, 18 nt, Artificial Sequence
  Description of Artificial Sequence: Synthetic oligonucleotide
cauggaugcuguccaggc

SEQ ID NO: 51691 - RNA, 18 nt, Artificial Sequence
  Description of Artificial Sequence: Synthetic oligonucleotide
ggucucauggaugcuguc

SEQ ID NO: 51692 - RNA, 18 nt, Artificial Sequence
  Description of Artificial Sequence: Synthetic oligonucleotide
gccgaggucucauggaug

SEQ ID NO: 51693 - RNA, 18 nt, Artificial Sequence
  Description of Artificial Sequence: Synthetic oligonucleotide
ggcgagccgaggucucau

SEQ ID NO: 51694 - RNA, 18 nt, Artificial Sequence
  Description of Artificial Sequence: Synthetic oligonucleotide
gaguaggcgagccgaggu

SEQ ID NO: 51695 - RNA, 18 nt, Artificial Sequence
  Description of Artificial Sequence: Synthetic oligonucleotide
augaagaguaggcgagcc

SEQ ID NO: 51696 - RNA, 18 nt, Artificial Sequence
  Description of Artificial Sequence: Synthetic oligonucleotide
cggccaugaagaguaggc

SEQ ID NO: 51697 - RNA, 18 nt, Artificial Sequence
  Description of Artificial Sequence: Synthetic oligonucleotide
cuugacggccaugaagag

SEQ ID NO: 51698 - RNA, 18 nt, Artificial Sequence
  Description of Artificial Sequence: Synthetic oligonucleotide
gcccacuugacggccaug

SEQ ID NO: 51699 - RNA, 18 nt, Artificial Sequence
  Description of Artificial Sequence: Synthetic oligonucleotide
ucuuggcccacuugacgg

SEQ ID NO: 51700 - RNA, 18 nt, Artificial Sequence
  Description of Artificial Sequence: Synthetic oligonucleotide
cagguucuuggcccacuu

SEQ ID NO: 51701 - RNA, 18 nt, Artificial Sequence
  Description of Artificial Sequence: Synthetic oligonucleotide
acaggcagguucuuggcc

SEQ ID NO: 51702 - RNA, 18 nt, Artificial Sequence
  Description of Artificial Sequence: Synthetic oligonucleotide
agaacacaggcagguucu

SEQ ID NO: 51703 - RNA, 18 nt, Artificial Sequence
  Description of Artificial Sequence: Synthetic oligonucleotide
gcuggagaacacaggcag

SEQ ID NO: 51704 - RNA, 18 nt, Artificial Sequence
  Description of Artificial Sequence: Synthetic oligonucleotide
ggcaggcuggagaacaca

SEQ ID NO: 51705 - RNA, 18 nt, Artificial Sequence
  Description of Artificial Sequence: Synthetic oligonucleotide
ggaagggcaggcuggaga

SEQ ID NO: 51706 - RNA, 18 nt, Artificial Sequence
  Description of Artificial Sequence: Synthetic oligonucleotide
aucccggaagggcaggcu

SEQ ID NO: 51707 - RNA, 18 nt, Artificial Sequence
  Description of Artificial Sequence: Synthetic oligonucleotide
ccagcaggcaggccggua

SEQ ID NO: 51708 - RNA, 18 nt, Artificial Sequence
  Description of Artificial Sequence: Synthetic oligonucleotide
gcuccccagcaggcaggc

SEQ ID NO: 51709 - RNA, 18 nt, Artificial Sequence
  Description of Artificial Sequence: Synthetic oligonucleotide
gccuagcuccccagcagg

SEQ ID NO: 51710 - RNA, 18 nt, Artificial Sequence
  Description of Artificial Sequence: Synthetic oligonucleotide
gcccagccuagcucccca

SEQ ID NO: 51711 - RNA, 18 nt, Artificial Sequence
  Description of Artificial Sequence: Synthetic oligonucleotide
ccccagcccagccuagcu

SEQ ID NO: 51712 - RNA, 18 nt, Artificial Sequence
  Description of Artificial Sequence: Synthetic oligonucleotide
ccugaccccagcccagcc

SEQ ID NO: 51713 - RNA, 18 nt, Artificial Sequence
  Description of Artificial Sequence: Synthetic oligonucleotide
ggccgccugaccccagcc

SEQ ID NO: 51714 - RNA, 18 nt, Artificial Sequence
  Description of Artificial Sequence: Synthetic oligonucleotide
gagugggccgccugaccc

SEQ ID NO: 51715 - RNA, 18 nt, Artificial Sequence
  Description of Artificial Sequence: Synthetic oligonucleotide
gacucgagugggccgccu

SEQ ID NO: 51716 - RNA, 18 nt, Artificial Sequence
  Description of Artificial Sequence: Synthetic oligonucleotide
ugguugacucgagugggc

SEQ ID NO: 51717 - RNA, 18 nt, Artificial Sequence
  Description of Artificial Sequence: Synthetic oligonucleotide
cugucugguugacucgag

SEQ ID NO: 51718 - RNA, 18 nt, Artificial Sequence
  Description of Artificial Sequence: Synthetic oligonucleotide
gugcccugucugguugac

SEQ ID NO: 51719 - RNA, 18 nt, Artificial Sequence
  Description of Artificial Sequence: Synthetic oligonucleotide
ugugugugcccugucugg

SEQ ID NO: 51720 - RNA, 18 nt, Artificial Sequence
  Description of Artificial Sequence: Synthetic oligonucleotide
gggaugugugugcccugu

SEQ ID NO: 51721 - RNA, 18 nt, Artificial Sequence
  Description of Artificial Sequence: Synthetic oligonucleotide
cauucauacuggcguggg

SEQ ID NO: 51722 - RNA, 18 nt, Artificial Sequence
  Description of Artificial Sequence: Synthetic oligonucleotide
gugugcauucauacuggc

SEQ ID NO: 51723 - RNA, 18 nt, Artificial Sequence
  Description of Artificial Sequence: Synthetic oligonucleotide
aagcugugugcauucaua

SEQ ID NO: 51724 - RNA, 18 nt, Artificial Sequence
  Description of Artificial Sequence: Synthetic oligonucleotide
cauccaagcugugugcau

SEQ ID NO: 51725 - RNA, 18 nt, Artificial Sequence
  Description of Artificial Sequence: Synthetic oligonucleotide
aucaccauccaagcugug

SEQ ID NO: 51726 - RNA, 18 nt, Artificial Sequence
  Description of Artificial Sequence: Synthetic oligonucleotide
cagccaucaccauccaag

SEQ ID NO: 51727 - RNA, 18 nt, Artificial Sequence
  Description of Artificial Sequence: Synthetic oligonucleotide
guccccagccaucaccau

SEQ ID NO: 51728 - RNA, 18 nt, Artificial Sequence
  Description of Artificial Sequence: Synthetic oligonucleotide
uguguguccccagccauc

SEQ ID NO: 51729 - RNA, 18 nt, Artificial Sequence
  Description of Artificial Sequence: Synthetic oligonucleotide
agguauguguguccccag

SEQ ID NO: 51730 - RNA, 18 nt, Artificial Sequence
  Description of Artificial Sequence: Synthetic oligonucleotide
aucagagguauguguguc

SEQ ID NO: 51731 - RNA, 18 nt, Artificial Sequence
  Description of Artificial Sequence: Synthetic oligonucleotide
gcugaaucagagguaugu

SEQ ID NO: 51732 - RNA, 18 nt, Artificial Sequence
  Description of Artificial Sequence: Synthetic oligonucleotide
ccaucgcugaaucagagg

SEQ ID NO: 51733 - RNA, 18 nt, Artificial Sequence
  Description of Artificial Sequence: Synthetic oligonucleotide
cccagccaucgcugaauc

SEQ ID NO: 51734 - RNA, 18 nt, Artificial Sequence
  Description of Artificial Sequence: Synthetic oligonucleotide
ugcaccccagccaucgcu

SEQ ID NO: 51735 - RNA, 18 nt, Artificial Sequence
  Description of Artificial Sequence: Synthetic oligonucleotide
ugagaugcaccccagcca

SEQ ID NO: 51736 - RNA, 18 nt, Artificial Sequence
  Description of Artificial Sequence: Synthetic oligonucleotide
aucccugagaugcacccc

SEQ ID NO: 51737 - RNA, 18 nt, Artificial Sequence
  Description of Artificial Sequence: Synthetic oligonucleotide
ucaccaucccugagaugc

SEQ ID NO: 51738 - RNA, 18 nt, Artificial Sequence
  Description of Artificial Sequence: Synthetic oligonucleotide
caccgucaccaucccuga

SEQ ID NO: 51739 - RNA, 18 nt, Artificial Sequence
  Description of Artificial Sequence: Synthetic oligonucleotide
acccccaccgucaccauc

SEQ ID NO: 51740 - RNA, 18 nt, Artificial Sequence
  Description of Artificial Sequence: Synthetic oligonucleotide
caugcacccccaccguca

SEQ ID NO: 51741 - RNA, 18 nt, Artificial Sequence
  Description of Artificial Sequence: Synthetic oligonucleotide
agaugcaugcacccccac

SEQ ID NO: 51742 - RNA, 18 nt, Artificial Sequence
  Description of Artificial Sequence: Synthetic oligonucleotide
gccagagaugcaugcacc

SEQ ID NO: 51743 - RNA, 18 nt, Artificial Sequence
  Description of Artificial Sequence: Synthetic oligonucleotide
ccugugccagagaugcau

SEQ ID NO: 51744 - RNA, 18 nt, Artificial Sequence
  Description of Artificial Sequence: Synthetic oligonucleotide
ucaucccugugccagaga

SEQ ID NO: 51745 - RNA, 18 nt, Artificial Sequence
  Description of Artificial Sequence: Synthetic oligonucleotide
gaccaucaucccugugcc

SEQ ID NO: 51746 - RNA, 18 nt, Artificial Sequence
  Description of Artificial Sequence: Synthetic oligonucleotide
accccgaccaucaucccu

SEQ ID NO: 51747 - RNA, 18 nt, Artificial Sequence
  Description of Artificial Sequence: Synthetic oligonucleotide
ugugcaccccgaccauca

SEQ ID NO: 51748 - RNA, 18 nt, Artificial Sequence
  Description of Artificial Sequence: Synthetic oligonucleotide
cuaggugugcaccccgac

SEQ ID NO: 51749 - RNA, 18 nt, Artificial Sequence
  Description of Artificial Sequence: Synthetic oligonucleotide
aucuccuaggugugcacc

SEQ ID NO: 51750 - RNA, 18 nt, Artificial Sequence
  Description of Artificial Sequence: Synthetic oligonucleotide
ucaucaucuccuaggugu

SEQ ID NO: 51751 - RNA, 18 nt, Artificial Sequence
  Description of Artificial Sequence: Synthetic oligonucleotide
agccaucaucaucuccua

SEQ ID NO: 51752 - RNA, 18 nt, Artificial Sequence
  Description of Artificial Sequence: Synthetic oligonucleotide
ucccuagccaucaucauc

SEQ ID NO: 51753 - RNA, 18 nt, Artificial Sequence
  Description of Artificial Sequence: Synthetic oligonucleotide
guaggucccuagccauca

SEQ ID NO: 51754 - RNA, 18 nt, Artificial Sequence
  Description of Artificial Sequence: Synthetic oligonucleotide
gcccuguaggucccuagc

SEQ ID NO: 51755 - RNA, 18 nt, Artificial Sequence
  Description of Artificial Sequence: Synthetic oligonucleotide
ccugggcccuguaggucc

SEQ ID NO: 51756 - RNA, 18 nt, Artificial Sequence
  Description of Artificial Sequence: Synthetic oligonucleotide
aagacccugggcccugua

SEQ ID NO: 51757 - RNA, 18 nt, Artificial Sequence
  Description of Artificial Sequence: Synthetic oligonucleotide
uuaagaagacccugggcc

SEQ ID NO: 51758 - RNA, 18 nt, Artificial Sequence
  Description of Artificial Sequence: Synthetic oligonucleotide
agaacuuaagaagacccu

SEQ ID NO: 51759 - RNA, 18 nt, Artificial Sequence
  Description of Artificial Sequence: Synthetic oligonucleotide
cuuccagaacuuaagaag

SEQ ID NO: 51760 - RNA, 18 nt, Artificial Sequence
  Description of Artificial Sequence: Synthetic oligonucleotide
agggucuuccagaacuua

SEQ ID NO: 51761 - RNA, 18 nt, Artificial Sequence
  Description of Artificial Sequence: Synthetic oligonucleotide
gccugagggucuuccaga

SEQ ID NO: 51762 - RNA, 18 nt, Artificial Sequence
  Description of Artificial Sequence: Synthetic oligonucleotide
gcagggccugagggucuu

SEQ ID NO: 51763 - RNA, 18 nt, Artificial Sequence
  Description of Artificial Sequence: Synthetic oligonucleotide
ugucugcagggccugagg

SEQ ID NO: 51764 - RNA, 18 nt, Artificial Sequence
  Description of Artificial Sequence: Synthetic oligonucleotide
cagaaugucugcagggcc

SEQ ID NO: 51765 - RNA, 18 nt, Artificial Sequence
  Description of Artificial Sequence: Synthetic oligonucleotide
acccacagaaugucugca

SEQ ID NO: 51766 - RNA, 18 nt, Artificial Sequence
  Description of Artificial Sequence: Synthetic oligonucleotide
uuguuacccacagaaugu

SEQ ID NO: 51767 - RNA, 18 nt, Artificial Sequence
  Description of Artificial Sequence: Synthetic oligonucleotide
gucacuuguuacccacag

SEQ ID NO: 51768 - RNA, 18 nt, Artificial Sequence
  Description of Artificial Sequence: Synthetic oligonucleotide
ugcaggucacuuguuacc

SEQ ID NO: 51769 - RNA, 18 nt, Artificial Sequence
  Description of Artificial Sequence: Synthetic oligonucleotide
gggugugcaggucacuug

SEQ ID NO: 51770 - RNA, 18 nt, Artificial Sequence
  Description of Artificial Sequence: Synthetic oligonucleotide
guucagggugugcagguc

SEQ ID NO: 51771 - RNA, 18 nt, Artificial Sequence
  Description of Artificial Sequence: Synthetic oligonucleotide
agccuguucagggugugc

SEQ ID NO: 51772 - RNA, 18 nt, Artificial Sequence
  Description of Artificial Sequence: Synthetic oligonucleotide
cacucagccuguucaggg

SEQ ID NO: 51773 - RNA, 18 nt, Artificial Sequence
  Description of Artificial Sequence: Synthetic oligonucleotide
ucagccacucagccuguu

SEQ ID NO: 51774 - RNA, 18 nt, Artificial Sequence
  Description of Artificial Sequence: Synthetic oligonucleotide
uagagucagccacucagc

SEQ ID NO: 51775 - RNA, 18 nt, Artificial Sequence
  Description of Artificial Sequence: Synthetic oligonucleotide
gggccuagagucagccac

SEQ ID NO: 51776 - RNA, 18 nt, Artificial Sequence
  Description of Artificial Sequence: Synthetic oligonucleotide
uaggcacuugugcuccaa

SEQ ID NO: 51777 - RNA, 18 nt, Artificial Sequence
  Description of Artificial Sequence: Synthetic oligonucleotide
agucguaggcacuugugc

SEQ ID NO: 51778 - RNA, 18 nt, Artificial Sequence
  Description of Artificial Sequence: Synthetic oligonucleotide
ccugaagucguaggcacu

SEQ ID NO: 51779 - RNA, 18 nt, Artificial Sequence
  Description of Artificial Sequence: Synthetic oligonucleotide
caagcccugaagucguag

SEQ ID NO: 51780 - RNA, 18 nt, Artificial Sequence
  Description of Artificial Sequence: Synthetic oligonucleotide
aaaugcaagcccugaagu

SEQ ID NO: 51781 - RNA, 18 nt, Artificial Sequence
  Description of Artificial Sequence: Synthetic oligonucleotide
aacuaaaaugcaagcccu

SEQ ID NO: 51782 - RNA, 18 nt, Artificial Sequence
  Description of Artificial Sequence: Synthetic oligonucleotide
gauugaacuaaaaugcaa

SEQ ID NO: 51783 - RNA, 18 nt, Artificial Sequence
  Description of Artificial Sequence: Synthetic oligonucleotide
ggagagauugaacuaaaa

SEQ ID NO: 51784 - RNA, 18 nt, Artificial Sequence
  Description of Artificial Sequence: Synthetic oligonucleotide
gagcuggagagauugaac

SEQ ID NO: 51785 - RNA, 18 nt, Artificial Sequence
  Description of Artificial Sequence: Synthetic oligonucleotide
gcccagagcuggagagau

SEQ ID NO: 51786 - RNA, 18 nt, Artificial Sequence
  Description of Artificial Sequence: Synthetic oligonucleotide
ggauggcccagagcugga

SEQ ID NO: 51787 - RNA, 18 nt, Artificial Sequence
  Description of Artificial Sequence: Synthetic oligonucleotide
gagagggauggcccagag

SEQ ID NO: 51788 - RNA, 18 nt, Artificial Sequence
  Description of Artificial Sequence: Synthetic oligonucleotide
aagccgagagggauggcc

SEQ ID NO: 51789 - RNA, 18 nt, Artificial Sequence
  Description of Artificial Sequence: Synthetic oligonucleotide
auuagaagccgagaggga

SEQ ID NO: 51790 - RNA, 18 nt, Artificial Sequence
  Description of Artificial Sequence: Synthetic oligonucleotide
ugcccauuagaagccgag

SEQ ID NO: 51791 - RNA, 18 nt, Artificial Sequence
  Description of Artificial Sequence: Synthetic oligonucleotide
cugcuugcccauuagaag

SEQ ID NO: 51792 - RNA, 18 nt, Artificial Sequence
  Description of Artificial Sequence: Synthetic oligonucleotide
gagagauugaacuaaaau

SEQ ID NO: 51793 - RNA, 18 nt, Artificial Sequence
  Description of Artificial Sequence: Synthetic oligonucleotide
agcuggagagauugaacu

SEQ ID NO: 51794 - RNA, 18 nt, Artificial Sequence
  Description of Artificial Sequence: Synthetic oligonucleotide
cccagagcuggagagauu

SEQ ID NO: 51795 - RNA, 18 nt, Artificial Sequence
  Description of Artificial Sequence: Synthetic oligonucleotide
gauggcccagagcuggag

SEQ ID NO: 51796 - RNA, 18 nt, Artificial Sequence
  Description of Artificial Sequence: Synthetic oligonucleotide
agagggauggcccagagc

SEQ ID NO: 51797 - RNA, 18 nt, Artificial Sequence
  Description of Artificial Sequence: Synthetic oligonucleotide
agccgagagggauggccc

SEQ ID NO: 51798 - RNA, 18 nt, Artificial Sequence
  Description of Artificial Sequence: Synthetic oligonucleotide
uuagaagccgagagggau

SEQ ID NO: 51799 - RNA, 18 nt, Artificial Sequence
  Description of Artificial Sequence: Synthetic oligonucleotide
gcccauuagaagccgaga

SEQ ID NO: 51800 - RNA, 18 nt, Artificial Sequence
  Description of Artificial Sequence: Synthetic oligonucleotide
ugcuugcccauuagaagc

SEQ ID NO: 51801 - RNA, 18 nt, Artificial Sequence
  Description of Artificial Sequence: Synthetic oligonucleotide
agaucugcuugcccauua

SEQ ID NO: 51802 - RNA, 18 nt, Artificial Sequence
  Description of Artificial Sequence: Synthetic oligonucleotide
cugaaagaucugcuugcc

SEQ ID NO: 51803 - RNA, 18 nt, Artificial Sequence
  Description of Artificial Sequence: Synthetic oligonucleotide
uuuuccugaaagaucugc

SEQ ID NO: 51804 - RNA, 18 nt, Artificial Sequence
  Description of Artificial Sequence: Synthetic oligonucleotide
ccugguuuuccugaaaga

SEQ ID NO: 51805 - RNA, 18 nt, Artificial Sequence
  Description of Artificial Sequence: Synthetic oligonucleotide
cuccuccugguuuuccug

SEQ ID NO: 51806 - RNA, 18 nt, Artificial Sequence
  Description of Artificial Sequence: Synthetic oligonucleotide
ugccucuccuccugguuu

SEQ ID NO: 51807 - RNA, 18 nt, Artificial Sequence
  Description of Artificial Sequence: Synthetic oligonucleotide
ccucaugccucuccuccu

SEQ ID NO: 51808 - RNA, 18 nt, Artificial Sequence
  Description of Artificial Sequence: Synthetic oligonucleotide
acccuccucaugccucuc

SEQ ID NO: 51809 - RNA, 18 nt, Artificial Sequence
  Description of Artificial Sequence: Synthetic oligonucleotide
cucaaacccuccucaugc

SEQ ID NO: 51810 - RNA, 18 nt, Artificial Sequence
  Description of Artificial Sequence: Synthetic oligonucleotide
agggccucaaacccuccu

SEQ ID NO: 51811 - RNA, 18 nt, Artificial Sequence
  Description of Artificial Sequence: Synthetic oligonucleotide
ggcugagggccucaaacc

SEQ ID NO: 51812 - RNA, 18 nt, Artificial Sequence
  Description of Artificial Sequence: Synthetic oligonucleotide
agacuggcugagggccuc

SEQ ID NO: 51813 - RNA, 18 nt, Artificial Sequence
  Description of Artificial Sequence: Synthetic oligonucleotide
cacacagacuggcugagg

SEQ ID NO: 51814 - RNA, 18 nt, Artificial Sequence
  Description of Artificial Sequence: Synthetic oligonucleotide
cccagcacacagacuggc

SEQ ID NO: 51815 - RNA, 18 nt, Artificial Sequence
  Description of Artificial Sequence: Synthetic oligonucleotide
uccaccccagcacacaga

SEQ ID NO: 51816 - RNA, 18 nt, Artificial Sequence
  Description of Artificial Sequence: Synthetic oligonucleotide
guugcuccaccccagcac

SEQ ID NO: 51817 - RNA, 18 nt, Artificial Sequence
  Description of Artificial Sequence: Synthetic oligonucleotide
ucugaguugcuccacccc

SEQ ID NO: 51818 - RNA, 18 nt, Artificial Sequence
  Description of Artificial Sequence: Synthetic oligonucleotide
acucuucugaguugcucc

SEQ ID NO: 51819 - RNA, 18 nt, Artificial Sequence
  Description of Artificial Sequence: Synthetic oligonucleotide
gccugacucuucugaguu

SEQ ID NO: 51820 - RNA, 18 nt, Artificial Sequence
  Description of Artificial Sequence: Synthetic oligonucleotide
guguggccugacucuucu

SEQ ID NO: 51821 - RNA, 18 nt, Artificial Sequence
  Description of Artificial Sequence: Synthetic oligonucleotide
aagugguguggccugacu

SEQ ID NO: 51822 - RNA, 18 nt, Artificial Sequence
  Description of Artificial Sequence: Synthetic oligonucleotide
uauucaagugguguggcc

SEQ ID NO: 51823 - RNA, 18 nt, Artificial Sequence
  Description of Artificial Sequence: Synthetic oligonucleotide
gaguguauucaaguggug

SEQ ID NO: 51824 - RNA, 18 nt, Artificial Sequence
  Description of Artificial Sequence: Synthetic oligonucleotide
aaguugaguguauucaag

SEQ ID NO: 51825 - RNA, 18 nt, Artificial Sequence
  Description of Artificial Sequence: Synthetic oligonucleotide
guccuaaguugaguguau

SEQ ID NO: 51826 - RNA, 18 nt, Artificial Sequence
  Description of Artificial Sequence: Synthetic oligonucleotide
ugaguguccuaaguugag

SEQ ID NO: 51827 - RNA, 18 nt, Artificial Sequence
  Description of Artificial Sequence: Synthetic oligonucleotide
ccucaugaguguccuaag

SEQ ID NO: 51828 - RNA, 18 nt, Artificial Sequence
  Description of Artificial Sequence: Synthetic oligonucleotide
acaugccucaugaguguc

SEQ ID NO: 51829 - RNA, 18 nt, Artificial Sequence
  Description of Artificial Sequence: Synthetic oligonucleotide
cagagacaugccucauga

SEQ ID NO: 51830 - RNA, 18 nt, Artificial Sequence
  Description of Artificial Sequence: Synthetic oligonucleotide
agccucagagacaugccu

SEQ ID NO: 51831 - RNA, 18 nt, Artificial Sequence
  Description of Artificial Sequence: Synthetic oligonucleotide
ugggcagccucagagaca

SEQ ID NO: 51832 - RNA, 18 nt, Artificial Sequence
  Description of Artificial Sequence: Synthetic oligonucleotide
gaaguugggcagccucag

SEQ ID NO: 51833 - RNA, 18 nt, Artificial Sequence
  Description of Artificial Sequence: Synthetic oligonucleotide
cauuggaaguugggcagc

SEQ ID NO: 51834 - RNA, 18 nt, Artificial Sequence
  Description of Artificial Sequence: Synthetic oligonucleotide
agagccauuggaaguugg

SEQ ID NO: 51835 - RNA, 18 nt, Artificial Sequence
  Description of Artificial Sequence: Synthetic oligonucleotide
cgcccagagccauuggaa

SEQ ID NO: 51836 - RNA, 18 nt, Artificial Sequence
  Description of Artificial Sequence: Synthetic oligonucleotide
aggaacgcccagagccau

SEQ ID NO: 51837 - RNA, 18 nt, Artificial Sequence
  Description of Artificial Sequence: Synthetic oligonucleotide
cauuuaggaacgcccaga

SEQ ID NO: 51838 - RNA, 18 nt, Artificial Sequence
  Description of Artificial Sequence: Synthetic oligonucleotide
ugggacauuuaggaacgc

SEQ ID NO: 51839 - RNA, 18 nt, Artificial Sequence
  Description of Artificial Sequence: Synthetic oligonucleotide
gcagcugggacauuuagg

SEQ ID NO: 51840 - RNA, 18 nt, Artificial Sequence
  Description of Artificial Sequence: Synthetic oligonucleotide
gagcugcagcugggacau

SEQ ID NO: 51841 - RNA, 18 nt, Artificial Sequence
  Description of Artificial Sequence: Synthetic oligonucleotide
auccagagcugcagcugg

SEQ ID NO: 51842 - RNA, 18 nt, Artificial Sequence
  Description of Artificial Sequence: Synthetic oligonucleotide
guuccauccagagcugca

SEQ ID NO: 51843 - RNA, 18 nt, Artificial Sequence
  Description of Artificial Sequence: Synthetic oligonucleotide
acuggguuccauccagag

SEQ ID NO: 51844 - RNA, 18 nt, Artificial Sequence
  Description of Artificial Sequence: Synthetic oligonucleotide
gagacacuggguuccauc

SEQ ID NO: 51845 - RNA, 18 nt, Artificial Sequence
  Description of Artificial Sequence: Synthetic oligonucleotide
caucugagacacuggguu

SEQ ID NO: 51846 - RNA, 18 nt, Artificial Sequence
  Description of Artificial Sequence: Synthetic oligonucleotide
ccuaucaucugagacacu

SEQ ID NO: 51847 - RNA, 18 nt, Artificial Sequence
  Description of Artificial Sequence: Synthetic oligonucleotide
agcugccuaucaucugag

SEQ ID NO: 51848 - RNA, 18 nt, Artificial Sequence
  Description of Artificial Sequence: Synthetic oligonucleotide
ggcucagcugccuaucau

SEQ ID NO: 51849 - RNA, 18 nt, Artificial Sequence
  Description of Artificial Sequence: Synthetic oligonucleotide
cauccggcucagcugccu

SEQ ID NO: 51850 - RNA, 18 nt, Artificial Sequence
  Description of Artificial Sequence: Synthetic oligonucleotide
ggcaccauccggcucagc

SEQ ID NO: 51851 - RNA, 18 nt, Artificial Sequence
  Description of Artificial Sequence: Synthetic oligonucleotide
gauuuggcaccauccggc

SEQ ID NO: 51852 - RNA, 18 nt, Artificial Sequence
  Description of Artificial Sequence: Synthetic oligonucleotide
ucugggauuuggcaccau

SEQ ID NO: 51853 - RNA, 18 nt, Artificial Sequence
  Description of Artificial Sequence: Synthetic oligonucleotide
agagcucugggauuuggc

SEQ ID NO: 51854 - RNA, 18 nt, Artificial Sequence
  Description of Artificial Sequence: Synthetic oligonucleotide
ggcucagagcucugggau

SEQ ID NO: 51855 - RNA, 18 nt, Artificial Sequence
  Description of Artificial Sequence: Synthetic oligonucleotide
ccagaggcucagagcucu

SEQ ID NO: 51856 - RNA, 18 nt, Artificial Sequence
  Description of Artificial Sequence: Synthetic oligonucleotide
aucagccagaggcucaga

SEQ ID NO: 51857 - RNA, 18 nt, Artificial Sequence
  Description of Artificial Sequence: Synthetic oligonucleotide
cugacaucagccagaggc

SEQ ID NO: 51858 - RNA, 18 nt, Artificial Sequence
  Description of Artificial Sequence: Synthetic oligonucleotide
cucuccugacaucagcca

SEQ ID NO: 51859 - RNA, 18 nt, Artificial Sequence
  Description of Artificial Sequence: Synthetic oligonucleotide
gaaugcucuccugacauc

SEQ ID NO: 51860 - RNA, 18 nt, Artificial Sequence
  Description of Artificial Sequence: Synthetic oligonucleotide
cccgagaaugcucuccug

SEQ ID NO: 51861 - RNA, 18 nt, Artificial Sequence
  Description of Artificial Sequence: Synthetic oligonucleotide
ugggacccgagaaugcuc

SEQ ID NO: 51862 - RNA, 18 nt, Artificial Sequence
  Description of Artificial Sequence: Synthetic oligonucleotide
uguccugggacccgagaa

SEQ ID NO: 51863 - RNA, 18 nt, Artificial Sequence
  Description of Artificial Sequence: Synthetic oligonucleotide
agugcuguccugggaccc

SEQ ID NO: 51864 - RNA, 18 nt, Artificial Sequence
  Description of Artificial Sequence: Synthetic oligonucleotide
auggaagugcuguccugg

SEQ ID NO: 51865 - RNA, 18 nt, Artificial Sequence
  Description of Artificial Sequence: Synthetic oligonucleotide
aaggaauggaagugcugu

SEQ ID NO: 51866 - RNA, 18 nt, Artificial Sequence
  Description of Artificial Sequence: Synthetic oligonucleotide
cacccaaggaauggaagu

SEQ ID NO: 51867 - RNA, 18 nt, Artificial Sequence
  Description of Artificial Sequence: Synthetic oligonucleotide
ucaggcacccaaggaaug

SEQ ID NO: 51868 - RNA, 18 nt, Artificial Sequence
  Description of Artificial Sequence: Synthetic oligonucleotide
ccaucucaggcacccaag

SEQ ID NO: 51869 - RNA, 18 nt, Artificial Sequence
  Description of Artificial Sequence: Synthetic oligonucleotide
ugccaccaucucaggcac

SEQ ID NO: 51870 - RNA, 18 nt, Artificial Sequence
  Description of Artificial Sequence: Synthetic oligonucleotide
gccucugccaccaucuca

SEQ ID NO: 51871 - RNA, 18 nt, Artificial Sequence
  Description of Artificial Sequence: Synthetic oligonucleotide
cuggagccucugccacca

SEQ ID NO: 51872 - RNA, 18 nt, Artificial Sequence
  Description of Artificial Sequence: Synthetic oligonucleotide
ucagucuggagccucugc

SEQ ID NO: 51873 - RNA, 18 nt, Artificial Sequence
  Description of Artificial Sequence: Synthetic oligonucleotide
cuggcucagucuggagcc

SEQ ID NO: 51874 - RNA, 18 nt, Artificial Sequence
  Description of Artificial Sequence: Synthetic oligonucleotide
cuucucuggcucagucug

SEQ ID NO: 51875 - RNA, 18 nt, Artificial Sequence
  Description of Artificial Sequence: Synthetic oligonucleotide
cacagcuucucuggcuca

SEQ ID NO: 51876 - RNA, 18 nt, Artificial Sequence
  Description of Artificial Sequence: Synthetic oligonucleotide
agacacacagcuucucug

SEQ ID NO: 51877 - RNA, 18 nt, Artificial Sequence
  Description of Artificial Sequence: Synthetic oligonucleotide
auggcagacacacagcuu

SEQ ID NO: 51878 - RNA, 18 nt, Artificial Sequence
  Description of Artificial Sequence: Synthetic oligonucleotide
cuguuauggcagacacac

SEQ ID NO: 51879 - RNA, 18 nt, Artificial Sequence
  Description of Artificial Sequence: Synthetic oligonucleotide
ggugccuguuauggcaga

SEQ ID NO: 51880 - RNA, 18 nt, Artificial Sequence
  Description of Artificial Sequence: Synthetic oligonucleotide
ccucuuccagcaggauca

SEQ ID NO: 51881 - RNA, 18 nt, Artificial Sequence
  Description of Artificial Sequence: Synthetic oligonucleotide
ccacgccucuuccagcag

SEQ ID NO: 51882 - RNA, 18 nt, Artificial Sequence
  Description of Artificial Sequence: Synthetic oligonucleotide
ucacuccacgccucuucc

SEQ ID NO: 51883 - RNA, 18 nt, Artificial Sequence
  Description of Artificial Sequence: Synthetic oligonucleotide
agaguucacuccacgccu

SEQ ID NO: 51884 - RNA, 18 nt, Artificial Sequence
  Description of Artificial Sequence: Synthetic oligonucleotide
gagaaagaguucacucca

SEQ ID NO: 51885 - RNA, 18 nt, Artificial Sequence
  Description of Artificial Sequence: Synthetic oligonucleotide
ccgaggagaaagaguuca

SEQ ID NO: 51886 - RNA, 18 nt, Artificial Sequence
  Description of Artificial Sequence: Synthetic oligonucleotide
uggccccgaggagaaaga

SEQ ID NO: 51887 - RNA, 18 nt, Artificial Sequence
  Description of Artificial Sequence: Synthetic oligonucleotide
cuggauggccccgaggag

SEQ ID NO: 51888 - RNA, 18 nt, Artificial Sequence
  Description of Artificial Sequence: Synthetic oligonucleotide
gaccacuggauggccccg

SEQ ID NO: 51889 - RNA, 18 nt, Artificial Sequence
  Description of Artificial Sequence: Synthetic oligonucleotide
gcagagaccacuggaugg

SEQ ID NO: 51890 - RNA, 18 nt, Artificial Sequence
  Description of Artificial Sequence: Synthetic oligonucleotide
cagaggcagagaccacug

SEQ ID NO: 51891 - RNA, 18 nt, Artificial Sequence
  Description of Artificial Sequence: Synthetic oligonucleotide
cuguccagaggcagagac

SEQ ID NO: 51892 - RNA, 18 nt, Artificial Sequence
  Description of Artificial Sequence: Synthetic oligonucleotide
gacagcuguccagaggca

SEQ ID NO: 51893 - RNA, 18 nt, Artificial Sequence
  Description of Artificial Sequence: Synthetic oligonucleotide
cagaggacagcuguccag

SEQ ID NO: 51894 - RNA, 18 nt, Artificial Sequence
  Description of Artificial Sequence: Synthetic oligonucleotide
gccagcagaggacagcug

SEQ ID NO: 51895 - RNA, 18 nt, Artificial Sequence
  Description of Artificial Sequence: Synthetic oligonucleotide
gcggugccagcagaggac

SEQ ID NO: 51896 - RNA, 18 nt, Artificial Sequence
  Description of Artificial Sequence: Synthetic oligonucleotide
cucgggcggugccagcag

SEQ ID NO: 51897 - RNA, 18 nt, Artificial Sequence
  Description of Artificial Sequence: Synthetic oligonucleotide
gaggccucgggcggugcc

SEQ ID NO: 51898 - RNA, 18 nt, Artificial Sequence
  Description of Artificial Sequence: Synthetic oligonucleotide
cagcagaggccucgggcg

SEQ ID NO: 51899 - RNA, 18 nt, Artificial Sequence
  Description of Artificial Sequence: Synthetic oligonucleotide
accggcagcagaggccuc

SEQ ID NO: 51900 - RNA, 18 nt, Artificial Sequence
  Description of Artificial Sequence: Synthetic oligonucleotide
gcaccaccggcagcagag

SEQ ID NO: 51901 - RNA, 18 nt, Artificial Sequence
  Description of Artificial Sequence: Synthetic oligonucleotide
ccugggcaccaccggcag

SEQ ID NO: 51902 - RNA, 18 nt, Artificial Sequence
  Description of Artificial Sequence: Synthetic oligonucleotide
ccggcccugggcaccacc

SEQ ID NO: 51903 - RNA, 18 nt, Artificial Sequence
  Description of Artificial Sequence: Synthetic oligonucleotide
gugagccggcccugggca

SEQ ID NO: 51904 - RNA, 18 nt, Artificial Sequence
  Description of Artificial Sequence: Synthetic oligonucleotide
ccagcgugagccggcccu

SEQ ID NO: 51905 - RNA, 18 nt, Artificial Sequence
  Description of Artificial Sequence: Synthetic oligonucleotide
gcuggccagcgugagccg

SEQ ID NO: 51906 - RNA, 18 nt, Artificial Sequence
  Description of Artificial Sequence: Synthetic oligonucleotide
uccaugcuggccagcgug

SEQ ID NO: 51907 - RNA, 18 nt, Artificial Sequence
  Description of Artificial Sequence: Synthetic oligonucleotide
gcgucuccaugcuggcca

SEQ ID NO: 51908 - RNA, 18 nt, Artificial Sequence
  Description of Artificial Sequence: Synthetic oligonucleotide
gacacgcgucuccaugcu

SEQ ID NO: 51909 - RNA, 18 nt, Artificial Sequence
  Description of Artificial Sequence: Synthetic oligonucleotide
ugcaggacacgcgucucc

SEQ ID NO: 51910 - RNA, 18 nt, Artificial Sequence
  Description of Artificial Sequence: Synthetic oligonucleotide
uuuccugcaggacacgcg

SEQ ID NO: 51911 - RNA, 18 nt, Artificial Sequence
  Description of Artificial Sequence: Synthetic oligonucleotide
gauaguuuccugcaggac

SEQ ID NO: 51912 - RNA, 18 nt, Artificial Sequence
  Description of Artificial Sequence: Synthetic oligonucleotide
cgagagauaguuuccugc

SEQ ID NO: 51913 - RNA, 18 nt, Artificial Sequence
  Description of Artificial Sequence: Synthetic oligonucleotide
ggaaccgagagauaguuu

SEQ ID NO: 51914 - RNA, 18 nt, Artificial Sequence
  Description of Artificial Sequence: Synthetic oligonucleotide
ugcccggaaccgagagau

SEQ ID NO: 51915 - RNA, 18 nt, Artificial Sequence
  Description of Artificial Sequence: Synthetic oligonucleotide
gccaaugcccggaaccga

SEQ ID NO: 51916 - RNA, 18 nt, Artificial Sequence
  Description of Artificial Sequence: Synthetic oligonucleotide
ccaccgccaaugcccgga

SEQ ID NO: 51917 - RNA, 18 nt, Artificial Sequence
  Description of Artificial Sequence: Synthetic oligonucleotide
acgccucuuccagcagga

SEQ ID NO: 51918 - RNA, 18 nt, Artificial Sequence
  Description of Artificial Sequence: Synthetic oligonucleotide
acuccacgccucuuccag

SEQ ID NO: 51919 - RNA, 18 nt, Artificial Sequence
  Description of Artificial Sequence: Synthetic oligonucleotide
aguucacuccacgccucu

SEQ ID NO: 51920 - RNA, 18 nt, Artificial Sequence
  Description of Artificial Sequence: Synthetic oligonucleotide
gaaagaguucacuccacg

SEQ ID NO: 51921 - RNA, 18 nt, Artificial Sequence
  Description of Artificial Sequence: Synthetic oligonucleotide
gaggagaaagaguucacu

SEQ ID NO: 51922 - RNA, 18 nt, Artificial Sequence
  Description of Artificial Sequence: Synthetic oligonucleotide
gccccgaggagaaagagu

SEQ ID NO: 51923 - RNA, 18 nt, Artificial Sequence
  Description of Artificial Sequence: Synthetic oligonucleotide
ggauggccccgaggagaa

SEQ ID NO: 51924 - RNA, 18 nt, Artificial Sequence
  Description of Artificial Sequence: Synthetic oligonucleotide
ccacuggauggccccgag

SEQ ID NO: 51925 - RNA, 18 nt, Artificial Sequence
  Description of Artificial Sequence: Synthetic oligonucleotide
agagaccacuggauggcc

SEQ ID NO: 51926 - RNA, 18 nt, Artificial Sequence
  Description of Artificial Sequence: Synthetic oligonucleotide
gaggcagagaccacugga

SEQ ID NO: 51927 - RNA, 18 nt, Artificial Sequence
  Description of Artificial Sequence: Synthetic oligonucleotide
guccagaggcagagacca

SEQ ID NO: 51928 - RNA, 18 nt, Artificial Sequence
  Description of Artificial Sequence: Synthetic oligonucleotide
cagcuguccagaggcaga

SEQ ID NO: 51929 - RNA, 18 nt, Artificial Sequence
  Description of Artificial Sequence: Synthetic oligonucleotide
gaggacagcuguccagag

SEQ ID NO: 51930 - RNA, 18 nt, Artificial Sequence
  Description of Artificial Sequence: Synthetic oligonucleotide
cagcagaggacagcuguc

SEQ ID NO: 51931 - RNA, 18 nt, Artificial Sequence
  Description of Artificial Sequence: Synthetic oligonucleotide
ggugccagcagaggacag

SEQ ID NO: 51932 - RNA, 18 nt, Artificial Sequence
  Description of Artificial Sequence: Synthetic oligonucleotide
cgggcggugccagcagag

SEQ ID NO: 51933 - RNA, 18 nt, Artificial Sequence
  Description of Artificial Sequence: Synthetic oligonucleotide
ggccucgggcggugccag

SEQ ID NO: 51934 - RNA, 18 nt, Artificial Sequence
  Description of Artificial Sequence: Synthetic oligonucleotide
gcagaggccucgggcggu

SEQ ID NO: 51935 - RNA, 18 nt, Artificial Sequence
  Description of Artificial Sequence: Synthetic oligonucleotide
cggcagcagaggccucgg

SEQ ID NO: 51936 - RNA, 18 nt, Artificial Sequence
  Description of Artificial Sequence: Synthetic oligonucleotide
accaccggcagcagaggc

SEQ ID NO: 51937 - RNA, 18 nt, Artificial Sequence
  Description of Artificial Sequence: Synthetic oligonucleotide
ugggcaccaccggcagca

SEQ ID NO: 51938 - RNA, 18 nt, Artificial Sequence
  Description of Artificial Sequence: Synthetic oligonucleotide
ggcccugggcaccaccgg

SEQ ID NO: 51939 - RNA, 18 nt, Artificial Sequence
  Description of Artificial Sequence: Synthetic oligonucleotide
gagccggcccugggcacc

SEQ ID NO: 51940 - RNA, 18 nt, Artificial Sequence
  Description of Artificial Sequence: Synthetic oligonucleotide
agcgugagccggcccugg

SEQ ID NO: 51941 - RNA, 18 nt, Artificial Sequence
  Description of Artificial Sequence: Synthetic oligonucleotide
uggccagcgugagccggc

SEQ ID NO: 51942 - RNA, 18 nt, Artificial Sequence
  Description of Artificial Sequence: Synthetic oligonucleotide
caugcuggccagcgugag

SEQ ID NO: 51943 - RNA, 18 nt, Artificial Sequence
  Description of Artificial Sequence: Synthetic oligonucleotide
gucuccaugcuggccagc

SEQ ID NO: 51944 - RNA, 18 nt, Artificial Sequence
  Description of Artificial Sequence: Synthetic oligonucleotide
cacgcgucuccaugcugg

SEQ ID NO: 51945 - RNA, 18 nt, Artificial Sequence
  Description of Artificial Sequence: Synthetic oligonucleotide
caggacacgcgucuccau

SEQ ID NO: 51946 - RNA, 18 nt, Artificial Sequence
  Description of Artificial Sequence: Synthetic oligonucleotide
uccugcaggacacgcguc

SEQ ID NO: 51947 - RNA, 18 nt, Artificial Sequence
  Description of Artificial Sequence: Synthetic oligonucleotide
uaguuuccugcaggacac

SEQ ID NO: 51948 - RNA, 18 nt, Artificial Sequence
  Description of Artificial Sequence: Synthetic oligonucleotide
agagauaguuuccugcag

SEQ ID NO: 51949 - RNA, 18 nt, Artificial Sequence
  Description of Artificial Sequence: Synthetic oligonucleotide
aaccgagagauaguuucc

SEQ ID NO: 51950 - RNA, 18 nt, Artificial Sequence
  Description of Artificial Sequence: Synthetic oligonucleotide
cccggaaccgagagauag

SEQ ID NO: 51951 - RNA, 18 nt, Artificial Sequence
  Description of Artificial Sequence: Synthetic oligonucleotide
caaugcccggaaccgaga

SEQ ID NO: 51952 - RNA, 18 nt, Artificial Sequence
  Description of Artificial Sequence: Synthetic oligonucleotide
accgccaaugcccggaac

SEQ ID NO: 51953 - RNA, 18 nt, Artificial Sequence
  Description of Artificial Sequence: Synthetic oligonucleotide
gcaggcaaacuccguggg

SEQ ID NO: 51954 - RNA, 18 nt, Artificial Sequence
  Description of Artificial Sequence: Synthetic oligonucleotide
uucaugcaggcaaacucc

SEQ ID NO: 51955 - RNA, 18 nt, Artificial Sequence
  Description of Artificial Sequence: Synthetic oligonucleotide
aggccuucaugcaggcaa

SEQ ID NO: 51956 - RNA, 18 nt, Artificial Sequence
  Description of Artificial Sequence: Synthetic oligonucleotide
gaccaaggccuucaugca

SEQ ID NO: 51957 - RNA, 18 nt, Artificial Sequence
  Description of Artificial Sequence: Synthetic oligonucleotide
aagaggaccaaggccuuc

SEQ ID NO: 51958 - RNA, 18 nt, Artificial Sequence
  Description of Artificial Sequence: Synthetic oligonucleotide
gcuugaagaggaccaagg

SEQ ID NO: 51959 - RNA, 18 nt, Artificial Sequence
  Description of Artificial Sequence: Synthetic oligonucleotide
gcaggcaaacuccguggg

SEQ ID NO: 51960 - RNA, 18 nt, Artificial Sequence
  Description of Artificial Sequence: Synthetic oligonucleotide
uucaugcaggcaaacucc

SEQ ID NO: 51961 - RNA, 18 nt, Artificial Sequence
  Description of Artificial Sequence: Synthetic oligonucleotide
aggccuucaugcaggcaa

SEQ ID NO: 51962 - RNA, 18 nt, Artificial Sequence
  Description of Artificial Sequence: Synthetic oligonucleotide
gaccaaggccuucaugca

SEQ ID NO: 51963 - RNA, 18 nt, Artificial Sequence
  Description of Artificial Sequence: Synthetic oligonucleotide
aagaggaccaaggccuuc

SEQ ID NO: 51964 - RNA, 18 nt, Artificial Sequence
  Description of Artificial Sequence: Synthetic oligonucleotide
gcuugaagaggaccaagg

SEQ ID NO: 51965 - RNA, 18 nt, Artificial Sequence
  Description of Artificial Sequence: Synthetic oligonucleotide
gguuugggcagagacuca

SEQ ID NO: 51966 - RNA, 18 nt, Artificial Sequence
  Description of Artificial Sequence: Synthetic oligonucleotide
cucaagguuugggcagag

SEQ ID NO: 51967 - RNA, 18 nt, Artificial Sequence
  Description of Artificial Sequence: Synthetic oligonucleotide
ucccacucaagguuuggg

SEQ ID NO: 51968 - RNA, 18 nt, Artificial Sequence
  Description of Artificial Sequence: Synthetic oligonucleotide
agaauucccacucaaggu

SEQ ID NO: 51969 - RNA, 18 nt, Artificial Sequence
  Description of Artificial Sequence: Synthetic oligonucleotide
ucaccagaauucccacuc

SEQ ID NO: 51970 - RNA, 18 nt, Artificial Sequence
  Description of Artificial Sequence: Synthetic oligonucleotide
ggaagucaccagaauucc

SEQ ID NO: 51971 - RNA, 18 nt, Artificial Sequence
  Description of Artificial Sequence: Synthetic oligonucleotide
cagauggaagucaccaga

SEQ ID NO: 51972 - RNA, 18 nt, Artificial Sequence
  Description of Artificial Sequence: Synthetic oligonucleotide
agaggcagauggaaguca

SEQ ID NO: 51973 - RNA, 18 nt, Artificial Sequence
  Description of Artificial Sequence: Synthetic oligonucleotide
gagugagaggcagaugga

SEQ ID NO: 51974 - RNA, 18 nt, Artificial Sequence
  Description of Artificial Sequence: Synthetic oligonucleotide
agggagagugagaggcag

SEQ ID NO: 51975 - RNA, 18 nt, Artificial Sequence
  Description of Artificial Sequence: Synthetic oligonucleotide
aguggagggagagugaga

SEQ ID NO: 51976 - RNA, 18 nt, Artificial Sequence
  Description of Artificial Sequence: Synthetic oligonucleotide
ggguaguggagggagagu

SEQ ID NO: 51977 - RNA, 18 nt, Artificial Sequence
  Description of Artificial Sequence: Synthetic oligonucleotide
cacaucugcacacauggg

SEQ ID NO: 51978 - RNA, 18 nt, Artificial Sequence
  Description of Artificial Sequence: Synthetic oligonucleotide
cuacacacaucugcacac

SEQ ID NO: 51979 - RNA, 18 nt, Artificial Sequence
  Description of Artificial Sequence: Synthetic oligonucleotide
gaggccuacacacaucug

SEQ ID NO: 51980 - RNA, 18 nt, Artificial Sequence
  Description of Artificial Sequence: Synthetic oligonucleotide
ggauagaggccuacacac

SEQ ID NO: 51981 - RNA, 18 nt, Artificial Sequence
  Description of Artificial Sequence: Synthetic oligonucleotide
ccccaggauagaggccua

SEQ ID NO: 51982 - RNA, 18 nt, Artificial Sequence
  Description of Artificial Sequence: Synthetic oligonucleotide
ccaccccccaggauagag

SEQ ID NO: 51983 - RNA, 18 nt, Artificial Sequence
  Description of Artificial Sequence: Synthetic oligonucleotide
uccucccaccccccagga

SEQ ID NO: 51984 - RNA, 18 nt, Artificial Sequence
  Description of Artificial Sequence: Synthetic oligonucleotide
cacucuccucccaccccc

SEQ ID NO: 51985 - RNA, 18 nt, Artificial Sequence
  Description of Artificial Sequence: Synthetic oligonucleotide
cucaccacucuccuccca

SEQ ID NO: 51986 - RNA, 18 nt, Artificial Sequence
  Description of Artificial Sequence: Synthetic oligonucleotide
ccagccucaccacucucc

SEQ ID NO: 51987 - RNA, 18 nt, Artificial Sequence
  Description of Artificial Sequence: Synthetic oligonucleotide
ggaguccagccucaccac

SEQ ID NO: 51988 - RNA, 18 nt, Artificial Sequence
  Description of Artificial Sequence: Synthetic oligonucleotide
agaagggaguccagccuc

SEQ ID NO: 51989 - RNA, 18 nt, Artificial Sequence
  Description of Artificial Sequence: Synthetic oligonucleotide
caaggagaagggagucca

SEQ ID NO: 51990 - RNA, 18 nt, Artificial Sequence
  Description of Artificial Sequence: Synthetic oligonucleotide
ggccccaaggagaaggga

SEQ ID NO: 51991 - RNA, 18 nt, Artificial Sequence
  Description of Artificial Sequence: Synthetic oligonucleotide
ggaguggccccaaggaga

SEQ ID NO: 51992 - RNA, 18 nt, Artificial Sequence
  Description of Artificial Sequence: Synthetic oligonucleotide
aaccaggaguggccccaa

SEQ ID NO: 51993 - RNA, 18 nt, Artificial Sequence
  Description of Artificial Sequence: Synthetic oligonucleotide
cagucaaccaggaguggc

SEQ ID NO: 51994 - RNA, 18 nt, Artificial Sequence
  Description of Artificial Sequence: Synthetic oligonucleotide
ccucacagucaaccagga

SEQ ID NO: 51995 - RNA, 18 nt, Artificial Sequence
  Description of Artificial Sequence: Synthetic oligonucleotide
uguccccucacagucaac

SEQ ID NO: 51996 - RNA, 18 nt, Artificial Sequence
  Description of Artificial Sequence: Synthetic oligonucleotide
ugcccuguccccucacag

SEQ ID NO: 51997 - RNA, 18 nt, Artificial Sequence
  Description of Artificial Sequence: Synthetic oligonucleotide
cagccugcccuguccccu

SEQ ID NO: 51998 - RNA, 18 nt, Artificial Sequence
  Description of Artificial Sequence: Synthetic oligonucleotide
gcucccagccugcccugu

SEQ ID NO: 51999 - RNA, 18 nt, Artificial Sequence
  Description of Artificial Sequence: Synthetic oligonucleotide
gggcucccagccugcccu

SEQ ID NO: 52000 - RNA, 18 nt, Artificial Sequence
  Description of Artificial Sequence: Synthetic oligonucleotide
gcucagggucucccaggg

SEQ ID NO: 52001 - RNA, 18 nt, Artificial Sequence
  Description of Artificial Sequence: Synthetic oligonucleotide
cacagucaaccaggagug

SEQ ID NO: 52002 - RNA, 18 nt, Artificial Sequence
  Description of Artificial Sequence: Synthetic oligonucleotide
ccccucacagucaaccag

SEQ ID NO: 52003 - RNA, 18 nt, Artificial Sequence
  Description of Artificial Sequence: Synthetic oligonucleotide
ccuguccccucacaguca

SEQ ID NO: 52004 - RNA, 18 nt, Artificial Sequence
  Description of Artificial Sequence: Synthetic oligonucleotide
ccugcccuguccccucac

SEQ ID NO: 52005 - RNA, 18 nt, Artificial Sequence
  Description of Artificial Sequence: Synthetic oligonucleotide
cccagccugcccuguccc

SEQ ID NO: 52006 - RNA, 18 nt, Artificial Sequence
  Description of Artificial Sequence: Synthetic oligonucleotide
gggcucccagccugcccu

SEQ ID NO: 52007 - RNA, 18 nt, Artificial Sequence
  Description of Artificial Sequence: Synthetic oligonucleotide
gcucagggucucccaggg

SEQ ID NO: 52008 - RNA, 18 nt, Artificial Sequence
  Description of Artificial Sequence: Synthetic oligonucleotide
gggcucagggucucccag

SEQ ID NO: 52009 - RNA, 18 nt, Artificial Sequence
  Description of Artificial Sequence: Synthetic oligonucleotide
ccagaggagccaccaggg

SEQ ID NO: 52010 - RNA, 18 nt, Artificial Sequence
  Description of Artificial Sequence: Synthetic oligonucleotide
aggcccagaggagccacc

SEQ ID NO: 52011 - RNA, 18 nt, Artificial Sequence
  Description of Artificial Sequence: Synthetic oligonucleotide
cugccaggcccagaggag

SEQ ID NO: 52012 - RNA, 18 nt, Artificial Sequence
  Description of Artificial Sequence: Synthetic oligonucleotide
gggcucugccaggcccag

SEQ ID NO: 52013 - RNA, 18 nt, Artificial Sequence
  Description of Artificial Sequence: Synthetic oligonucleotide
ugcagacauggaccuggg

SEQ ID NO: 52014 - RNA, 18 nt, Artificial Sequence
  Description of Artificial Sequence: Synthetic oligonucleotide
cuggcugcagacauggac

SEQ ID NO: 52015 - RNA, 18 nt, Artificial Sequence
  Description of Artificial Sequence: Synthetic oligonucleotide
ggguucuggcugcagaca

SEQ ID NO: 52016 - RNA, 18 nt, Artificial Sequence
  Description of Artificial Sequence: Synthetic oligonucleotide
gcccaggguucuggcugc

SEQ ID NO: 52017 - RNA, 18 nt, Artificial Sequence
  Description of Artificial Sequence: Synthetic oligonucleotide
ugguggcccaggguucug

SEQ ID NO: 52018 - RNA, 18 nt, Artificial Sequence
  Description of Artificial Sequence: Synthetic oligonucleotide
ugaagugguggcccaggg

SEQ ID NO: 52019 - RNA, 18 nt, Artificial Sequence
  Description of Artificial Sequence: Synthetic oligonucleotide
ggccaugaagugguggcc

SEQ ID NO: 52020 - RNA, 18 nt, Artificial Sequence
  Description of Artificial Sequence: Synthetic oligonucleotide
aggcuggccaugaagugg

SEQ ID NO: 52021 - RNA, 18 nt, Artificial Sequence
  Description of Artificial Sequence: Synthetic oligonucleotide
uuauaaggcuggccauga

SEQ ID NO: 52022 - RNA, 18 nt, Artificial Sequence
  Description of Artificial Sequence: Synthetic oligonucleotide
ggcuguuauaaggcuggc

SEQ ID NO: 52023 - RNA, 18 nt, Artificial Sequence
  Description of Artificial Sequence: Synthetic oligonucleotide
uuuacggcuguuauaagg

SEQ ID NO: 52024 - RNA, 18 nt, Artificial Sequence
  Description of Artificial Sequence: Synthetic oligonucleotide
acagguuuacggcuguua

SEQ ID NO: 52025 - RNA, 18 nt, Artificial Sequence
  Description of Artificial Sequence: Synthetic oligonucleotide
uuagcacagguuuacggc

SEQ ID NO: 52026 - RNA, 18 nt, Artificial Sequence
  Description of Artificial Sequence: Synthetic oligonucleotide
ugagcuuagcacagguuu

SEQ ID NO: 52027 - RNA, 18 nt, Artificial Sequence
  Description of Artificial Sequence: Synthetic oligonucleotide
accagugagcuuagcaca

SEQ ID NO: 52028 - RNA, 18 nt, Artificial Sequence
  Description of Artificial Sequence: Synthetic oligonucleotide
uccuucaggccccgcguc

SEQ ID NO: 52029 - RNA, 18 nt, Artificial Sequence
  Description of Artificial Sequence: Synthetic oligonucleotide
caggauccuucaggcccc

SEQ ID NO: 52030 - RNA, 18 nt, Artificial Sequence
  Description of Artificial Sequence: Synthetic oligonucleotide
gugcucaggauccuucag

SEQ ID NO: 52031 - RNA, 18 nt, Artificial Sequence
  Description of Artificial Sequence: Synthetic oligonucleotide
ucuacgugcucaggaucc

SEQ ID NO: 52032 - RNA, 18 nt, Artificial Sequence
  Description of Artificial Sequence: Synthetic oligonucleotide
aggccucuacgugcucag

SEQ ID NO: 52033 - RNA, 18 nt, Artificial Sequence
  Description of Artificial Sequence: Synthetic oligonucleotide
cugcaaggccucuacgug

SEQ ID NO: 52034 - RNA, 18 nt, Artificial Sequence
  Description of Artificial Sequence: Synthetic oligonucleotide
ugguccugcaaggccucu

SEQ ID NO: 52035 - RNA, 18 nt, Artificial Sequence
  Description of Artificial Sequence: Synthetic oligonucleotide
gggacugguccugcaagg

SEQ ID NO: 52036 - RNA, 18 nt, Artificial Sequence
  Description of Artificial Sequence: Synthetic oligonucleotide
cacuugggacugguccug

SEQ ID NO: 52037 - RNA, 18 nt, Artificial Sequence
  Description of Artificial Sequence: Synthetic oligonucleotide
agcaucacuugggacugg

SEQ ID NO: 52038 - RNA, 18 nt, Artificial Sequence
  Description of Artificial Sequence: Synthetic oligonucleotide
ggcucagcaucacuuggg

SEQ ID NO: 52039 - RNA, 18 nt, Artificial Sequence
  Description of Artificial Sequence: Synthetic oligonucleotide
gugcuggcucagcaucac

SEQ ID NO: 52040 - RNA, 18 nt, Artificial Sequence
  Description of Artificial Sequence: Synthetic oligonucleotide
uugcugugcuggcucagc

SEQ ID NO: 52041 - RNA, 18 nt, Artificial Sequence
  Description of Artificial Sequence: Synthetic oligonucleotide
gggccuugcugugcuggc

SEQ ID NO: 52042 - RNA, 18 nt, Artificial Sequence
  Description of Artificial Sequence: Synthetic oligonucleotide
guggugggccuugcugug

SEQ ID NO: 52043 - RNA, 18 nt, Artificial Sequence
  Description of Artificial Sequence: Synthetic oligonucleotide
ggguggugggccuugcug

SEQ ID NO: 52044 - RNA, 18 nt, Artificial Sequence
  Description of Artificial Sequence: Synthetic oligonucleotide
cuugaggagauuucuccc

SEQ ID NO: 52045 - RNA, 18 nt, Artificial Sequence
  Description of Artificial Sequence: Synthetic oligonucleotide
ucuggcuugaggagauuu

SEQ ID NO: 52046 - RNA, 18 nt, Artificial Sequence
  Description of Artificial Sequence: Synthetic oligonucleotide
caggcucuggcuugagga

SEQ ID NO: 52047 - RNA, 18 nt, Artificial Sequence
  Description of Artificial Sequence: Synthetic oligonucleotide
cagcacaggcucuggcuu

SEQ ID NO: 52048 - RNA, 18 nt, Artificial Sequence
  Description of Artificial Sequence: Synthetic oligonucleotide
ccucacagcacaggcucu

SEQ ID NO: 52049 - RNA, 18 nt, Artificial Sequence
  Description of Artificial Sequence: Synthetic oligonucleotide
aagccccucacagcacag

SEQ ID NO: 52050 - RNA, 18 nt, Artificial Sequence
  Description of Artificial Sequence: Synthetic oligonucleotide
ucccgaagccccucacag

SEQ ID NO: 52051 - RNA, 18 nt, Artificial Sequence
  Description of Artificial Sequence: Synthetic oligonucleotide
caaggucccgaagccccu

SEQ ID NO: 52052 - RNA, 18 nt, Artificial Sequence
  Description of Artificial Sequence: Synthetic oligonucleotide
ugccccaaggucccgaag

SEQ ID NO: 52053 - RNA, 18 nt, Artificial Sequence
  Description of Artificial Sequence: Synthetic oligonucleotide
ggagcugccccaaggucc

SEQ ID NO: 52054 - RNA, 18 nt, Artificial Sequence
  Description of Artificial Sequence: Synthetic oligonucleotide
acucaggagcugccccaa

SEQ ID NO: 52055 - RNA, 18 nt, Artificial Sequence
  Description of Artificial Sequence: Synthetic oligonucleotide
ucugaacucaggagcugc

SEQ ID NO: 52056 - RNA, 18 nt, Artificial Sequence
  Description of Artificial Sequence: Synthetic oligonucleotide
cucugucugaacucagga

SEQ ID NO: 52057 - RNA, 18 nt, Artificial Sequence
  Description of Artificial Sequence: Synthetic oligonucleotide
cugaacucugucugaacu

SEQ ID NO: 52058 - RNA, 18 nt, Artificial Sequence
  Description of Artificial Sequence: Synthetic oligonucleotide
ccuuccugaacucugucu

SEQ ID NO: 52059 - RNA, 18 nt, Artificial Sequence
  Description of Artificial Sequence: Synthetic oligonucleotide
gucucccuuccugaacuc

SEQ ID NO: 52060 - RNA, 18 nt, Artificial Sequence
  Description of Artificial Sequence: Synthetic oligonucleotide
ccccugucucccuuccug

SEQ ID NO: 52061 - RNA, 18 nt, Artificial Sequence
  Description of Artificial Sequence: Synthetic oligonucleotide
cugugccccugucucccu

SEQ ID NO: 52062 - RNA, 18 nt, Artificial Sequence
  Description of Artificial Sequence: Synthetic oligonucleotide
ucucucugugccccuguc

SEQ ID NO: 52063 - RNA, 18 nt, Artificial Sequence
  Description of Artificial Sequence: Synthetic oligonucleotide
cucugucucucugugccc

SEQ ID NO: 52064 - RNA, 18 nt, Artificial Sequence
  Description of Artificial Sequence: Synthetic oligonucleotide
ugaaccucugucucucug

SEQ ID NO: 52065 - RNA, 18 nt, Artificial Sequence
  Description of Artificial Sequence: Synthetic oligonucleotide
guccaugaaccucugucu

SEQ ID NO: 52066 - RNA, 18 nt, Artificial Sequence
  Description of Artificial Sequence: Synthetic oligonucleotide
ccucaguccaugaaccuc

SEQ ID NO: 52067 - RNA, 18 nt, Artificial Sequence
  Description of Artificial Sequence: Synthetic oligonucleotide
cuuugccucaguccauga

SEQ ID NO: 52068 - RNA, 18 nt, Artificial Sequence
  Description of Artificial Sequence: Synthetic oligonucleotide
ccagccuuugccucaguc

SEQ ID NO: 52069 - RNA, 18 nt, Artificial Sequence
  Description of Artificial Sequence: Synthetic oligonucleotide
cuggcccagccuuugccu

SEQ ID NO: 52070 - RNA, 18 nt, Artificial Sequence
  Description of Artificial Sequence: Synthetic oligonucleotide
ugagccuggcccagccuu

SEQ ID NO: 52071 - RNA, 18 nt, Artificial Sequence
  Description of Artificial Sequence: Synthetic oligonucleotide
guugcugagccuggccca

SEQ ID NO: 52072 - RNA, 18 nt, Artificial Sequence
  Description of Artificial Sequence: Synthetic oligonucleotide
ccuggguugcugagccug

SEQ ID NO: 52073 - RNA, 18 nt, Artificial Sequence
  Description of Artificial Sequence: Synthetic oligonucleotide
ggaggccuggguugcuga

SEQ ID NO: 52074 - RNA, 18 nt, Artificial Sequence
  Description of Artificial Sequence: Synthetic oligonucleotide
cugcgggaggccuggguu

SEQ ID NO: 52075 - RNA, 18 nt, Artificial Sequence
  Description of Artificial Sequence: Synthetic oligonucleotide
ccugccugcgggaggccu

SEQ ID NO: 52076 - RNA, 18 nt, Artificial Sequence
  Description of Artificial Sequence: Synthetic oligonucleotide
cucugccugccugcggga

SEQ ID NO: 52077 - RNA, 18 nt, Artificial Sequence
  Description of Artificial Sequence: Synthetic oligonucleotide
gcagccucugccugccug

SEQ ID NO: 52078 - RNA, 18 nt, Artificial Sequence
  Description of Artificial Sequence: Synthetic oligonucleotide
acagggcagccucugccu

SEQ ID NO: 52079 - RNA, 18 nt, Artificial Sequence
  Description of Artificial Sequence: Synthetic oligonucleotide
ggguuacagggcagccuc

SEQ ID NO: 52080 - RNA, 18 nt, Artificial Sequence
  Description of Artificial Sequence: Synthetic oligonucleotide
uccauggguuacagggca

SEQ ID NO: 52081 - RNA, 18 nt, Artificial Sequence
  Description of Artificial Sequence: Synthetic oligonucleotide
uggucuccauggguuaca

SEQ ID NO: 52082 - RNA, 18 nt, Artificial Sequence
  Description of Artificial Sequence: Synthetic oligonucleotide
uggucuggucuccauggg

SEQ ID NO: 52083 - RNA, 18 nt, Artificial Sequence
  Description of Artificial Sequence: Synthetic oligonucleotide
gcuguuggucuggucucc

SEQ ID NO: 52084 - RNA, 18 nt, Artificial Sequence
  Description of Artificial Sequence: Synthetic oligonucleotide
ucagagcuguuggucugg

SEQ ID NO: 52085 - RNA, 18 nt, Artificial Sequence
  Description of Artificial Sequence: Synthetic oligonucleotide
gcucaucagagcuguugg

SEQ ID NO: 52086 - RNA, 18 nt, Artificial Sequence
  Description of Artificial Sequence: Synthetic oligonucleotide
guggagcucaucagagcu

SEQ ID NO: 52087 - RNA, 18 nt, Artificial Sequence
  Description of Artificial Sequence: Synthetic oligonucleotide
ccacuguggagcucauca

SEQ ID NO: 52088 - RNA, 18 nt, Artificial Sequence
  Description of Artificial Sequence: Synthetic oligonucleotide
ugcagccacuguggagcu

SEQ ID NO: 52089 - RNA, 18 nt, Artificial Sequence
  Description of Artificial Sequence: Synthetic oligonucleotide
gcagcugcagccacugug

SEQ ID NO: 52090 - RNA, 18 nt, Artificial Sequence
  Description of Artificial Sequence: Synthetic oligonucleotide
caggcgcagcugcagcca

SEQ ID NO: 52091 - RNA, 18 nt, Artificial Sequence
  Description of Artificial Sequence: Synthetic oligonucleotide
agcugcaggcgcagcugc

SEQ ID NO: 52092 - RNA, 18 nt, Artificial Sequence
  Description of Artificial Sequence: Synthetic oligonucleotide
gccccagcugcaggcgca

SEQ ID NO: 52093 - RNA, 18 nt, Artificial Sequence
  Description of Artificial Sequence: Synthetic oligonucleotide
aggcagccccagcugcag

SEQ ID NO: 52094 - RNA, 18 nt, Artificial Sequence
  Description of Artificial Sequence: Synthetic oligonucleotide
ccuggaggcagccccagc

SEQ ID NO: 52095 - RNA, 18 nt, Artificial Sequence
  Description of Artificial Sequence: Synthetic oligonucleotide
uccuuccuggaggcagcc

SEQ ID NO: 52096 - RNA, 18 nt, Artificial Sequence
  Description of Artificial Sequence: Synthetic oligonucleotide
gagacuccuuccuggagg

SEQ ID NO: 52097 - RNA, 18 nt, Artificial Sequence
  Description of Artificial Sequence: Synthetic oligonucleotide
gccuggagacuccuuccu

SEQ ID NO: 52098 - RNA, 18 nt, Artificial Sequence
  Description of Artificial Sequence: Synthetic oligonucleotide
caucugccuggagacucc

SEQ ID NO: 52099 - RNA, 18 nt, Artificial Sequence
  Description of Artificial Sequence: Synthetic oligonucleotide
ggccccaucugccuggag

SEQ ID NO: 52100 - RNA, 18 nt, Artificial Sequence
  Description of Artificial Sequence: Synthetic oligonucleotide
ccccaggccccaucugcc

SEQ ID NO: 52101 - RNA, 18 nt, Artificial Sequence
  Description of Artificial Sequence: Synthetic oligonucleotide
uccucccccaggccccau

SEQ ID NO: 52102 - RNA, 18 nt, Artificial Sequence
  Description of Artificial Sequence: Synthetic oligonucleotide
ugggauccucccccaggc

SEQ ID NO: 52103 - RNA, 18 nt, Artificial Sequence
  Description of Artificial Sequence: Synthetic oligonucleotide
ccuaccuccaggagaagc

SEQ ID NO: 52104 - RNA, 18 nt, Artificial Sequence
  Description of Artificial Sequence: Synthetic oligonucleotide
ccaacccuaccuccagga

SEQ ID NO: 52105 - RNA, 18 nt, Artificial Sequence
  Description of Artificial Sequence: Synthetic oligonucleotide
cagacccaacccuaccuc

SEQ ID NO: 52106 - RNA, 18 nt, Artificial Sequence
  Description of Artificial Sequence: Synthetic oligonucleotide
gggcccagacccaacccu

SEQ ID NO: 52107 - RNA, 18 nt, Artificial Sequence
  Description of Artificial Sequence: Synthetic oligonucleotide
cccaagggcccagaccca

SEQ ID NO: 52108 - RNA, 18 nt, Artificial Sequence
  Description of Artificial Sequence: Synthetic oligonucleotide
ugcuccccaagggcccag

SEQ ID NO: 52109 - RNA, 18 nt, Artificial Sequence
  Description of Artificial Sequence: Synthetic oligonucleotide
uacccugcuccccaaggg

SEQ ID NO: 52110 - RNA, 18 nt, Artificial Sequence
  Description of Artificial Sequence: Synthetic oligonucleotide
gcccuuacccugcucccc

SEQ ID NO: 52111 - RNA, 18 nt, Artificial Sequence
  Description of Artificial Sequence: Synthetic oligonucleotide
cucuggcccuuacccugc

SEQ ID NO: 52112 - RNA, 18 nt, Artificial Sequence
  Description of Artificial Sequence: Synthetic oligonucleotide
cgaaccucuggcccuuac

SEQ ID NO: 52113 - RNA, 18 nt, Artificial Sequence
  Description of Artificial Sequence: Synthetic oligonucleotide
cccugcgaaccucuggcc

SEQ ID NO: 52114 - RNA, 18 nt, Artificial Sequence
  Description of Artificial Sequence: Synthetic oligonucleotide
auggucccugcgaaccuc

SEQ ID NO: 52115 - RNA, 18 nt, Artificial Sequence
  Description of Artificial Sequence: Synthetic oligonucleotide
cuuccauggucccugcga

SEQ ID NO: 52116 - RNA, 18 nt, Artificial Sequence
  Description of Artificial Sequence: Synthetic oligonucleotide
ggcuccuuccaugguccc

SEQ ID NO: 52117 - RNA, 18 nt, Artificial Sequence
  Description of Artificial Sequence: Synthetic oligonucleotide
guucuggcuccuuccaug

SEQ ID NO: 52118 - RNA, 18 nt, Artificial Sequence
  Description of Artificial Sequence: Synthetic oligonucleotide
gaguuguucuggcuccuu

SEQ ID NO: 52119 - RNA, 18 nt, Artificial Sequence
  Description of Artificial Sequence: Synthetic oligonucleotide
ggucugaguuguucuggc

SEQ ID NO: 52120 - RNA, 18 nt, Artificial Sequence
  Description of Artificial Sequence: Synthetic oligonucleotide
ggcugggucugaguuguu

SEQ ID NO: 52121 - RNA, 18 nt, Artificial Sequence
  Description of Artificial Sequence: Synthetic oligonucleotide
gggcugggucugaguugu

SEQ ID NO: 52122 - RNA, 18 nt, Artificial Sequence
  Description of Artificial Sequence: Synthetic oligonucleotide
uugcccacagccggcggg

SEQ ID NO: 52123 - RNA, 18 nt, Artificial Sequence
  Description of Artificial Sequence: Synthetic oligonucleotide
cacccuugcccacagccg

SEQ ID NO: 52124 - RNA, 18 nt, Artificial Sequence
  Description of Artificial Sequence: Synthetic oligonucleotide
uaccccacccuugcccac

SEQ ID NO: 52125 - RNA, 18 nt, Artificial Sequence
  Description of Artificial Sequence: Synthetic oligonucleotide
caggcuaccccacccuug

SEQ ID NO: 52126 - RNA, 18 nt, Artificial Sequence
  Description of Artificial Sequence: Synthetic oligonucleotide
acccacaggcuaccccac

SEQ ID NO: 52127 - RNA, 18 nt, Artificial Sequence
  Description of Artificial Sequence: Synthetic oligonucleotide
gguuuacccacaggcuac

SEQ ID NO: 52128 - RNA, 18 nt, Artificial Sequence
  Description of Artificial Sequence: Synthetic oligonucleotide
uucuggguuuacccacag

SEQ ID NO: 52129 - RNA, 18 nt, Artificial Sequence
  Description of Artificial Sequence: Synthetic oligonucleotide
uaggauucuggguuuacc

SEQ ID NO: 52130 - RNA, 18 nt, Artificial Sequence
  Description of Artificial Sequence: Synthetic oligonucleotide
guuucuaggauucugggu

SEQ ID NO: 52131 - RNA, 18 nt, Artificial Sequence
  Description of Artificial Sequence: Synthetic oligonucleotide
accguguuucuaggauuc

SEQ ID NO: 52132 - RNA, 18 nt, Artificial Sequence
  Description of Artificial Sequence: Synthetic oligonucleotide
gccccaccguguuucuag

SEQ ID NO: 52133 - RNA, 18 nt, Artificial Sequence
  Description of Artificial Sequence: Synthetic oligonucleotide
uccccgccccaccguguu

SEQ ID NO: 52134 - RNA, 18 nt, Artificial Sequence
  Description of Artificial Sequence: Synthetic oligonucleotide
ccccauccccgccccacc

SEQ ID NO: 52135 - RNA, 18 nt, Artificial Sequence
  Description of Artificial Sequence: Synthetic oligonucleotide
ccaacccccauccccgcc

SEQ ID NO: 52136 - RNA, 18 nt, Artificial Sequence
  Description of Artificial Sequence: Synthetic oligonucleotide
cgcccccaacccccaucc

SEQ ID NO: 52137 - RNA, 18 nt, Artificial Sequence
  Description of Artificial Sequence: Synthetic oligonucleotide
cugcccgcccccaacccc

SEQ ID NO: 52138 - RNA, 18 nt, Artificial Sequence
  Description of Artificial Sequence: Synthetic oligonucleotide
gcagccugcccgccccca

SEQ ID NO: 52139 - RNA, 18 nt, Artificial Sequence
  Description of Artificial Sequence: Synthetic oligonucleotide
gcucugcagccugcccgc

SEQ ID NO: 52140 - RNA, 18 nt, Artificial Sequence
  Description of Artificial Sequence: Synthetic oligonucleotide
uccuggcucugcagccug

SEQ ID NO: 52141 - RNA, 18 nt, Artificial Sequence
  Description of Artificial Sequence: Synthetic oligonucleotide
uccuguccuggcucugca

SEQ ID NO: 52142 - RNA, 18 nt, Artificial Sequence
  Description of Artificial Sequence: Synthetic oligonucleotide
ggcuguccuguccuggcu

SEQ ID NO: 52143 - RNA, 18 nt, Artificial Sequence
  Description of Artificial Sequence: Synthetic oligonucleotide
ggcuaggcuguccugucc

SEQ ID NO: 52144 - RNA, 18 nt, Artificial Sequence
  Description of Artificial Sequence: Synthetic oligonucleotide
ccaucggcuaggcugucc

SEQ ID NO: 52145 - RNA, 18 nt, Artificial Sequence
  Description of Artificial Sequence: Synthetic oligonucleotide
cuuccccaucggcuaggc

SEQ ID NO: 52146 - RNA, 18 nt, Artificial Sequence
  Description of Artificial Sequence: Synthetic oligonucleotide
cuuuccuuccccaucggc

SEQ ID NO: 52147 - RNA, 18 nt, Artificial Sequence
  Description of Artificial Sequence: Synthetic oligonucleotide
cuguucuuuccuucccca

SEQ ID NO: 52148 - RNA, 18 nt, Artificial Sequence
  Description of Artificial Sequence: Synthetic oligonucleotide
cuucucuguucuuuccuu

SEQ ID NO: 52149 - RNA, 18 nt, Artificial Sequence
  Description of Artificial Sequence: Synthetic oligonucleotide
gggcgcuucucuguucuu

SEQ ID NO: 52150 - RNA, 18 nt, Artificial Sequence
  Description of Artificial Sequence: Synthetic oligonucleotide
ccuaagggcgcuucucug

SEQ ID NO: 52151 - RNA, 18 nt, Artificial Sequence
  Description of Artificial Sequence: Synthetic oligonucleotide
uaagcccuaagggcgcuu

SEQ ID NO: 52152 - RNA, 18 nt, Artificial Sequence
  Description of Artificial Sequence: Synthetic oligonucleotide
gcuguuaagcccuaaggg

SEQ ID NO: 52153 - RNA, 18 nt, Artificial Sequence
  Description of Artificial Sequence: Synthetic oligonucleotide
ucugugcuguuaagcccu

SEQ ID NO: 52154 - RNA, 18 nt, Artificial Sequence
  Description of Artificial Sequence: Synthetic oligonucleotide
ggaccucugugcuguuaa

SEQ ID NO: 52155 - RNA, 18 nt, Artificial Sequence
  Description of Artificial Sequence: Synthetic oligonucleotide
acuagggaccucugugcu

SEQ ID NO: 52156 - RNA, 18 nt, Artificial Sequence
  Description of Artificial Sequence: Synthetic oligonucleotide
acgccacuagggaccucu

SEQ ID NO: 52157 - RNA, 18 nt, Artificial Sequence
  Description of Artificial Sequence: Synthetic oligonucleotide
ugucaacgccacuaggga

SEQ ID NO: 52158 - RNA, 18 nt, Artificial Sequence
  Description of Artificial Sequence: Synthetic oligonucleotide
auucuugucaacgccacu

SEQ ID NO: 52159 - RNA, 18 nt, Artificial Sequence
  Description of Artificial Sequence: Synthetic oligonucleotide
gaaacauucuugucaacg

SEQ ID NO: 52160 - RNA, 18 nt, Artificial Sequence
  Description of Artificial Sequence: Synthetic oligonucleotide
ccacagaaacauucuugu

SEQ ID NO: 52161 - RNA, 18 nt, Artificial Sequence
  Description of Artificial Sequence: Synthetic oligonucleotide
ucaucccacagaaacauu

SEQ ID NO: 52162 - RNA, 18 nt, Artificial Sequence
  Description of Artificial Sequence: Synthetic oligonucleotide
cuccaucaucccacagaa

SEQ ID NO: 52163 - RNA, 18 nt, Artificial Sequence
  Description of Artificial Sequence: Synthetic oligonucleotide
ucaggcuccaucauccca

SEQ ID NO: 52164 - RNA, 18 nt, Artificial Sequence
  Description of Artificial Sequence: Synthetic oligonucleotide
uggcuucaggcuccauca

SEQ ID NO: 52165 - RNA, 18 nt, Artificial Sequence
  Description of Artificial Sequence: Synthetic oligonucleotide
guggguggcuucaggcuc

SEQ ID NO: 52166 - RNA, 18 nt, Artificial Sequence
  Description of Artificial Sequence: Synthetic oligonucleotide
caacgccacuagggaccu

SEQ ID NO: 52167 - RNA, 18 nt, Artificial Sequence
  Description of Artificial Sequence: Synthetic oligonucleotide
cuugucaacgccacuagg

SEQ ID NO: 52168 - RNA, 18 nt, Artificial Sequence
  Description of Artificial Sequence: Synthetic oligonucleotide
acauucuugucaacgcca

SEQ ID NO: 52169 - RNA, 18 nt, Artificial Sequence
  Description of Artificial Sequence: Synthetic oligonucleotide
cagaaacauucuugucaa

SEQ ID NO: 52170 - RNA, 18 nt, Artificial Sequence
  Description of Artificial Sequence: Synthetic oligonucleotide
ucccacagaaacauucuu

SEQ ID NO: 52171 - RNA, 18 nt, Artificial Sequence
  Description of Artificial Sequence: Synthetic oligonucleotide
caucaucccacagaaaca

SEQ ID NO: 52172 - RNA, 18 nt, Artificial Sequence
  Description of Artificial Sequence: Synthetic oligonucleotide
ggcuccaucaucccacag

SEQ ID NO: 52173 - RNA, 18 nt, Artificial Sequence
  Description of Artificial Sequence: Synthetic oligonucleotide
cuucaggcuccaucaucc

SEQ ID NO: 52174 - RNA, 18 nt, Artificial Sequence
  Description of Artificial Sequence: Synthetic oligonucleotide
gguggcuucaggcuccau

SEQ ID NO: 52175 - RNA, 18 nt, Artificial Sequence
  Description of Artificial Sequence: Synthetic oligonucleotide
cuguggguggcuucaggc

SEQ ID NO: 52176 - RNA, 18 nt, Artificial Sequence
  Description of Artificial Sequence: Synthetic oligonucleotide
cuucucuguggguggcuu

SEQ ID NO: 52177 - RNA, 18 nt, Artificial Sequence
  Description of Artificial Sequence: Synthetic oligonucleotide
caucccuucucugugggu

SEQ ID NO: 52178 - RNA, 18 nt, Artificial Sequence
  Description of Artificial Sequence: Synthetic oligonucleotide
gcucccaucccuucucug

SEQ ID NO: 52179 - RNA, 18 nt, Artificial Sequence
  Description of Artificial Sequence: Synthetic oligonucleotide
ucccagcucccaucccuu

SEQ ID NO: 52180 - RNA, 18 nt, Artificial Sequence
  Description of Artificial Sequence: Synthetic oligonucleotide
cacuuucccagcucccau

SEQ ID NO: 52181 - RNA, 18 nt, Artificial Sequence
  Description of Artificial Sequence: Synthetic oligonucleotide
agcuccacuuucccagcu

SEQ ID NO: 52182 - RNA, 18 nt, Artificial Sequence
  Description of Artificial Sequence: Synthetic oligonucleotide
gcccuagcuccacuuucc

SEQ ID NO: 52183 - RNA, 18 nt, Artificial Sequence
  Description of Artificial Sequence: Synthetic oligonucleotide
uccgagcccuagcuccac

SEQ ID NO: 52184 - RNA, 18 nt, Artificial Sequence
  Description of Artificial Sequence: Synthetic oligonucleotide
aagaguccgagcccuagc

SEQ ID NO: 52185 - RNA, 18 nt, Artificial Sequence
  Description of Artificial Sequence: Synthetic oligonucleotide
ucagcaagaguccgagcc

SEQ ID NO: 52186 - RNA, 18 nt, Artificial Sequence
  Description of Artificial Sequence: Synthetic oligonucleotide
aauuuucagcaagagucc

SEQ ID NO: 52187 - RNA, 18 nt, Artificial Sequence
  Description of Artificial Sequence: Synthetic oligonucleotide
uggccaauuuucagcaag

SEQ ID NO: 52188 - RNA, 18 nt, Artificial Sequence
  Description of Artificial Sequence: Synthetic oligonucleotide
cucaauggccaauuuuca

SEQ ID NO: 52189 - RNA, 18 nt, Artificial Sequence
  Description of Artificial Sequence: Synthetic oligonucleotide
ccucccucaauggccaau

SEQ ID NO: 52190 - RNA, 18 nt, Artificial Sequence
  Description of Artificial Sequence: Synthetic oligonucleotide
ucucuccucccucaaugg

SEQ ID NO: 52191 - RNA, 18 nt, Artificial Sequence
  Description of Artificial Sequence: Synthetic oligonucleotide
ugcccucucuccucccuc

SEQ ID NO: 52192 - RNA, 18 nt, Artificial Sequence
  Description of Artificial Sequence: Synthetic oligonucleotide
uuccuugcccucucuccu

SEQ ID NO: 52193 - RNA, 18 nt, Artificial Sequence
  Description of Artificial Sequence: Synthetic oligonucleotide
ccccauuccuugcccucu

SEQ ID NO: 52194 - RNA, 18 nt, Artificial Sequence
  Description of Artificial Sequence: Synthetic oligonucleotide
cccacccccauuccuugc

SEQ ID NO: 52195 - RNA, 18 nt, Artificial Sequence
  Description of Artificial Sequence: Synthetic oligonucleotide
cagcccccacccccauuc

SEQ ID NO: 52196 - RNA, 18 nt, Artificial Sequence
  Description of Artificial Sequence: Synthetic oligonucleotide
caccccagcccccacccc

SEQ ID NO: 52197 - RNA, 18 nt, Artificial Sequence
  Description of Artificial Sequence: Synthetic oligonucleotide
auccacaccccagccccc

SEQ ID NO: 52198 - RNA, 18 nt, Artificial Sequence
  Description of Artificial Sequence: Synthetic oligonucleotide
ugugcauccacaccccag

SEQ ID NO: 52199 - RNA, 18 nt, Artificial Sequence
  Description of Artificial Sequence: Synthetic oligonucleotide
cucacugugcauccacac

SEQ ID NO: 52200 - RNA, 18 nt, Artificial Sequence
  Description of Artificial Sequence: Synthetic oligonucleotide
ucucccucacugugcauc

SEQ ID NO: 52201 - RNA, 18 nt, Artificial Sequence
  Description of Artificial Sequence: Synthetic oligonucleotide
aagugucucccucacugu

SEQ ID NO: 52202 - RNA, 18 nt, Artificial Sequence
  Description of Artificial Sequence: Synthetic oligonucleotide
uggagaagugucucccuc

SEQ ID NO: 52203 - RNA, 18 nt, Artificial Sequence
  Description of Artificial Sequence: Synthetic oligonucleotide
ccaucuggagaagugucu

SEQ ID NO: 52204 - RNA, 18 nt, Artificial Sequence
  Description of Artificial Sequence: Synthetic oligonucleotide
cucuuccaucuggagaag

SEQ ID NO: 52205 - RNA, 18 nt, Artificial Sequence
  Description of Artificial Sequence: Synthetic oligonucleotide
cgugacucuuccaucugg

SEQ ID NO: 52206 - RNA, 18 nt, Artificial Sequence
  Description of Artificial Sequence: Synthetic oligonucleotide
ccacgcgugacucuucca

SEQ ID NO: 52207 - RNA, 18 nt, Artificial Sequence
  Description of Artificial Sequence: Synthetic oligonucleotide
cgaacccacgcgugacuc

SEQ ID NO: 52208 - RNA, 18 nt, Artificial Sequence
  Description of Artificial Sequence: Synthetic oligonucleotide
uugaacgaacccacgcgu

SEQ ID NO: 52209 - RNA, 18 nt, Artificial Sequence
  Description of Artificial Sequence: Synthetic oligonucleotide
cgcauuugaacgaaccca

SEQ ID NO: 52210 - RNA, 18 nt, Artificial Sequence
  Description of Artificial Sequence: Synthetic oligonucleotide
ucacccgcauuugaacga

SEQ ID NO: 52211 - RNA, 18 nt, Artificial Sequence
  Description of Artificial Sequence: Synthetic oligonucleotide
cccgcucacccgcauuug

SEQ ID NO: 52212 - RNA, 18 nt, Artificial Sequence
  Description of Artificial Sequence: Synthetic oligonucleotide
caggccccgcucacccgc

SEQ ID NO: 52213 - RNA, 18 nt, Artificial Sequence
  Description of Artificial Sequence: Synthetic oligonucleotide
guccucaggccccgcuca

SEQ ID NO: 52214 - RNA, 18 nt, Artificial Sequence
  Description of Artificial Sequence: Synthetic oligonucleotide
ucccaguccucaggcccc

SEQ ID NO: 52215 - RNA, 18 nt, Artificial Sequence
  Description of Artificial Sequence: Synthetic oligonucleotide
cccuuucccaguccucag

SEQ ID NO: 52216 - RNA, 18 nt, Artificial Sequence
  Description of Artificial Sequence: Synthetic oligonucleotide
cgggucccuuucccaguc

SEQ ID NO: 52217 - RNA, 18 nt, Artificial Sequence
  Description of Artificial Sequence: Synthetic oligonucleotide
ucccucgggucccuuucc

SEQ ID NO: 52218 - RNA, 18 nt, Artificial Sequence
  Description of Artificial Sequence: Synthetic oligonucleotide
cuccuucccucggguccc

SEQ ID NO: 52219 - RNA, 18 nt, Artificial Sequence
  Description of Artificial Sequence: Synthetic oligonucleotide
cuccccuccuucccucgg

SEQ ID NO: 52220 - RNA, 18 nt, Artificial Sequence
  Description of Artificial Sequence: Synthetic oligonucleotide
gcacgcuccccuccuucc

SEQ ID NO: 52221 - RNA, 18 nt, Artificial Sequence
  Description of Artificial Sequence: Synthetic oligonucleotide
gggcugcacgcuccccuc

SEQ ID NO: 52222 - RNA, 18 nt, Artificial Sequence
  Description of Artificial Sequence: Synthetic oligonucleotide
gggcagggcugcacgcuc

SEQ ID NO: 52223 - RNA, 18 nt, Artificial Sequence
  Description of Artificial Sequence: Synthetic oligonucleotide
gggcagggcugggccggg

SEQ ID NO: 52224 - RNA, 18 nt, Artificial Sequence
  Description of Artificial Sequence: Synthetic oligonucleotide
ccagggcagggcugggcc

SEQ ID NO: 52225 - RNA, 18 nt, Artificial Sequence
  Description of Artificial Sequence: Synthetic oligonucleotide
cugggccagggcagggcu

SEQ ID NO: 52226 - RNA, 18 nt, Artificial Sequence
  Description of Artificial Sequence: Synthetic oligonucleotide
cagggcugggccagggca

SEQ ID NO: 52227 - RNA, 18 nt, Artificial Sequence
  Description of Artificial Sequence: Synthetic oligonucleotide
cacgcggcacuggagcga

SEQ ID NO: 52228 - RNA, 18 nt, Artificial Sequence
  Description of Artificial Sequence: Synthetic oligonucleotide
ccgcacacgcggcacugg

SEQ ID NO: 52229 - RNA, 18 nt, Artificial Sequence
  Description of Artificial Sequence: Synthetic oligonucleotide
ugucuccgcacacgcggc

SEQ ID NO: 52230 - RNA, 18 nt, Artificial Sequence
  Description of Artificial Sequence: Synthetic oligonucleotide
gcugcugucuccgcacac

SEQ ID NO: 52231 - RNA, 18 nt, Artificial Sequence
  Description of Artificial Sequence: Synthetic oligonucleotide
ccgcugcugcugucuccg

SEQ ID NO: 52232 - RNA, 18 nt, Artificial Sequence
  Description of Artificial Sequence: Synthetic oligonucleotide
gcuucccgcugcugcugu

SEQ ID NO: 52233 - RNA, 18 nt, Artificial Sequence
  Description of Artificial Sequence: Synthetic oligonucleotide
auagugcuucccgcugcu

SEQ ID NO: 52234 - RNA, 18 nt, Artificial Sequence
  Description of Artificial Sequence: Synthetic oligonucleotide
augccauagugcuucccg

SEQ ID NO: 52235 - RNA, 18 nt, Artificial Sequence
  Description of Artificial Sequence: Synthetic oligonucleotide
cauagaugccauagugcu

SEQ ID NO: 52236 - RNA, 18 nt, Artificial Sequence
  Description of Artificial Sequence: Synthetic oligonucleotide
gcaggcauagaugccaua

SEQ ID NO: 52237 - RNA, 18 nt, Artificial Sequence
  Description of Artificial Sequence: Synthetic oligonucleotide
ccguugcaggcauagaug

SEQ ID NO: 52238 - RNA, 18 nt, Artificial Sequence
  Description of Artificial Sequence: Synthetic oligonucleotide
ugcagccguugcaggcau

SEQ ID NO: 52239 - RNA, 18 nt, Artificial Sequence
  Description of Artificial Sequence: Synthetic oligonucleotide
gccgcugcagccguugca

SEQ ID NO: 52240 - RNA, 18 nt, Artificial Sequence
  Description of Artificial Sequence: Synthetic oligonucleotide
aagaagccgcugcagccg

SEQ ID NO: 52241 - RNA, 18 nt, Artificial Sequence
  Description of Artificial Sequence: Synthetic oligonucleotide
ucuugaagaagccgcugc

SEQ ID NO: 52242 - RNA, 18 nt, Artificial Sequence
  Description of Artificial Sequence: Synthetic oligonucleotide
gcuccucuugaagaagcc

SEQ ID NO: 52243 - RNA, 18 nt, Artificial Sequence
  Description of Artificial Sequence: Synthetic oligonucleotide
cguacgcuccucuugaag

SEQ ID NO: 52244 - RNA, 18 nt, Artificial Sequence
  Description of Artificial Sequence: Synthetic oligonucleotide
uccgccguacgcuccucu

SEQ ID NO: 52245 - RNA, 18 nt, Artificial Sequence
  Description of Artificial Sequence: Synthetic oligonucleotide
gagccuccgccguacgcu

SEQ ID NO: 52246 - RNA, 18 nt, Artificial Sequence
  Description of Artificial Sequence: Synthetic oligonucleotide
uagaugagccuccgccgu

SEQ ID NO: 52247 - RNA, 18 nt, Artificial Sequence
  Description of Artificial Sequence: Synthetic oligonucleotide
gcggcacuggagcgaggg

SEQ ID NO: 52248 - RNA, 18 nt, Artificial Sequence
  Description of Artificial Sequence: Synthetic oligonucleotide
cacgcggcacuggagcga

SEQ ID NO: 52249 - RNA, 18 nt, Artificial Sequence
  Description of Artificial Sequence: Synthetic oligonucleotide
ccgcacacgcggcacugg

SEQ ID NO: 52250 - RNA, 18 nt, Artificial Sequence
  Description of Artificial Sequence: Synthetic oligonucleotide
ugucuccgcacacgcggc

SEQ ID NO: 52251 - RNA, 18 nt, Artificial Sequence
  Description of Artificial Sequence: Synthetic oligonucleotide
gcugcugucuccgcacac

SEQ ID NO: 52252 - RNA, 18 nt, Artificial Sequence
  Description of Artificial Sequence: Synthetic oligonucleotide
ccgcugcugcugucuccg

SEQ ID NO: 52253 - RNA, 18 nt, Artificial Sequence
  Description of Artificial Sequence: Synthetic oligonucleotide
gcuucccgcugcugcugu

SEQ ID NO: 52254 - RNA, 18 nt, Artificial Sequence
  Description of Artificial Sequence: Synthetic oligonucleotide
auagugcuucccgcugcu

SEQ ID NO: 52255 - RNA, 18 nt, Artificial Sequence
  Description of Artificial Sequence: Synthetic oligonucleotide
augccauagugcuucccg

SEQ ID NO: 52256 - RNA, 18 nt, Artificial Sequence
  Description of Artificial Sequence: Synthetic oligonucleotide
cauagaugccauagugcu

SEQ ID NO: 52257 - RNA, 18 nt, Artificial Sequence
  Description of Artificial Sequence: Synthetic oligonucleotide
gcaggcauagaugccaua

SEQ ID NO: 52258 - RNA, 18 nt, Artificial Sequence
  Description of Artificial Sequence: Synthetic oligonucleotide
ccguugcaggcauagaug

SEQ ID NO: 52259 - RNA, 18 nt, Artificial Sequence
  Description of Artificial Sequence: Synthetic oligonucleotide
ugcagccguugcaggcau

SEQ ID NO: 52260 - RNA, 18 nt, Artificial Sequence
  Description of Artificial Sequence: Synthetic oligonucleotide
gccgcugcagccguugca

SEQ ID NO: 52261 - RNA, 18 nt, Artificial Sequence
  Description of Artificial Sequence: Synthetic oligonucleotide
aagaagccgcugcagccg

SEQ ID NO: 52262 - RNA, 18 nt, Artificial Sequence
  Description of Artificial Sequence: Synthetic oligonucleotide
ucuugaagaagccgcugc

SEQ ID NO: 52263 - RNA, 18 nt, Artificial Sequence
  Description of Artificial Sequence: Synthetic oligonucleotide
gcuccucuugaagaagcc

SEQ ID NO: 52264 - RNA, 18 nt, Artificial Sequence
  Description of Artificial Sequence: Synthetic oligonucleotide
cguacgcuccucuugaag

SEQ ID NO: 52265 - RNA, 18 nt, Artificial Sequence
  Description of Artificial Sequence: Synthetic oligonucleotide
uccgccguacgcuccucu

SEQ ID NO: 52266 - RNA, 18 nt, Artificial Sequence
  Description of Artificial Sequence: Synthetic oligonucleotide
gagccuccgccguacgcu

SEQ ID NO: 52267 - RNA, 18 nt, Artificial Sequence
  Description of Artificial Sequence: Synthetic oligonucleotide
uagaugagccuccgccgu

SEQ ID NO: 52268 - RNA, 18 nt, Artificial Sequence
  Description of Artificial Sequence: Synthetic oligonucleotide
ccagcagggcccaccgca

SEQ ID NO: 52269 - RNA, 18 nt, Artificial Sequence
  Description of Artificial Sequence: Synthetic oligonucleotide
gacgcccagcagggccca

SEQ ID NO: 52270 - RNA, 18 nt, Artificial Sequence
  Description of Artificial Sequence: Synthetic oligonucleotide
gggcagacgcccagcagg

SEQ ID NO: 52271 - RNA, 18 nt, Artificial Sequence
  Description of Artificial Sequence: Synthetic oligonucleotide
accccuccagaaccccuc

SEQ ID NO: 52272 - RNA, 18 nt, Artificial Sequence
  Description of Artificial Sequence: Synthetic oligonucleotide
cccucaccccuccagaac

SEQ ID NO: 52273 - RNA, 18 nt, Artificial Sequence
  Description of Artificial Sequence: Synthetic oligonucleotide
gcacccccucaccccucc

SEQ ID NO: 52274 - RNA, 18 nt, Artificial Sequence
  Description of Artificial Sequence: Synthetic oligonucleotide
ccugagcacccccucacc

SEQ ID NO: 52275 - RNA, 18 nt, Artificial Sequence
  Description of Artificial Sequence: Synthetic oligonucleotide
cuuccccugagcaccccc

SEQ ID NO: 52276 - RNA, 18 nt, Artificial Sequence
  Description of Artificial Sequence: Synthetic oligonucleotide
ccccucuuccccugagca

SEQ ID NO: 52277 - RNA, 18 nt, Artificial Sequence
  Description of Artificial Sequence: Synthetic oligonucleotide
ccaagccccucuuccccu

SEQ ID NO: 52278 - RNA, 18 nt, Artificial Sequence
  Description of Artificial Sequence: Synthetic oligonucleotide
uuugcccaagccccucuu

SEQ ID NO: 52279 - RNA, 18 nt, Artificial Sequence
  Description of Artificial Sequence: Synthetic oligonucleotide
acauuuuugcccaagccc

SEQ ID NO: 52280 - RNA, 18 nt, Artificial Sequence
  Description of Artificial Sequence: Synthetic oligonucleotide
cuuggacauuuuugccca

SEQ ID NO: 52281 - RNA, 18 nt, Artificial Sequence
  Description of Artificial Sequence: Synthetic oligonucleotide
augggcuuggacauuuuu

SEQ ID NO: 52282 - RNA, 18 nt, Artificial Sequence
  Description of Artificial Sequence: Synthetic oligonucleotide
gagccaugggcuuggaca

SEQ ID NO: 52283 - RNA, 18 nt, Artificial Sequence
  Description of Artificial Sequence: Synthetic oligonucleotide
ugagcacccccucacccc

SEQ ID NO: 52284 - RNA, 18 nt, Artificial Sequence
  Description of Artificial Sequence: Synthetic oligonucleotide
uccccugagcacccccuc

SEQ ID NO: 52285 - RNA, 18 nt, Artificial Sequence
  Description of Artificial Sequence: Synthetic oligonucleotide
ccucuuccccugagcacc

SEQ ID NO: 52286 - RNA, 18 nt, Artificial Sequence
  Description of Artificial Sequence: Synthetic oligonucleotide
aagccccucuuccccuga

SEQ ID NO: 52287 - RNA, 18 nt, Artificial Sequence
  Description of Artificial Sequence: Synthetic oligonucleotide
ugcccaagccccucuucc

SEQ ID NO: 52288 - RNA, 18 nt, Artificial Sequence
  Description of Artificial Sequence: Synthetic oligonucleotide
auuuuugcccaagccccu

SEQ ID NO: 52289 - RNA, 18 nt, Artificial Sequence
  Description of Artificial Sequence: Synthetic oligonucleotide
uggacauuuuugcccaag

SEQ ID NO: 52290 - RNA, 18 nt, Artificial Sequence
  Description of Artificial Sequence: Synthetic oligonucleotide
gggcuuggacauuuuugc

SEQ ID NO: 52291 - RNA, 18 nt, Artificial Sequence
  Description of Artificial Sequence: Synthetic oligonucleotide
gccaugggcuuggacauu

SEQ ID NO: 52292 - RNA, 18 nt, Artificial Sequence
  Description of Artificial Sequence: Synthetic oligonucleotide
ccugagccaugggcuugg

SEQ ID NO: 52293 - RNA, 18 nt, Artificial Sequence
  Description of Artificial Sequence: Synthetic oligonucleotide
caugcccugagccauggg

SEQ ID NO: 52294 - RNA, 18 nt, Artificial Sequence
  Description of Artificial Sequence: Synthetic oligonucleotide
ccucccaugcccugagcc

SEQ ID NO: 52295 - RNA, 18 nt, Artificial Sequence
  Description of Artificial Sequence: Synthetic oligonucleotide
gugucccucccaugcccu

SEQ ID NO: 52296 - RNA, 18 nt, Artificial Sequence
  Description of Artificial Sequence: Synthetic oligonucleotide
ggucagugucccucccau

SEQ ID NO: 52297 - RNA, 18 nt, Artificial Sequence
  Description of Artificial Sequence: Synthetic oligonucleotide
cccugcccccaccuggca

SEQ ID NO: 52298 - RNA, 18 nt, Artificial Sequence
  Description of Artificial Sequence: Synthetic oligonucleotide
cacaucccugcccccacc

SEQ ID NO: 52299 - RNA, 18 nt, Artificial Sequence
  Description of Artificial Sequence: Synthetic oligonucleotide
gggcacaucccugccccc

SEQ ID NO: 52300 - RNA, 18 nt, Artificial Sequence
  Description of Artificial Sequence: Synthetic oligonucleotide
gugggccuuguccacggg

SEQ ID NO: 52301 - RNA, 18 nt, Artificial Sequence
  Description of Artificial Sequence: Synthetic oligonucleotide
uugcggugggccuugucc

SEQ ID NO: 52302 - RNA, 18 nt, Artificial Sequence
  Description of Artificial Sequence: Synthetic oligonucleotide
acugguugcggugggccu

SEQ ID NO: 52303 - RNA, 18 nt, Artificial Sequence
  Description of Artificial Sequence: Synthetic oligonucleotide
cuggcacugguugcggug

SEQ ID NO: 52304 - RNA, 18 nt, Artificial Sequence
  Description of Artificial Sequence: Synthetic oligonucleotide
caggccuggcacugguug

SEQ ID NO: 52305 - RNA, 18 nt, Artificial Sequence
  Description of Artificial Sequence: Synthetic oligonucleotide
gccggcaggccuggcacu

SEQ ID NO: 52306 - RNA, 18 nt, Artificial Sequence
  Description of Artificial Sequence: Synthetic oligonucleotide
cuucagccggcaggccug

SEQ ID NO: 52307 - RNA, 18 nt, Artificial Sequence
  Description of Artificial Sequence: Synthetic oligonucleotide
cacuucuucagccggcag

SEQ ID NO: 52308 - RNA, 18 nt, Artificial Sequence
  Description of Artificial Sequence: Synthetic oligonucleotide
gcaggcacuucuucagcc

SEQ ID NO: 52309 - RNA, 18 nt, Artificial Sequence
  Description of Artificial Sequence: Synthetic oligonucleotide
cgccugcaggcacuucuu

SEQ ID NO: 52310 - RNA, 18 nt, Artificial Sequence
  Description of Artificial Sequence: Synthetic oligonucleotide
auccccgccugcaggcac

SEQ ID NO: 52311 - RNA, 18 nt, Artificial Sequence
  Description of Artificial Sequence: Synthetic oligonucleotide
gguucauccccgccugca

SEQ ID NO: 52312 - RNA, 18 nt, Artificial Sequence
  Description of Artificial Sequence: Synthetic oligonucleotide
guccugguucauccccgc

SEQ ID NO: 52313 - RNA, 18 nt, Artificial Sequence
  Description of Artificial Sequence: Synthetic oligonucleotide
caucccugcccccaccug

SEQ ID NO: 52314 - RNA, 18 nt, Artificial Sequence
  Description of Artificial Sequence: Synthetic oligonucleotide
gggcacaucccugccccc

SEQ ID NO: 52315 - RNA, 18 nt, Artificial Sequence
  Description of Artificial Sequence: Synthetic oligonucleotide
gugggccuuguccacggg

SEQ ID NO: 52316 - RNA, 18 nt, Artificial Sequence
  Description of Artificial Sequence: Synthetic oligonucleotide
gcggugggccuuguccac

SEQ ID NO: 52317 - RNA, 18 nt, Artificial Sequence
  Description of Artificial Sequence: Synthetic oligonucleotide
ugguugcggugggccuug

SEQ ID NO: 52318 - RNA, 18 nt, Artificial Sequence
  Description of Artificial Sequence: Synthetic oligonucleotide
ggcacugguugcgguggg

SEQ ID NO: 52319 - RNA, 18 nt, Artificial Sequence
  Description of Artificial Sequence: Synthetic oligonucleotide
ggccuggcacugguugcg

SEQ ID NO: 52320 - RNA, 18 nt, Artificial Sequence
  Description of Artificial Sequence: Synthetic oligonucleotide
cggcaggccuggcacugg

SEQ ID NO: 52321 - RNA, 18 nt, Artificial Sequence
  Description of Artificial Sequence: Synthetic oligonucleotide
ucagccggcaggccuggc

SEQ ID NO: 52322 - RNA, 18 nt, Artificial Sequence
  Description of Artificial Sequence: Synthetic oligonucleotide
cuucuucagccggcaggc

SEQ ID NO: 52323 - RNA, 18 nt, Artificial Sequence
  Description of Artificial Sequence: Synthetic oligonucleotide
aggcacuucuucagccgg

SEQ ID NO: 52324 - RNA, 18 nt, Artificial Sequence
  Description of Artificial Sequence: Synthetic oligonucleotide
ccugcaggcacuucuuca

SEQ ID NO: 52325 - RNA, 18 nt, Artificial Sequence
  Description of Artificial Sequence: Synthetic oligonucleotide
ccccgccugcaggcacuu

SEQ ID NO: 52326 - RNA, 18 nt, Artificial Sequence
  Description of Artificial Sequence: Synthetic oligonucleotide
uucauccccgccugcagg

SEQ ID NO: 52327 - RNA, 18 nt, Artificial Sequence
  Description of Artificial Sequence: Synthetic oligonucleotide
ccugguucauccccgccu

SEQ ID NO: 52328 - RNA, 18 nt, Artificial Sequence
  Description of Artificial Sequence: Synthetic oligonucleotide
ccccgggccagcccccgc

SEQ ID NO: 52329 - RNA, 18 nt, Artificial Sequence
  Description of Artificial Sequence: Synthetic oligonucleotide
ccuccccccgggccagcc

SEQ ID NO: 52330 - RNA, 18 nt, Artificial Sequence
  Description of Artificial Sequence: Synthetic oligonucleotide
ugucaccuccccccgggc

SEQ ID NO: 52331 - RNA, 18 nt, Artificial Sequence
  Description of Artificial Sequence: Synthetic oligonucleotide
uuucuugucaccuccccc

SEQ ID NO: 52332 - RNA, 18 nt, Artificial Sequence
  Description of Artificial Sequence: Synthetic oligonucleotide
gcccauuucuugucaccu

SEQ ID NO: 52333 - RNA, 18 nt, Artificial Sequence
  Description of Artificial Sequence: Synthetic oligonucleotide
ccgcugcccauuucuugu

SEQ ID NO: 52334 - RNA, 18 nt, Artificial Sequence
  Description of Artificial Sequence: Synthetic oligonucleotide
cagucccgcugcccauuu

SEQ ID NO: 52335 - RNA, 18 nt, Artificial Sequence
  Description of Artificial Sequence: Synthetic oligonucleotide
cacgccagucccgcugcc

SEQ ID NO: 52336 - RNA, 18 nt, Artificial Sequence
  Description of Artificial Sequence: Synthetic oligonucleotide
gacgacacgccagucccg

SEQ ID NO: 52337 - RNA, 18 nt, Artificial Sequence
  Description of Artificial Sequence: Synthetic oligonucleotide
gucaggacgacacgccag

SEQ ID NO: 52338 - RNA, 18 nt, Artificial Sequence
  Description of Artificial Sequence: Synthetic oligonucleotide
gaagggucaggacgacac

SEQ ID NO: 52339 - RNA, 18 nt, Artificial Sequence
  Description of Artificial Sequence: Synthetic oligonucleotide
caccuccccccgggccag

SEQ ID NO: 52340 - RNA, 18 nt, Artificial Sequence
  Description of Artificial Sequence: Synthetic oligonucleotide
cuugucaccuccccccgg

SEQ ID NO: 52341 - RNA, 18 nt, Artificial Sequence
  Description of Artificial Sequence: Synthetic oligonucleotide
cauuucuugucaccuccc

SEQ ID NO: 52342 - RNA, 18 nt, Artificial Sequence
  Description of Artificial Sequence: Synthetic oligonucleotide
cugcccauuucuugucac

SEQ ID NO: 52343 - RNA, 18 nt, Artificial Sequence
  Description of Artificial Sequence: Synthetic oligonucleotide
ucccgcugcccauuucuu

SEQ ID NO: 52344 - RNA, 18 nt, Artificial Sequence
  Description of Artificial Sequence: Synthetic oligonucleotide
gccagucccgcugcccau

SEQ ID NO: 52345 - RNA, 18 nt, Artificial Sequence
  Description of Artificial Sequence: Synthetic oligonucleotide
gacacgccagucccgcug

SEQ ID NO: 52346 - RNA, 18 nt, Artificial Sequence
  Description of Artificial Sequence: Synthetic oligonucleotide
aggacgacacgccagucc

SEQ ID NO: 52347 - RNA, 18 nt, Artificial Sequence
  Description of Artificial Sequence: Synthetic oligonucleotide
gggucaggacgacacgcc

SEQ ID NO: 52348 - RNA, 18 nt, Artificial Sequence
  Description of Artificial Sequence: Synthetic oligonucleotide
uggcgcucguucugcacg

SEQ ID NO: 52349 - RNA, 18 nt, Artificial Sequence
  Description of Artificial Sequence: Synthetic oligonucleotide
gcggcuggcgcucguucu

SEQ ID NO: 52350 - RNA, 18 nt, Artificial Sequence
  Description of Artificial Sequence: Synthetic oligonucleotide
gcuucgcggcuggcgcuc

SEQ ID NO: 52351 - RNA, 18 nt, Artificial Sequence
  Description of Artificial Sequence: Synthetic oligonucleotide
gcugugcuucgcggcugg

SEQ ID NO: 52352 - RNA, 18 nt, Artificial Sequence
  Description of Artificial Sequence: Synthetic oligonucleotide
ccugggcugugcuucgcg

SEQ ID NO: 52353 - RNA, 18 nt, Artificial Sequence
  Description of Artificial Sequence: Synthetic oligonucleotide
guggaccugggcugugcu

SEQ ID NO: 52354 - RNA, 18 nt, Artificial Sequence
  Description of Artificial Sequence: Synthetic oligonucleotide
uccagguggaccugggcu

SEQ ID NO: 52355 - RNA, 18 nt, Artificial Sequence
  Description of Artificial Sequence: Synthetic oligonucleotide
ugcuguccagguggaccu

SEQ ID NO: 52356 - RNA, 18 nt, Artificial Sequence
  Description of Artificial Sequence: Synthetic oligonucleotide
cuccaugcuguccaggug

SEQ ID NO: 52357 - RNA, 18 nt, Artificial Sequence
  Description of Artificial Sequence: Synthetic oligonucleotide
uuggacuccaugcugucc

SEQ ID NO: 52358 - RNA, 18 nt, Artificial Sequence
  Description of Artificial Sequence: Synthetic oligonucleotide
caguguuggacuccaugc

SEQ ID NO: 52359 - RNA, 18 nt, Artificial Sequence
  Description of Artificial Sequence: Synthetic oligonucleotide
ggacucaguguuggacuc

SEQ ID NO: 52360 - RNA, 18 nt, Artificial Sequence
  Description of Artificial Sequence: Synthetic oligonucleotide
ggccgggacucaguguug

SEQ ID NO: 52361 - RNA, 18 nt, Artificial Sequence
  Description of Artificial Sequence: Synthetic oligonucleotide
acuccggccgggacucag

SEQ ID NO: 52362 - RNA, 18 nt, Artificial Sequence
  Description of Artificial Sequence: Synthetic oligonucleotide
cagggacuccggccggga

SEQ ID NO: 52363 - RNA, 18 nt, Artificial Sequence
  Description of Artificial Sequence: Synthetic oligonucleotide
gccaccagggacuccggc

SEQ ID NO: 52364 - RNA, 18 nt, Artificial Sequence
  Description of Artificial Sequence: Synthetic oligonucleotide
gggagccaccagggacuc

SEQ ID NO: 52365 - RNA, 18 nt, Artificial Sequence
  Description of Artificial Sequence: Synthetic oligonucleotide
gggcugcgcccugccggg

SEQ ID NO: 52366 - RNA, 18 nt, Artificial Sequence
  Description of Artificial Sequence: Synthetic oligonucleotide
cccgugggcugcgcccug

SEQ ID NO: 52367 - RNA, 18 nt, Artificial Sequence
  Description of Artificial Sequence: Synthetic oligonucleotide
gggccccgugggcugcgc

SEQ ID NO: 52368 - RNA, 18 nt, Artificial Sequence
  Description of Artificial Sequence: Synthetic oligonucleotide
ugcagacauggguguggg

SEQ ID NO: 52369 - RNA, 18 nt, Artificial Sequence
  Description of Artificial Sequence: Synthetic oligonucleotide
cuggcugcagacaugggu

SEQ ID NO: 52370 - RNA, 18 nt, Artificial Sequence
  Description of Artificial Sequence: Synthetic oligonucleotide
gggcucuggcugcagaca

SEQ ID NO: 52371 - RNA, 18 nt, Artificial Sequence
  Description of Artificial Sequence: Synthetic oligonucleotide
gcccagggcucuggcugc

SEQ ID NO: 52372 - RNA, 18 nt, Artificial Sequence
  Description of Artificial Sequence: Synthetic oligonucleotide
ugguggcccagggcucug

SEQ ID NO: 52373 - RNA, 18 nt, Artificial Sequence
  Description of Artificial Sequence: Synthetic oligonucleotide
ugaagugguggcccaggg

SEQ ID NO: 52374 - RNA, 18 nt, Artificial Sequence
  Description of Artificial Sequence: Synthetic oligonucleotide
ggccaugaagugguggcc

SEQ ID NO: 52375 - RNA, 18 nt, Artificial Sequence
  Description of Artificial Sequence: Synthetic oligonucleotide
aggcuggccaugaagugg

SEQ ID NO: 52376 - RNA, 18 nt, Artificial Sequence
  Description of Artificial Sequence: Synthetic oligonucleotide
uuauaaggcuggccauga

SEQ ID NO: 52377 - RNA, 18 nt, Artificial Sequence
  Description of Artificial Sequence: Synthetic oligonucleotide
agcuguuauaaggcuggc

SEQ ID NO: 52378 - RNA, 18 nt, Artificial Sequence
  Description of Artificial Sequence: Synthetic oligonucleotide
guuucagcuguuauaagg

SEQ ID NO: 52379 - RNA, 18 nt, Artificial Sequence
  Description of Artificial Sequence: Synthetic oligonucleotide
cacagguuucagcuguua

SEQ ID NO: 52380 - RNA, 18 nt, Artificial Sequence
  Description of Artificial Sequence: Synthetic oligonucleotide
cuuagcacagguuucagc

SEQ ID NO: 52381 - RNA, 18 nt, Artificial Sequence
  Description of Artificial Sequence: Synthetic oligonucleotide
uccagcuuagcacagguu

SEQ ID NO: 52382 - RNA, 18 nt, Artificial Sequence
  Description of Artificial Sequence: Synthetic oligonucleotide
cuggcuccagcuuagcac

SEQ ID NO: 52383 - RNA, 18 nt, Artificial Sequence
  Description of Artificial Sequence: Synthetic oligonucleotide
auccucuggcuccagcuu

SEQ ID NO: 52384 - RNA, 18 nt, Artificial Sequence
  Description of Artificial Sequence: Synthetic oligonucleotide
ggcgcucguucugcacgg

SEQ ID NO: 52385 - RNA, 18 nt, Artificial Sequence
  Description of Artificial Sequence: Synthetic oligonucleotide
cggcuggcgcucguucug

SEQ ID NO: 52386 - RNA, 18 nt, Artificial Sequence
  Description of Artificial Sequence: Synthetic oligonucleotide
cuucgcggcuggcgcucg

SEQ ID NO: 52387 - RNA, 18 nt, Artificial Sequence
  Description of Artificial Sequence: Synthetic oligonucleotide
cugugcuucgcggcuggc

SEQ ID NO: 52388 - RNA, 18 nt, Artificial Sequence
  Description of Artificial Sequence: Synthetic oligonucleotide
cugggcugugcuucgcgg

SEQ ID NO: 52389 - RNA, 18 nt, Artificial Sequence
  Description of Artificial Sequence: Synthetic oligonucleotide
uggaccugggcugugcuu

SEQ ID NO: 52390 - RNA, 18 nt, Artificial Sequence
  Description of Artificial Sequence: Synthetic oligonucleotide
ccagguggaccugggcug

SEQ ID NO: 52391 - RNA, 18 nt, Artificial Sequence
  Description of Artificial Sequence: Synthetic oligonucleotide
gcuguccagguggaccug

SEQ ID NO: 52392 - RNA, 18 nt, Artificial Sequence
  Description of Artificial Sequence: Synthetic oligonucleotide
uccaugcuguccaggugg

SEQ ID NO: 52393 - RNA, 18 nt, Artificial Sequence
  Description of Artificial Sequence: Synthetic oligonucleotide
uggacuccaugcugucca

SEQ ID NO: 52394 - RNA, 18 nt, Artificial Sequence
  Description of Artificial Sequence: Synthetic oligonucleotide
aguguuggacuccaugcu

SEQ ID NO: 52395 - RNA, 18 nt, Artificial Sequence
  Description of Artificial Sequence: Synthetic oligonucleotide
gacucaguguuggacucc

SEQ ID NO: 52396 - RNA, 18 nt, Artificial Sequence
  Description of Artificial Sequence: Synthetic oligonucleotide
gccgggacucaguguugg

SEQ ID NO: 52397 - RNA, 18 nt, Artificial Sequence
  Description of Artificial Sequence: Synthetic oligonucleotide
cuccggccgggacucagu

SEQ ID NO: 52398 - RNA, 18 nt, Artificial Sequence
  Description of Artificial Sequence: Synthetic oligonucleotide
agggacuccggccgggac

SEQ ID NO: 52399 - RNA, 18 nt, Artificial Sequence
  Description of Artificial Sequence: Synthetic oligonucleotide
ccaccagggacuccggcc

SEQ ID NO: 52400 - RNA, 18 nt, Artificial Sequence
  Description of Artificial Sequence: Synthetic oligonucleotide
gggagccaccagggacuc

SEQ ID NO: 52401 - RNA, 18 nt, Artificial Sequence
  Description of Artificial Sequence: Synthetic oligonucleotide
gggcugcgcccugccggg

SEQ ID NO: 52402 - RNA, 18 nt, Artificial Sequence
  Description of Artificial Sequence: Synthetic oligonucleotide
ccgugggcugcgcccugc

SEQ ID NO: 52403 - RNA, 18 nt, Artificial Sequence
  Description of Artificial Sequence: Synthetic oligonucleotide
gggccccgugggcugcgc

SEQ ID NO: 52404 - RNA, 18 nt, Artificial Sequence
  Description of Artificial Sequence: Synthetic oligonucleotide
ugcagacauggguguggg

SEQ ID NO: 52405 - RNA, 18 nt, Artificial Sequence
  Description of Artificial Sequence: Synthetic oligonucleotide
ggcugcagacaugggugu

SEQ ID NO: 52406 - RNA, 18 nt, Artificial Sequence
  Description of Artificial Sequence: Synthetic oligonucleotide
gcucuggcugcagacaug

SEQ ID NO: 52407 - RNA, 18 nt, Artificial Sequence
  Description of Artificial Sequence: Synthetic oligonucleotide
ccagggcucuggcugcag

SEQ ID NO: 52408 - RNA, 18 nt, Artificial Sequence
  Description of Artificial Sequence: Synthetic oligonucleotide
guggcccagggcucuggc

SEQ ID NO: 52409 - RNA, 18 nt, Artificial Sequence
  Description of Artificial Sequence: Synthetic oligonucleotide
aagugguggcccagggcu

SEQ ID NO: 52410 - RNA, 18 nt, Artificial Sequence
  Description of Artificial Sequence: Synthetic oligonucleotide
ccaugaagugguggccca

SEQ ID NO: 52411 - RNA, 18 nt, Artificial Sequence
  Description of Artificial Sequence: Synthetic oligonucleotide
gcuggccaugaaguggug

SEQ ID NO: 52412 - RNA, 18 nt, Artificial Sequence
  Description of Artificial Sequence: Synthetic oligonucleotide
auaaggcuggccaugaag

SEQ ID NO: 52413 - RNA, 18 nt, Artificial Sequence
  Description of Artificial Sequence: Synthetic oligonucleotide
cuguuauaaggcuggcca

SEQ ID NO: 52414 - RNA, 18 nt, Artificial Sequence
  Description of Artificial Sequence: Synthetic oligonucleotide
uucagcuguuauaaggcu

SEQ ID NO: 52415 - RNA, 18 nt, Artificial Sequence
  Description of Artificial Sequence: Synthetic oligonucleotide
cagguuucagcuguuaua

SEQ ID NO: 52416 - RNA, 18 nt, Artificial Sequence
  Description of Artificial Sequence: Synthetic oligonucleotide
uagcacagguuucagcug

SEQ ID NO: 52417 - RNA, 18 nt, Artificial Sequence
  Description of Artificial Sequence: Synthetic oligonucleotide
cagcuuagcacagguuuc

SEQ ID NO: 52418 - RNA, 18 nt, Artificial Sequence
  Description of Artificial Sequence: Synthetic oligonucleotide
ggcuccagcuuagcacag

SEQ ID NO: 52419 - RNA, 18 nt, Artificial Sequence
  Description of Artificial Sequence: Synthetic oligonucleotide
ccucuggcuccagcuuag

SEQ ID NO: 52420 - RNA, 18 nt, Artificial Sequence
  Description of Artificial Sequence: Synthetic oligonucleotide
cccucagcugcucuccca

SEQ ID NO: 52421 - RNA, 18 nt, Artificial Sequence
  Description of Artificial Sequence: Synthetic oligonucleotide
cugugcccucagcugcuc

SEQ ID NO: 52422 - RNA, 18 nt, Artificial Sequence
  Description of Artificial Sequence: Synthetic oligonucleotide
cccugcugugcccucagc

SEQ ID NO: 52423 - RNA, 18 nt, Artificial Sequence
  Description of Artificial Sequence: Synthetic oligonucleotide
ccaagcccugcugugccc

SEQ ID NO: 52424 - RNA, 18 nt, Artificial Sequence
  Description of Artificial Sequence: Synthetic oligonucleotide
ggaagccaagcccugcug

SEQ ID NO: 52425 - RNA, 18 nt, Artificial Sequence
  Description of Artificial Sequence: Synthetic oligonucleotide
acccgggaagccaagccc

SEQ ID NO: 52426 - RNA, 18 nt, Artificial Sequence
  Description of Artificial Sequence: Synthetic oligonucleotide
cugugacccgggaagcca

SEQ ID NO: 52427 - RNA, 18 nt, Artificial Sequence
  Description of Artificial Sequence: Synthetic oligonucleotide
cccugcugugacccggga

SEQ ID NO: 52428 - RNA, 18 nt, Artificial Sequence
  Description of Artificial Sequence: Synthetic oligonucleotide
ugcagcccugcugugacc

SEQ ID NO: 52429 - RNA, 18 nt, Artificial Sequence
  Description of Artificial Sequence: Synthetic oligonucleotide
ggcgcugcagcccugcug

SEQ ID NO: 52430 - RNA, 18 nt, Artificial Sequence
  Description of Artificial Sequence: Synthetic oligonucleotide
ggcaaggcgcugcagccc

SEQ ID NO: 52431 - RNA, 18 nt, Artificial Sequence
  Description of Artificial Sequence: Synthetic oligonucleotide
aucaaggcaaggcgcugc

SEQ ID NO: 52432 - RNA, 18 nt, Artificial Sequence
  Description of Artificial Sequence: Synthetic oligonucleotide
ggaggaucaaggcaaggc

SEQ ID NO: 52433 - RNA, 18 nt, Artificial Sequence
  Description of Artificial Sequence: Synthetic oligonucleotide
gggagggaggaucaaggc

SEQ ID NO: 52434 - RNA, 18 nt, Artificial Sequence
  Description of Artificial Sequence: Synthetic oligonucleotide
gggaguacuuggagcccc

SEQ ID NO: 52435 - RNA, 18 nt, Artificial Sequence
  Description of Artificial Sequence: Synthetic oligonucleotide
ggcgcugcagcccugcug

SEQ ID NO: 52436 - RNA, 18 nt, Artificial Sequence
  Description of Artificial Sequence: Synthetic oligonucleotide
ggcaaggcgcugcagccc

SEQ ID NO: 52437 - RNA, 18 nt, Artificial Sequence
  Description of Artificial Sequence: Synthetic oligonucleotide
aucaaggcaaggcgcugc

SEQ ID NO: 52438 - RNA, 18 nt, Artificial Sequence
  Description of Artificial Sequence: Synthetic oligonucleotide
ggaggaucaaggcaaggc

SEQ ID NO: 52439 - RNA, 18 nt, Artificial Sequence
  Description of Artificial Sequence: Synthetic oligonucleotide
gggagggaggaucaaggc

SEQ ID NO: 52440 - RNA, 18 nt, Artificial Sequence
  Description of Artificial Sequence: Synthetic oligonucleotide
aguacuuggagccccggg

SEQ ID NO: 52441 - RNA, 18 nt, Artificial Sequence
  Description of Artificial Sequence: Synthetic oligonucleotide
agggaguacuuggagccc

SEQ ID NO: 52442 - RNA, 18 nt, Artificial Sequence
  Description of Artificial Sequence: Synthetic oligonucleotide
guggcagggaguacuugg

SEQ ID NO: 52443 - RNA, 18 nt, Artificial Sequence
  Description of Artificial Sequence: Synthetic oligonucleotide
gggagguggcagggagua

SEQ ID NO: 52444 - RNA, 18 nt, Artificial Sequence
  Description of Artificial Sequence: Synthetic oligonucleotide
uucucgggagguggcagg

SEQ ID NO: 52445 - RNA, 18 nt, Artificial Sequence
  Description of Artificial Sequence: Synthetic oligonucleotide
ccugcuucucgggaggug

SEQ ID NO: 52446 - RNA, 18 nt, Artificial Sequence
  Description of Artificial Sequence: Synthetic oligonucleotide
uagcgccugcuucucggg

SEQ ID NO: 52447 - RNA, 18 nt, Artificial Sequence
  Description of Artificial Sequence: Synthetic oligonucleotide
gaucuuagcgccugcuuc

SEQ ID NO: 52448 - RNA, 18 nt, Artificial Sequence
  Description of Artificial Sequence: Synthetic oligonucleotide
guugugaucuuagcgccu

SEQ ID NO: 52449 - RNA, 18 nt, Artificial Sequence
  Description of Artificial Sequence: Synthetic oligonucleotide
acaucaauauucucauca

SEQ ID NO: 52450 - RNA, 18 nt, Artificial Sequence
  Description of Artificial Sequence: Synthetic oligonucleotide
uggugacaucaauauucu

SEQ ID NO: 52451 - RNA, 18 nt, Artificial Sequence
  Description of Artificial Sequence: Synthetic oligonucleotide
auugcuggugacaucaau

SEQ ID NO: 52452 - RNA, 18 nt, Artificial Sequence
  Description of Artificial Sequence: Synthetic oligonucleotide
gggucauugcuggugaca

SEQ ID NO: 52453 - RNA, 18 nt, Artificial Sequence
  Description of Artificial Sequence: Synthetic oligonucleotide
acucagggucauugcugg

SEQ ID NO: 52454 - RNA, 18 nt, Artificial Sequence
  Description of Artificial Sequence: Synthetic oligonucleotide
gggaacucagggucauug

SEQ ID NO: 52455 - RNA, 18 nt, Artificial Sequence
  Description of Artificial Sequence: Synthetic oligonucleotide
ggaguauggagaggaggg

SEQ ID NO: 52456 - RNA, 18 nt, Artificial Sequence
  Description of Artificial Sequence: Synthetic oligonucleotide
gaagaggaguauggagag

SEQ ID NO: 52457 - RNA, 18 nt, Artificial Sequence
  Description of Artificial Sequence: Synthetic oligonucleotide
gggaggaagaggaguaug

SEQ ID NO: 52458 - RNA, 18 nt, Artificial Sequence
  Description of Artificial Sequence: Synthetic oligonucleotide
gaugcuguccaggccgca

SEQ ID NO: 52459 - RNA, 18 nt, Artificial Sequence
  Description of Artificial Sequence: Synthetic oligonucleotide
ucauggaugcuguccagg

SEQ ID NO: 52460 - RNA, 18 nt, Artificial Sequence
  Description of Artificial Sequence: Synthetic oligonucleotide
aggucucauggaugcugu

SEQ ID NO: 52461 - RNA, 18 nt, Artificial Sequence
  Description of Artificial Sequence: Synthetic oligonucleotide
agccgaggucucauggau

SEQ ID NO: 52462 - RNA, 18 nt, Artificial Sequence
  Description of Artificial Sequence: Synthetic oligonucleotide
aggcgagccgaggucuca

SEQ ID NO: 52463 - RNA, 18 nt, Artificial Sequence
  Description of Artificial Sequence: Synthetic oligonucleotide
agaguaggcgagccgagg

SEQ ID NO: 52464 - RNA, 18 nt, Artificial Sequence
  Description of Artificial Sequence: Synthetic oligonucleotide
caugaagaguaggcgagc

SEQ ID NO: 52465 - RNA, 18 nt, Artificial Sequence
  Description of Artificial Sequence: Synthetic oligonucleotide
acggccaugaagaguagg

SEQ ID NO: 52466 - RNA, 18 nt, Artificial Sequence
  Description of Artificial Sequence: Synthetic oligonucleotide
acuugacggccaugaaga

SEQ ID NO: 52467 - RNA, 18 nt, Artificial Sequence
  Description of Artificial Sequence: Synthetic oligonucleotide
ggcccacuugacggccau

SEQ ID NO: 52468 - RNA, 18 nt, Artificial Sequence
  Description of Artificial Sequence: Synthetic oligonucleotide
uucuuggcccacuugacg

SEQ ID NO: 52469 - RNA, 18 nt, Artificial Sequence
  Description of Artificial Sequence: Synthetic oligonucleotide
gcagguucuuggcccacu

SEQ ID NO: 52470 - RNA, 18 nt, Artificial Sequence
  Description of Artificial Sequence: Synthetic oligonucleotide
cacaggcagguucuuggc

SEQ ID NO: 52471 - RNA, 18 nt, Artificial Sequence
  Description of Artificial Sequence: Synthetic oligonucleotide
gagaacacaggcagguuc

SEQ ID NO: 52472 - RNA, 18 nt, Artificial Sequence
  Description of Artificial Sequence: Synthetic oligonucleotide
ggcuggagaacacaggca

SEQ ID NO: 52473 - RNA, 18 nt, Artificial Sequence
  Description of Artificial Sequence: Synthetic oligonucleotide
gggcaggcuggagaacac

SEQ ID NO: 52474 - RNA, 18 nt, Artificial Sequence
  Description of Artificial Sequence: Synthetic oligonucleotide
cggaagggcaggcuggag

SEQ ID NO: 52475 - RNA, 18 nt, Artificial Sequence
  Description of Artificial Sequence: Synthetic oligonucleotide
gaucccggaagggcaggc

SEQ ID NO: 52476 - RNA, 18 nt, Artificial Sequence
  Description of Artificial Sequence: Synthetic oligonucleotide
acaucaauauucucauca

SEQ ID NO: 52477 - RNA, 18 nt, Artificial Sequence
  Description of Artificial Sequence: Synthetic oligonucleotide
uggugacaucaauauucu

SEQ ID NO: 52478 - RNA, 18 nt, Artificial Sequence
  Description of Artificial Sequence: Synthetic oligonucleotide
auugcuggugacaucaau

SEQ ID NO: 52479 - RNA, 18 nt, Artificial Sequence
  Description of Artificial Sequence: Synthetic oligonucleotide
gggucauugcuggugaca

SEQ ID NO: 52480 - RNA, 18 nt, Artificial Sequence
  Description of Artificial Sequence: Synthetic oligonucleotide
acucagggucauugcugg

SEQ ID NO: 52481 - RNA, 18 nt, Artificial Sequence
  Description of Artificial Sequence: Synthetic oligonucleotide
ggaguauggagaggaggg

SEQ ID NO: 52482 - RNA, 18 nt, Artificial Sequence
  Description of Artificial Sequence: Synthetic oligonucleotide
gaagaggaguauggagag

SEQ ID NO: 52483 - RNA, 18 nt, Artificial Sequence
  Description of Artificial Sequence: Synthetic oligonucleotide
gggaggaagaggaguaug

SEQ ID NO: 52484 - RNA, 18 nt, Artificial Sequence
  Description of Artificial Sequence: Synthetic oligonucleotide
gcuguccaggccgcaggg

SEQ ID NO: 52485 - RNA, 18 nt, Artificial Sequence
  Description of Artificial Sequence: Synthetic oligonucleotide
augcuguccaggccgcag

SEQ ID NO: 52486 - RNA, 18 nt, Artificial Sequence
  Description of Artificial Sequence: Synthetic oligonucleotide
cauggaugcuguccaggc

SEQ ID NO: 52487 - RNA, 18 nt, Artificial Sequence
  Description of Artificial Sequence: Synthetic oligonucleotide
ggucucauggaugcuguc

SEQ ID NO: 52488 - RNA, 18 nt, Artificial Sequence
  Description of Artificial Sequence: Synthetic oligonucleotide
gccgaggucucauggaug

SEQ ID NO: 52489 - RNA, 18 nt, Artificial Sequence
  Description of Artificial Sequence: Synthetic oligonucleotide
ggcgagccgaggucucau

SEQ ID NO: 52490 - RNA, 18 nt, Artificial Sequence
  Description of Artificial Sequence: Synthetic oligonucleotide
gaguaggcgagccgaggu

SEQ ID NO: 52491 - RNA, 18 nt, Artificial Sequence
  Description of Artificial Sequence: Synthetic oligonucleotide
augaagaguaggcgagcc

SEQ ID NO: 52492 - RNA, 18 nt, Artificial Sequence
  Description of Artificial Sequence: Synthetic oligonucleotide
cggccaugaagaguaggc

SEQ ID NO: 52493 - RNA, 18 nt, Artificial Sequence
  Description of Artificial Sequence: Synthetic oligonucleotide
cuugacggccaugaagag

SEQ ID NO: 52494 - RNA, 18 nt, Artificial Sequence
  Description of Artificial Sequence: Synthetic oligonucleotide
gcccacuugacggccaug

SEQ ID NO: 52495 - RNA, 18 nt, Artificial Sequence
  Description of Artificial Sequence: Synthetic oligonucleotide
ucuuggcccacuugacgg

SEQ ID NO: 52496 - RNA, 18 nt, Artificial Sequence
  Description of Artificial Sequence: Synthetic oligonucleotide
cagguucuuggcccacuu

SEQ ID NO: 52497 - RNA, 18 nt, Artificial Sequence
  Description of Artificial Sequence: Synthetic oligonucleotide
acaggcagguucuuggcc

SEQ ID NO: 52498 - RNA, 18 nt, Artificial Sequence
  Description of Artificial Sequence: Synthetic oligonucleotide
agaacacaggcagguucu

SEQ ID NO: 52499 - RNA, 18 nt, Artificial Sequence
  Description of Artificial Sequence: Synthetic oligonucleotide
gcuggagaacacaggcag

SEQ ID NO: 52500 - RNA, 18 nt, Artificial Sequence
  Description of Artificial Sequence: Synthetic oligonucleotide
ggcaggcuggagaacaca

SEQ ID NO: 52501 - RNA, 18 nt, Artificial Sequence
  Description of Artificial Sequence: Synthetic oligonucleotide
ggaagggcaggcuggaga

SEQ ID NO: 52502 - RNA, 18 nt, Artificial Sequence
  Description of Artificial Sequence: Synthetic oligonucleotide
aucccggaagggcaggcu

SEQ ID NO: 52503 - RNA, 18 nt, Artificial Sequence
  Description of Artificial Sequence: Synthetic oligonucleotide
ccagcaggcaggccggua

SEQ ID NO: 52504 - RNA, 18 nt, Artificial Sequence
  Description of Artificial Sequence: Synthetic oligonucleotide
gcuccccagcaggcaggc

SEQ ID NO: 52505 - RNA, 18 nt, Artificial Sequence
  Description of Artificial Sequence: Synthetic oligonucleotide
gccuagcuccccagcagg

SEQ ID NO: 52506 - RNA, 18 nt, Artificial Sequence
  Description of Artificial Sequence: Synthetic oligonucleotide
gcccagccuagcucccca

SEQ ID NO: 52507 - RNA, 18 nt, Artificial Sequence
  Description of Artificial Sequence: Synthetic oligonucleotide
ccccagcccagccuagcu

SEQ ID NO: 52508 - RNA, 18 nt, Artificial Sequence
  Description of Artificial Sequence: Synthetic oligonucleotide
ccugaccccagcccagcc

SEQ ID NO: 52509 - RNA, 18 nt, Artificial Sequence
  Description of Artificial Sequence: Synthetic oligonucleotide
ggccgccugaccccagcc

SEQ ID NO: 52510 - RNA, 18 nt, Artificial Sequence
  Description of Artificial Sequence: Synthetic oligonucleotide
gagugggccgccugaccc

SEQ ID NO: 52511 - RNA, 18 nt, Artificial Sequence
  Description of Artificial Sequence: Synthetic oligonucleotide
gacucgagugggccgccu

SEQ ID NO: 52512 - RNA, 18 nt, Artificial Sequence
  Description of Artificial Sequence: Synthetic oligonucleotide
ugguugacucgagugggc

SEQ ID NO: 52513 - RNA, 18 nt, Artificial Sequence
  Description of Artificial Sequence: Synthetic oligonucleotide
cugucugguugacucgag

SEQ ID NO: 52514 - RNA, 18 nt, Artificial Sequence
  Description of Artificial Sequence: Synthetic oligonucleotide
gugcccugucugguugac

SEQ ID NO: 52515 - RNA, 18 nt, Artificial Sequence
  Description of Artificial Sequence: Synthetic oligonucleotide
ugugugugcccugucugg

SEQ ID NO: 52516 - RNA, 18 nt, Artificial Sequence
  Description of Artificial Sequence: Synthetic oligonucleotide
gggaugugugugcccugu

SEQ ID NO: 52517 - RNA, 18 nt, Artificial Sequence
  Description of Artificial Sequence: Synthetic oligonucleotide
cauucauacuggcguggg

SEQ ID NO: 52518 - RNA, 18 nt, Artificial Sequence
  Description of Artificial Sequence: Synthetic oligonucleotide
gugugcauucauacuggc

SEQ ID NO: 52519 - RNA, 18 nt, Artificial Sequence
  Description of Artificial Sequence: Synthetic oligonucleotide
aagcugugugcauucaua

SEQ ID NO: 52520 - RNA, 18 nt, Artificial Sequence
  Description of Artificial Sequence: Synthetic oligonucleotide
cauccaagcugugugcau

SEQ ID NO: 52521 - RNA, 18 nt, Artificial Sequence
  Description of Artificial Sequence: Synthetic oligonucleotide
aucaccauccaagcugug

SEQ ID NO: 52522 - RNA, 18 nt, Artificial Sequence
  Description of Artificial Sequence: Synthetic oligonucleotide
cagccaucaccauccaag

SEQ ID NO: 52523 - RNA, 18 nt, Artificial Sequence
  Description of Artificial Sequence: Synthetic oligonucleotide
guccccagccaucaccau

SEQ ID NO: 52524 - RNA, 18 nt, Artificial Sequence
  Description of Artificial Sequence: Synthetic oligonucleotide
uguguguccccagccauc

SEQ ID NO: 52525 - RNA, 18 nt, Artificial Sequence
  Description of Artificial Sequence: Synthetic oligonucleotide
agguauguguguccccag

SEQ ID NO: 52526 - RNA, 18 nt, Artificial Sequence
  Description of Artificial Sequence: Synthetic oligonucleotide
aucagagguauguguguc

SEQ ID NO: 52527 - RNA, 18 nt, Artificial Sequence
  Description of Artificial Sequence: Synthetic oligonucleotide
gcugaaucagagguaugu

SEQ ID NO: 52528 - RNA, 18 nt, Artificial Sequence
  Description of Artificial Sequence: Synthetic oligonucleotide
ccaucgcugaaucagagg

SEQ ID NO: 52529 - RNA, 18 nt, Artificial Sequence
  Description of Artificial Sequence: Synthetic oligonucleotide
cccagccaucgcugaauc

SEQ ID NO: 52530 - RNA, 18 nt, Artificial Sequence
  Description of Artificial Sequence: Synthetic oligonucleotide
ugcaccccagccaucgcu

SEQ ID NO: 52531 - RNA, 18 nt, Artificial Sequence
  Description of Artificial Sequence: Synthetic oligonucleotide
ugagaugcaccccagcca

SEQ ID NO: 52532 - RNA, 18 nt, Artificial Sequence
  Description of Artificial Sequence: Synthetic oligonucleotide
aucccugagaugcacccc

SEQ ID NO: 52533 - RNA, 18 nt, Artificial Sequence
  Description of Artificial Sequence: Synthetic oligonucleotide
ucaccaucccugagaugc

SEQ ID NO: 52534 - RNA, 18 nt, Artificial Sequence
  Description of Artificial Sequence: Synthetic oligonucleotide
caccgucaccaucccuga

SEQ ID NO: 52535 - RNA, 18 nt, Artificial Sequence
  Description of Artificial Sequence: Synthetic oligonucleotide
acccccaccgucaccauc

SEQ ID NO: 52536 - RNA, 18 nt, Artificial Sequence
  Description of Artificial Sequence: Synthetic oligonucleotide
caugcacccccaccguca

SEQ ID NO: 52537 - RNA, 18 nt, Artificial Sequence
  Description of Artificial Sequence: Synthetic oligonucleotide
agaugcaugcacccccac

SEQ ID NO: 52538 - RNA, 18 nt, Artificial Sequence
  Description of Artificial Sequence: Synthetic oligonucleotide
gccagagaugcaugcacc

SEQ ID NO: 52539 - RNA, 18 nt, Artificial Sequence
  Description of Artificial Sequence: Synthetic oligonucleotide
ccugugccagagaugcau

SEQ ID NO: 52540 - RNA, 18 nt, Artificial Sequence
  Description of Artificial Sequence: Synthetic oligonucleotide
ucaucccugugccagaga

SEQ ID NO: 52541 - RNA, 18 nt, Artificial Sequence
  Description of Artificial Sequence: Synthetic oligonucleotide
gaccaucaucccugugcc

SEQ ID NO: 52542 - RNA, 18 nt, Artificial Sequence
  Description of Artificial Sequence: Synthetic oligonucleotide
accccgaccaucaucccu

SEQ ID NO: 52543 - RNA, 18 nt, Artificial Sequence
  Description of Artificial Sequence: Synthetic oligonucleotide
ugugcaccccgaccauca

SEQ ID NO: 52544 - RNA, 18 nt, Artificial Sequence
  Description of Artificial Sequence: Synthetic oligonucleotide
cuaggugugcaccccgac

SEQ ID NO: 52545 - RNA, 18 nt, Artificial Sequence
  Description of Artificial Sequence: Synthetic oligonucleotide
aucuccuaggugugcacc

SEQ ID NO: 52546 - RNA, 18 nt, Artificial Sequence
  Description of Artificial Sequence: Synthetic oligonucleotide
ucaucaucuccuaggugu

SEQ ID NO: 52547 - RNA, 18 nt, Artificial Sequence
  Description of Artificial Sequence: Synthetic oligonucleotide
agccaucaucaucuccua

SEQ ID NO: 52548 - RNA, 18 nt, Artificial Sequence
  Description of Artificial Sequence: Synthetic oligonucleotide
ucccuagccaucaucauc

SEQ ID NO: 52549 - RNA, 18 nt, Artificial Sequence
  Description of Artificial Sequence: Synthetic oligonucleotide
guaggucccuagccauca

SEQ ID NO: 52550 - RNA, 18 nt, Artificial Sequence
  Description of Artificial Sequence: Synthetic oligonucleotide
gcccuguaggucccuagc

SEQ ID NO: 52551 - RNA, 18 nt, Artificial Sequence
  Description of Artificial Sequence: Synthetic oligonucleotide
ccugggcccuguaggucc

SEQ ID NO: 52552 - RNA, 18 nt, Artificial Sequence
  Description of Artificial Sequence: Synthetic oligonucleotide
aagacccugggcccugua

SEQ ID NO: 52553 - RNA, 18 nt, Artificial Sequence
  Description of Artificial Sequence: Synthetic oligonucleotide
uuaagaagacccugggcc

SEQ ID NO: 52554 - RNA, 18 nt, Artificial Sequence
  Description of Artificial Sequence: Synthetic oligonucleotide
agaacuuaagaagacccu

SEQ ID NO: 52555 - RNA, 18 nt, Artificial Sequence
  Description of Artificial Sequence: Synthetic oligonucleotide
cuuccagaacuuaagaag

SEQ ID NO: 52556 - RNA, 18 nt, Artificial Sequence
  Description of Artificial Sequence: Synthetic oligonucleotide
agggucuuccagaacuua

SEQ ID NO: 52557 - RNA, 18 nt, Artificial Sequence
  Description of Artificial Sequence: Synthetic oligonucleotide
gccugagggucuuccaga

SEQ ID NO: 52558 - RNA, 18 nt, Artificial Sequence
  Description of Artificial Sequence: Synthetic oligonucleotide
gcagggccugagggucuu

SEQ ID NO: 52559 - RNA, 18 nt, Artificial Sequence
  Description of Artificial Sequence: Synthetic oligonucleotide
ugucugcagggccugagg

SEQ ID NO: 52560 - RNA, 18 nt, Artificial Sequence
  Description of Artificial Sequence: Synthetic oligonucleotide
cagaaugucugcagggcc

SEQ ID NO: 52561 - RNA, 18 nt, Artificial Sequence
  Description of Artificial Sequence: Synthetic oligonucleotide
acccacagaaugucugca

SEQ ID NO: 52562 - RNA, 18 nt, Artificial Sequence
  Description of Artificial Sequence: Synthetic oligonucleotide
uuguuacccacagaaugu

SEQ ID NO: 52563 - RNA, 18 nt, Artificial Sequence
  Description of Artificial Sequence: Synthetic oligonucleotide
gucacuuguuacccacag

SEQ ID NO: 52564 - RNA, 18 nt, Artificial Sequence
  Description of Artificial Sequence: Synthetic oligonucleotide
ugcaggucacuuguuacc

SEQ ID NO: 52565 - RNA, 18 nt, Artificial Sequence
  Description of Artificial Sequence: Synthetic oligonucleotide
gggugugcaggucacuug

SEQ ID NO: 52566 - RNA, 18 nt, Artificial Sequence
  Description of Artificial Sequence: Synthetic oligonucleotide
guucagggugugcagguc

SEQ ID NO: 52567 - RNA, 18 nt, Artificial Sequence
  Description of Artificial Sequence: Synthetic oligonucleotide
agccuguucagggugugc

SEQ ID NO: 52568 - RNA, 18 nt, Artificial Sequence
  Description of Artificial Sequence: Synthetic oligonucleotide
cacucagccuguucaggg

SEQ ID NO: 52569 - RNA, 18 nt, Artificial Sequence
  Description of Artificial Sequence: Synthetic oligonucleotide
ucagccacucagccuguu

SEQ ID NO: 52570 - RNA, 18 nt, Artificial Sequence
  Description of Artificial Sequence: Synthetic oligonucleotide
uagagucagccacucagc

SEQ ID NO: 52571 - RNA, 18 nt, Artificial Sequence
  Description of Artificial Sequence: Synthetic oligonucleotide
gggccuagagucagccac

SEQ ID NO: 52572 - RNA, 18 nt, Artificial Sequence
  Description of Artificial Sequence: Synthetic oligonucleotide
uaggcacuugugcuccaa

SEQ ID NO: 52573 - RNA, 18 nt, Artificial Sequence
  Description of Artificial Sequence: Synthetic oligonucleotide
agucguaggcacuugugc

SEQ ID NO: 52574 - RNA, 18 nt, Artificial Sequence
  Description of Artificial Sequence: Synthetic oligonucleotide
ccugaagucguaggcacu

SEQ ID NO: 52575 - RNA, 18 nt, Artificial Sequence
  Description of Artificial Sequence: Synthetic oligonucleotide
caagcccugaagucguag

SEQ ID NO: 52576 - RNA, 18 nt, Artificial Sequence
  Description of Artificial Sequence: Synthetic oligonucleotide
aaaugcaagcccugaagu

SEQ ID NO: 52577 - RNA, 18 nt, Artificial Sequence
  Description of Artificial Sequence: Synthetic oligonucleotide
aacuaaaaugcaagcccu

SEQ ID NO: 52578 - RNA, 18 nt, Artificial Sequence
  Description of Artificial Sequence: Synthetic oligonucleotide
gauugaacuaaaaugcaa

SEQ ID NO: 52579 - RNA, 18 nt, Artificial Sequence
  Description of Artificial Sequence: Synthetic oligonucleotide
ggagagauugaacuaaaa

SEQ ID NO: 52580 - RNA, 18 nt, Artificial Sequence
  Description of Artificial Sequence: Synthetic oligonucleotide
gagcuggagagauugaac

SEQ ID NO: 52581 - RNA, 18 nt, Artificial Sequence
  Description of Artificial Sequence: Synthetic oligonucleotide
gcccagagcuggagagau

SEQ ID NO: 52582 - RNA, 18 nt, Artificial Sequence
  Description of Artificial Sequence: Synthetic oligonucleotide
ggauggcccagagcugga

SEQ ID NO: 52583 - RNA, 18 nt, Artificial Sequence
  Description of Artificial Sequence: Synthetic oligonucleotide
gagagggauggcccagag

SEQ ID NO: 52584 - RNA, 18 nt, Artificial Sequence
  Description of Artificial Sequence: Synthetic oligonucleotide
aagccgagagggauggcc

SEQ ID NO: 52585 - RNA, 18 nt, Artificial Sequence
  Description of Artificial Sequence: Synthetic oligonucleotide
auuagaagccgagaggga

SEQ ID NO: 52586 - RNA, 18 nt, Artificial Sequence
  Description of Artificial Sequence: Synthetic oligonucleotide
ugcccauuagaagccgag

SEQ ID NO: 52587 - RNA, 18 nt, Artificial Sequence
  Description of Artificial Sequence: Synthetic oligonucleotide
cugcuugcccauuagaag

SEQ ID NO: 52588 - RNA, 18 nt, Artificial Sequence
  Description of Artificial Sequence: Synthetic oligonucleotide
gagagauugaacuaaaau

SEQ ID NO: 52589 - RNA, 18 nt, Artificial Sequence
  Description of Artificial Sequence: Synthetic oligonucleotide
agcuggagagauugaacu

SEQ ID NO: 52590 - RNA, 18 nt, Artificial Sequence
  Description of Artificial Sequence: Synthetic oligonucleotide
cccagagcuggagagauu

SEQ ID NO: 52591 - RNA, 18 nt, Artificial Sequence
  Description of Artificial Sequence: Synthetic oligonucleotide
gauggcccagagcuggag

SEQ ID NO: 52592 - RNA, 18 nt, Artificial Sequence
  Description of Artificial Sequence: Synthetic oligonucleotide
agagggauggcccagagc

SEQ ID NO: 52593 - RNA, 18 nt, Artificial Sequence
  Description of Artificial Sequence: Synthetic oligonucleotide
agccgagagggauggccc

SEQ ID NO: 52594 - RNA, 18 nt, Artificial Sequence
  Description of Artificial Sequence: Synthetic oligonucleotide
uuagaagccgagagggau

SEQ ID NO: 52595 - RNA, 18 nt, Artificial Sequence
  Description of Artificial Sequence: Synthetic oligonucleotide
gcccauuagaagccgaga

SEQ ID NO: 52596 - RNA, 18 nt, Artificial Sequence
  Description of Artificial Sequence: Synthetic oligonucleotide
ugcuugcccauuagaagc

SEQ ID NO: 52597 - RNA, 18 nt, Artificial Sequence
  Description of Artificial Sequence: Synthetic oligonucleotide
agaucugcuugcccauua

SEQ ID NO: 52598 - RNA, 18 nt, Artificial Sequence
  Description of Artificial Sequence: Synthetic oligonucleotide
cugaaagaucugcuugcc

SEQ ID NO: 52599 - RNA, 18 nt, Artificial Sequence
  Description of Artificial Sequence: Synthetic oligonucleotide
uuuuccugaaagaucugc

SEQ ID NO: 52600 - RNA, 18 nt, Artificial Sequence
  Description of Artificial Sequence: Synthetic oligonucleotide
ccugguuuuccugaaaga

SEQ ID NO: 52601 - RNA, 18 nt, Artificial Sequence
  Description of Artificial Sequence: Synthetic oligonucleotide
cuccuccugguuuuccug

SEQ ID NO: 52602 - RNA, 18 nt, Artificial Sequence
  Description of Artificial Sequence: Synthetic oligonucleotide
ugccucuccuccugguuu

SEQ ID NO: 52603 - RNA, 18 nt, Artificial Sequence
  Description of Artificial Sequence: Synthetic oligonucleotide
ccucaugccucuccuccu

SEQ ID NO: 52604 - RNA, 18 nt, Artificial Sequence
  Description of Artificial Sequence: Synthetic oligonucleotide
acccuccucaugccucuc

SEQ ID NO: 52605 - RNA, 18 nt, Artificial Sequence
  Description of Artificial Sequence: Synthetic oligonucleotide
cucaaacccuccucaugc

SEQ ID NO: 52606 - RNA, 18 nt, Artificial Sequence
  Description of Artificial Sequence: Synthetic oligonucleotide
agggccucaaacccuccu

SEQ ID NO: 52607 - RNA, 18 nt, Artificial Sequence
  Description of Artificial Sequence: Synthetic oligonucleotide
ggcugagggccucaaacc

SEQ ID NO: 52608 - RNA, 18 nt, Artificial Sequence
  Description of Artificial Sequence: Synthetic oligonucleotide
agacuggcugagggccuc

SEQ ID NO: 52609 - RNA, 18 nt, Artificial Sequence
  Description of Artificial Sequence: Synthetic oligonucleotide
cacacagacuggcugagg

SEQ ID NO: 52610 - RNA, 18 nt, Artificial Sequence
  Description of Artificial Sequence: Synthetic oligonucleotide
cccagcacacagacuggc

SEQ ID NO: 52611 - RNA, 18 nt, Artificial Sequence
  Description of Artificial Sequence: Synthetic oligonucleotide
uccaccccagcacacaga

SEQ ID NO: 52612 - RNA, 18 nt, Artificial Sequence
  Description of Artificial Sequence: Synthetic oligonucleotide
guugcuccaccccagcac

SEQ ID NO: 52613 - RNA, 18 nt, Artificial Sequence
  Description of Artificial Sequence: Synthetic oligonucleotide
ucugaguugcuccacccc

SEQ ID NO: 52614 - RNA, 18 nt, Artificial Sequence
  Description of Artificial Sequence: Synthetic oligonucleotide
acucuucugaguugcucc

SEQ ID NO: 52615 - RNA, 18 nt, Artificial Sequence
  Description of Artificial Sequence: Synthetic oligonucleotide
gccugacucuucugaguu

SEQ ID NO: 52616 - RNA, 18 nt, Artificial Sequence
  Description of Artificial Sequence: Synthetic oligonucleotide
guguggccugacucuucu

SEQ ID NO: 52617 - RNA, 18 nt, Artificial Sequence
  Description of Artificial Sequence: Synthetic oligonucleotide
aagugguguggccugacu

SEQ ID NO: 52618 - RNA, 18 nt, Artificial Sequence
  Description of Artificial Sequence: Synthetic oligonucleotide
uauucaagugguguggcc

SEQ ID NO: 52619 - RNA, 18 nt, Artificial Sequence
  Description of Artificial Sequence: Synthetic oligonucleotide
gaguguauucaaguggug

SEQ ID NO: 52620 - RNA, 18 nt, Artificial Sequence
  Description of Artificial Sequence: Synthetic oligonucleotide
aaguugaguguauucaag

SEQ ID NO: 52621 - RNA, 18 nt, Artificial Sequence
  Description of Artificial Sequence: Synthetic oligonucleotide
guccuaaguugaguguau

SEQ ID NO: 52622 - RNA, 18 nt, Artificial Sequence
  Description of Artificial Sequence: Synthetic oligonucleotide
ugaguguccuaaguugag

SEQ ID NO: 52623 - RNA, 18 nt, Artificial Sequence
  Description of Artificial Sequence: Synthetic oligonucleotide
ccucaugaguguccuaag

SEQ ID NO: 52624 - RNA, 18 nt, Artificial Sequence
  Description of Artificial Sequence: Synthetic oligonucleotide
acaugccucaugaguguc

SEQ ID NO: 52625 - RNA, 18 nt, Artificial Sequence
  Description of Artificial Sequence: Synthetic oligonucleotide
cagagacaugccucauga

SEQ ID NO: 52626 - RNA, 18 nt, Artificial Sequence
  Description of Artificial Sequence: Synthetic oligonucleotide
agccucagagacaugccu

SEQ ID NO: 52627 - RNA, 18 nt, Artificial Sequence
  Description of Artificial Sequence: Synthetic oligonucleotide
ugggcagccucagagaca

SEQ ID NO: 52628 - RNA, 18 nt, Artificial Sequence
  Description of Artificial Sequence: Synthetic oligonucleotide
gaaguugggcagccucag

SEQ ID NO: 52629 - RNA, 18 nt, Artificial Sequence
  Description of Artificial Sequence: Synthetic oligonucleotide
cauuggaaguugggcagc

SEQ ID NO: 52630 - RNA, 18 nt, Artificial Sequence
  Description of Artificial Sequence: Synthetic oligonucleotide
agagccauuggaaguugg

SEQ ID NO: 52631 - RNA, 18 nt, Artificial Sequence
  Description of Artificial Sequence: Synthetic oligonucleotide
cgcccagagccauuggaa

SEQ ID NO: 52632 - RNA, 18 nt, Artificial Sequence
  Description of Artificial Sequence: Synthetic oligonucleotide
aggaacgcccagagccau

SEQ ID NO: 52633 - RNA, 18 nt, Artificial Sequence
  Description of Artificial Sequence: Synthetic oligonucleotide
cauuuaggaacgcccaga

SEQ ID NO: 52634 - RNA, 18 nt, Artificial Sequence
  Description of Artificial Sequence: Synthetic oligonucleotide
ugggacauuuaggaacgc

SEQ ID NO: 52635 - RNA, 18 nt, Artificial Sequence
  Description of Artificial Sequence: Synthetic oligonucleotide
gcagcugggacauuuagg

SEQ ID NO: 52636 - RNA, 18 nt, Artificial Sequence
  Description of Artificial Sequence: Synthetic oligonucleotide
gagcugcagcugggacau

SEQ ID NO: 52637 - RNA, 18 nt, Artificial Sequence
  Description of Artificial Sequence: Synthetic oligonucleotide
auccagagcugcagcugg

SEQ ID NO: 52638 - RNA, 18 nt, Artificial Sequence
  Description of Artificial Sequence: Synthetic oligonucleotide
guuccauccagagcugca

SEQ ID NO: 52639 - RNA, 18 nt, Artificial Sequence
  Description of Artificial Sequence: Synthetic oligonucleotide
acuggguuccauccagag

SEQ ID NO: 52640 - RNA, 18 nt, Artificial Sequence
  Description of Artificial Sequence: Synthetic oligonucleotide
gagacacuggguuccauc

SEQ ID NO: 52641 - RNA, 18 nt, Artificial Sequence
  Description of Artificial Sequence: Synthetic oligonucleotide
caucugagacacuggguu

SEQ ID NO: 52642 - RNA, 18 nt, Artificial Sequence
  Description of Artificial Sequence: Synthetic oligonucleotide
ccuaucaucugagacacu

SEQ ID NO: 52643 - RNA, 18 nt, Artificial Sequence
  Description of Artificial Sequence: Synthetic oligonucleotide
agcugccuaucaucugag

SEQ ID NO: 52644 - RNA, 18 nt, Artificial Sequence
  Description of Artificial Sequence: Synthetic oligonucleotide
ggcucagcugccuaucau

SEQ ID NO: 52645 - RNA, 18 nt, Artificial Sequence
  Description of Artificial Sequence: Synthetic oligonucleotide
cauccggcucagcugccu

SEQ ID NO: 52646 - RNA, 18 nt, Artificial Sequence
  Description of Artificial Sequence: Synthetic oligonucleotide
ggcaccauccggcucagc

SEQ ID NO: 52647 - RNA, 18 nt, Artificial Sequence
  Description of Artificial Sequence: Synthetic oligonucleotide
gauuuggcaccauccggc

SEQ ID NO: 52648 - RNA, 18 nt, Artificial Sequence
  Description of Artificial Sequence: Synthetic oligonucleotide
ucugggauuuggcaccau

SEQ ID NO: 52649 - RNA, 18 nt, Artificial Sequence
  Description of Artificial Sequence: Synthetic oligonucleotide
agagcucugggauuuggc

SEQ ID NO: 52650 - RNA, 18 nt, Artificial Sequence
  Description of Artificial Sequence: Synthetic oligonucleotide
ggcucagagcucugggau

SEQ ID NO: 52651 - RNA, 18 nt, Artificial Sequence
  Description of Artificial Sequence: Synthetic oligonucleotide
ccagaggcucagagcucu

SEQ ID NO: 52652 - RNA, 18 nt, Artificial Sequence
  Description of Artificial Sequence: Synthetic oligonucleotide
aucagccagaggcucaga

SEQ ID NO: 52653 - RNA, 18 nt, Artificial Sequence
  Description of Artificial Sequence: Synthetic oligonucleotide
cugacaucagccagaggc

SEQ ID NO: 52654 - RNA, 18 nt, Artificial Sequence
  Description of Artificial Sequence: Synthetic oligonucleotide
cucuccugacaucagcca

SEQ ID NO: 52655 - RNA, 18 nt, Artificial Sequence
  Description of Artificial Sequence: Synthetic oligonucleotide
gaaugcucuccugacauc

SEQ ID NO: 52656 - RNA, 18 nt, Artificial Sequence
  Description of Artificial Sequence: Synthetic oligonucleotide
cccgagaaugcucuccug

SEQ ID NO: 52657 - RNA, 18 nt, Artificial Sequence
  Description of Artificial Sequence: Synthetic oligonucleotide
ugggacccgagaaugcuc

SEQ ID NO: 52658 - RNA, 18 nt, Artificial Sequence
  Description of Artificial Sequence: Synthetic oligonucleotide
uguccugggacccgagaa

SEQ ID NO: 52659 - RNA, 18 nt, Artificial Sequence
  Description of Artificial Sequence: Synthetic oligonucleotide
agugcuguccugggaccc

SEQ ID NO: 52660 - RNA, 18 nt, Artificial Sequence
  Description of Artificial Sequence: Synthetic oligonucleotide
auggaagugcuguccugg

SEQ ID NO: 52661 - RNA, 18 nt, Artificial Sequence
  Description of Artificial Sequence: Synthetic oligonucleotide
aaggaauggaagugcugu

SEQ ID NO: 52662 - RNA, 18 nt, Artificial Sequence
  Description of Artificial Sequence: Synthetic oligonucleotide
cacccaaggaauggaagu

SEQ ID NO: 52663 - RNA, 18 nt, Artificial Sequence
  Description of Artificial Sequence: Synthetic oligonucleotide
ucaggcacccaaggaaug

SEQ ID NO: 52664 - RNA, 18 nt, Artificial Sequence
  Description of Artificial Sequence: Synthetic oligonucleotide
ccaucucaggcacccaag

SEQ ID NO: 52665 - RNA, 18 nt, Artificial Sequence
  Description of Artificial Sequence: Synthetic oligonucleotide
ugccaccaucucaggcac

SEQ ID NO: 52666 - RNA, 18 nt, Artificial Sequence
  Description of Artificial Sequence: Synthetic oligonucleotide
gccucugccaccaucuca

SEQ ID NO: 52667 - RNA, 18 nt, Artificial Sequence
  Description of Artificial Sequence: Synthetic oligonucleotide
cuggagccucugccacca

SEQ ID NO: 52668 - RNA, 18 nt, Artificial Sequence
  Description of Artificial Sequence: Synthetic oligonucleotide
ucagucuggagccucugc

SEQ ID NO: 52669 - RNA, 18 nt, Artificial Sequence
  Description of Artificial Sequence: Synthetic oligonucleotide
cuggcucagucuggagcc

SEQ ID NO: 52670 - RNA, 18 nt, Artificial Sequence
  Description of Artificial Sequence: Synthetic oligonucleotide
cuucucuggcucagucug

SEQ ID NO: 52671 - RNA, 18 nt, Artificial Sequence
  Description of Artificial Sequence: Synthetic oligonucleotide
cacagcuucucuggcuca

SEQ ID NO: 52672 - RNA, 18 nt, Artificial Sequence
  Description of Artificial Sequence: Synthetic oligonucleotide
agacacacagcuucucug

SEQ ID NO: 52673 - RNA, 18 nt, Artificial Sequence
  Description of Artificial Sequence: Synthetic oligonucleotide
auggcagacacacagcuu

SEQ ID NO: 52674 - RNA, 18 nt, Artificial Sequence
  Description of Artificial Sequence: Synthetic oligonucleotide
cuguuauggcagacacac

SEQ ID NO: 52675 - RNA, 18 nt, Artificial Sequence
  Description of Artificial Sequence: Synthetic oligonucleotide
ggugccuguuauggcaga

SEQ ID NO: 52676 - RNA, 18 nt, Artificial Sequence
  Description of Artificial Sequence: Synthetic oligonucleotide
ccucuuccagcaggauca

SEQ ID NO: 52677 - RNA, 18 nt, Artificial Sequence
  Description of Artificial Sequence: Synthetic oligonucleotide
ccacgccucuuccagcag

SEQ ID NO: 52678 - RNA, 18 nt, Artificial Sequence
  Description of Artificial Sequence: Synthetic oligonucleotide
ucacuccacgccucuucc

SEQ ID NO: 52679 - RNA, 18 nt, Artificial Sequence
  Description of Artificial Sequence: Synthetic oligonucleotide
agaguucacuccacgccu

SEQ ID NO: 52680 - RNA, 18 nt, Artificial Sequence
  Description of Artificial Sequence: Synthetic oligonucleotide
gagaaagaguucacucca

SEQ ID NO: 52681 - RNA, 18 nt, Artificial Sequence
  Description of Artificial Sequence: Synthetic oligonucleotide
ccgaggagaaagaguuca

SEQ ID NO: 52682 - RNA, 18 nt, Artificial Sequence
  Description of Artificial Sequence: Synthetic oligonucleotide
uggccccgaggagaaaga

SEQ ID NO: 52683 - RNA, 18 nt, Artificial Sequence
  Description of Artificial Sequence: Synthetic oligonucleotide
cuggauggccccgaggag

SEQ ID NO: 52684 - RNA, 18 nt, Artificial Sequence
  Description of Artificial Sequence: Synthetic oligonucleotide
gaccacuggauggccccg

SEQ ID NO: 52685 - RNA, 18 nt, Artificial Sequence
  Description of Artificial Sequence: Synthetic oligonucleotide
gcagagaccacuggaugg

SEQ ID NO: 52686 - RNA, 18 nt, Artificial Sequence
  Description of Artificial Sequence: Synthetic oligonucleotide
cagaggcagagaccacug

SEQ ID NO: 52687 - RNA, 18 nt, Artificial Sequence
  Description of Artificial Sequence: Synthetic oligonucleotide
cuguccagaggcagagac

SEQ ID NO: 52688 - RNA, 18 nt, Artificial Sequence
  Description of Artificial Sequence: Synthetic oligonucleotide
gacagcuguccagaggca

SEQ ID NO: 52689 - RNA, 18 nt, Artificial Sequence
  Description of Artificial Sequence: Synthetic oligonucleotide
cagaggacagcuguccag

SEQ ID NO: 52690 - RNA, 18 nt, Artificial Sequence
  Description of Artificial Sequence: Synthetic oligonucleotide
gccagcagaggacagcug

SEQ ID NO: 52691 - RNA, 18 nt, Artificial Sequence
  Description of Artificial Sequence: Synthetic oligonucleotide
gcggugccagcagaggac

SEQ ID NO: 52692 - RNA, 18 nt, Artificial Sequence
  Description of Artificial Sequence: Synthetic oligonucleotide
cucgggcggugccagcag

SEQ ID NO: 52693 - RNA, 18 nt, Artificial Sequence
  Description of Artificial Sequence: Synthetic oligonucleotide
gaggccucgggcggugcc

SEQ ID NO: 52694 - RNA, 18 nt, Artificial Sequence
  Description of Artificial Sequence: Synthetic oligonucleotide
cagcagaggccucgggcg

SEQ ID NO: 52695 - RNA, 18 nt, Artificial Sequence
  Description of Artificial Sequence: Synthetic oligonucleotide
accggcagcagaggccuc

SEQ ID NO: 52696 - RNA, 18 nt, Artificial Sequence
  Description of Artificial Sequence: Synthetic oligonucleotide
gcaccaccggcagcagag

SEQ ID NO: 52697 - RNA, 18 nt, Artificial Sequence
  Description of Artificial Sequence: Synthetic oligonucleotide
ccugggcaccaccggcag

SEQ ID NO: 52698 - RNA, 18 nt, Artificial Sequence
  Description of Artificial Sequence: Synthetic oligonucleotide
ccggcccugggcaccacc

SEQ ID NO: 52699 - RNA, 18 nt, Artificial Sequence
  Description of Artificial Sequence: Synthetic oligonucleotide
gugagccggcccugggca

SEQ ID NO: 52700 - RNA, 18 nt, Artificial Sequence
  Description of Artificial Sequence: Synthetic oligonucleotide
ccagcgugagccggcccu

SEQ ID NO: 52701 - RNA, 18 nt, Artificial Sequence
  Description of Artificial Sequence: Synthetic oligonucleotide
gcuggccagcgugagccg

SEQ ID NO: 52702 - RNA, 18 nt, Artificial Sequence
  Description of Artificial Sequence: Synthetic oligonucleotide
uccaugcuggccagcgug

SEQ ID NO: 52703 - RNA, 18 nt, Artificial Sequence
  Description of Artificial Sequence: Synthetic oligonucleotide
gcgucuccaugcuggcca

SEQ ID NO: 52704 - RNA, 18 nt, Artificial Sequence
  Description of Artificial Sequence: Synthetic oligonucleotide
gacacgcgucuccaugcu

SEQ ID NO: 52705 - RNA, 18 nt, Artificial Sequence
  Description of Artificial Sequence: Synthetic oligonucleotide
ugcaggacacgcgucucc

SEQ ID NO: 52706 - RNA, 18 nt, Artificial Sequence
  Description of Artificial Sequence: Synthetic oligonucleotide
uuuccugcaggacacgcg

SEQ ID NO: 52707 - RNA, 18 nt, Artificial Sequence
  Description of Artificial Sequence: Synthetic oligonucleotide
gauaguuuccugcaggac

SEQ ID NO: 52708 - RNA, 18 nt, Artificial Sequence
  Description of Artificial Sequence: Synthetic oligonucleotide
cgagagauaguuuccugc

SEQ ID NO: 52709 - RNA, 18 nt, Artificial Sequence
  Description of Artificial Sequence: Synthetic oligonucleotide
ggaaccgagagauaguuu

SEQ ID NO: 52710 - RNA, 18 nt, Artificial Sequence
  Description of Artificial Sequence: Synthetic oligonucleotide
ugcccggaaccgagagau

SEQ ID NO: 52711 - RNA, 18 nt, Artificial Sequence
  Description of Artificial Sequence: Synthetic oligonucleotide
gccaaugcccggaaccga

SEQ ID NO: 52712 - RNA, 18 nt, Artificial Sequence
  Description of Artificial Sequence: Synthetic oligonucleotide
ccaccgccaaugcccgga

SEQ ID NO: 52713 - RNA, 18 nt, Artificial Sequence
  Description of Artificial Sequence: Synthetic oligonucleotide
acgccucuuccagcagga

SEQ ID NO: 52714 - RNA, 18 nt, Artificial Sequence
  Description of Artificial Sequence: Synthetic oligonucleotide
acuccacgccucuuccag

SEQ ID NO: 52715 - RNA, 18 nt, Artificial Sequence
  Description of Artificial Sequence: Synthetic oligonucleotide
aguucacuccacgccucu

SEQ ID NO: 52716 - RNA, 18 nt, Artificial Sequence
  Description of Artificial Sequence: Synthetic oligonucleotide
gaaagaguucacuccacg

SEQ ID NO: 52717 - RNA, 18 nt, Artificial Sequence
  Description of Artificial Sequence: Synthetic oligonucleotide
gaggagaaagaguucacu

SEQ ID NO: 52718 - RNA, 18 nt, Artificial Sequence
  Description of Artificial Sequence: Synthetic oligonucleotide
gccccgaggagaaagagu

SEQ ID NO: 52719 - RNA, 18 nt, Artificial Sequence
  Description of Artificial Sequence: Synthetic oligonucleotide
ggauggccccgaggagaa

SEQ ID NO: 52720 - RNA, 18 nt, Artificial Sequence
  Description of Artificial Sequence: Synthetic oligonucleotide
ccacuggauggccccgag

SEQ ID NO: 52721 - RNA, 18 nt, Artificial Sequence
  Description of Artificial Sequence: Synthetic oligonucleotide
agagaccacuggauggcc

SEQ ID NO: 52722 - RNA, 18 nt, Artificial Sequence
  Description of Artificial Sequence: Synthetic oligonucleotide
gaggcagagaccacugga

SEQ ID NO: 52723 - RNA, 18 nt, Artificial Sequence
  Description of Artificial Sequence: Synthetic oligonucleotide
guccagaggcagagacca

SEQ ID NO: 52724 - RNA, 18 nt, Artificial Sequence
  Description of Artificial Sequence: Synthetic oligonucleotide
cagcuguccagaggcaga

SEQ ID NO: 52725 - RNA, 18 nt, Artificial Sequence
  Description of Artificial Sequence: Synthetic oligonucleotide
gaggacagcuguccagag

SEQ ID NO: 52726 - RNA, 18 nt, Artificial Sequence
  Description of Artificial Sequence: Synthetic oligonucleotide
cagcagaggacagcuguc

SEQ ID NO: 52727 - RNA, 18 nt, Artificial Sequence
  Description of Artificial Sequence: Synthetic oligonucleotide
ggugccagcagaggacag

SEQ ID NO: 52728 - RNA, 18 nt, Artificial Sequence
  Description of Artificial Sequence: Synthetic oligonucleotide
cgggcggugccagcagag

SEQ ID NO: 52729 - RNA, 18 nt, Artificial Sequence
  Description of Artificial Sequence: Synthetic oligonucleotide
ggccucgggcggugccag

SEQ ID NO: 52730 - RNA, 18 nt, Artificial Sequence
  Description of Artificial Sequence: Synthetic oligonucleotide
gcagaggccucgggcggu

SEQ ID NO: 52731 - RNA, 18 nt, Artificial Sequence
  Description of Artificial Sequence: Synthetic oligonucleotide
cggcagcagaggccucgg

SEQ ID NO: 52732 - RNA, 18 nt, Artificial Sequence
  Description of Artificial Sequence: Synthetic oligonucleotide
accaccggcagcagaggc

SEQ ID NO: 52733 - RNA, 18 nt, Artificial Sequence
  Description of Artificial Sequence: Synthetic oligonucleotide
ugggcaccaccggcagca

SEQ ID NO: 52734 - RNA, 18 nt, Artificial Sequence
  Description of Artificial Sequence: Synthetic oligonucleotide
ggcccugggcaccaccgg

SEQ ID NO: 52735 - RNA, 18 nt, Artificial Sequence
  Description of Artificial Sequence: Synthetic oligonucleotide
gagccggcccugggcacc

SEQ ID NO: 52736 - RNA, 18 nt, Artificial Sequence
  Description of Artificial Sequence: Synthetic oligonucleotide
agcgugagccggcccugg

SEQ ID NO: 52737 - RNA, 18 nt, Artificial Sequence
  Description of Artificial Sequence: Synthetic oligonucleotide
uggccagcgugagccggc

SEQ ID NO: 52738 - RNA, 18 nt, Artificial Sequence
  Description of Artificial Sequence: Synthetic oligonucleotide
caugcuggccagcgugag

SEQ ID NO: 52739 - RNA, 18 nt, Artificial Sequence
  Description of Artificial Sequence: Synthetic oligonucleotide
gucuccaugcuggccagc

SEQ ID NO: 52740 - RNA, 18 nt, Artificial Sequence
  Description of Artificial Sequence: Synthetic oligonucleotide
cacgcgucuccaugcugg

SEQ ID NO: 52741 - RNA, 18 nt, Artificial Sequence
  Description of Artificial Sequence: Synthetic oligonucleotide
caggacacgcgucuccau

SEQ ID NO: 52742 - RNA, 18 nt, Artificial Sequence
  Description of Artificial Sequence: Synthetic oligonucleotide
uccugcaggacacgcguc

SEQ ID NO: 52743 - RNA, 18 nt, Artificial Sequence
  Description of Artificial Sequence: Synthetic oligonucleotide
uaguuuccugcaggacac

SEQ ID NO: 52744 - RNA, 18 nt, Artificial Sequence
  Description of Artificial Sequence: Synthetic oligonucleotide
agagauaguuuccugcag

SEQ ID NO: 52745 - RNA, 18 nt, Artificial Sequence
  Description of Artificial Sequence: Synthetic oligonucleotide
aaccgagagauaguuucc

SEQ ID NO: 52746 - RNA, 18 nt, Artificial Sequence
  Description of Artificial Sequence: Synthetic oligonucleotide
cccggaaccgagagauag

SEQ ID NO: 52747 - RNA, 18 nt, Artificial Sequence
  Description of Artificial Sequence: Synthetic oligonucleotide
caaugcccggaaccgaga

SEQ ID NO: 52748 - RNA, 18 nt, Artificial Sequence
  Description of Artificial Sequence: Synthetic oligonucleotide
accgccaaugcccggaac

SEQ ID NO: 52749 - RNA, 18 nt, Artificial Sequence
  Description of Artificial Sequence: Synthetic oligonucleotide
gcaggcaaacuccguggg

SEQ ID NO: 52750 - RNA, 18 nt, Artificial Sequence
  Description of Artificial Sequence: Synthetic oligonucleotide
uucaugcaggcaaacucc

SEQ ID NO: 52751 - RNA, 18 nt, Artificial Sequence
  Description of Artificial Sequence: Synthetic oligonucleotide
aggccuucaugcaggcaa

SEQ ID NO: 52752 - RNA, 18 nt, Artificial Sequence
  Description of Artificial Sequence: Synthetic oligonucleotide
gaccaaggccuucaugca

SEQ ID NO: 52753 - RNA, 18 nt, Artificial Sequence
  Description of Artificial Sequence: Synthetic oligonucleotide
aagaggaccaaggccuuc

SEQ ID NO: 52754 - RNA, 18 nt, Artificial Sequence
  Description of Artificial Sequence: Synthetic oligonucleotide
gcuugaagaggaccaagg

SEQ ID NO: 52755 - RNA, 18 nt, Artificial Sequence
  Description of Artificial Sequence: Synthetic oligonucleotide
gcaggcaaacuccguggg

SEQ ID NO: 52756 - RNA, 18 nt, Artificial Sequence
  Description of Artificial Sequence: Synthetic oligonucleotide
uucaugcaggcaaacucc

SEQ ID NO: 52757 - RNA, 18 nt, Artificial Sequence
  Description of Artificial Sequence: Synthetic oligonucleotide
aggccuucaugcaggcaa

SEQ ID NO: 52758 - RNA, 18 nt, Artificial Sequence
  Description of Artificial Sequence: Synthetic oligonucleotide
gaccaaggccuucaugca

SEQ ID NO: 52759 - RNA, 18 nt, Artificial Sequence
  Description of Artificial Sequence: Synthetic oligonucleotide
aagaggaccaaggccuuc

SEQ ID NO: 52760 - RNA, 18 nt, Artificial Sequence
  Description of Artificial Sequence: Synthetic oligonucleotide
gcuugaagaggaccaagg

SEQ ID NO: 52761 - RNA, 18 nt, Artificial Sequence
  Description of Artificial Sequence: Synthetic oligonucleotide
gguuugggcagagacuca

SEQ ID NO: 52762 - RNA, 18 nt, Artificial Sequence
  Description of Artificial Sequence: Synthetic oligonucleotide
cucaagguuugggcagag

SEQ ID NO: 52763 - RNA, 18 nt, Artificial Sequence
  Description of Artificial Sequence: Synthetic oligonucleotide
ucccacucaagguuuggg

SEQ ID NO: 52764 - RNA, 18 nt, Artificial Sequence
  Description of Artificial Sequence: Synthetic oligonucleotide
agaauucccacucaaggu

SEQ ID NO: 52765 - RNA, 18 nt, Artificial Sequence
  Description of Artificial Sequence: Synthetic oligonucleotide
ucaccagaauucccacuc

SEQ ID NO: 52766 - RNA, 18 nt, Artificial Sequence
  Description of Artificial Sequence: Synthetic oligonucleotide
ggaagucaccagaauucc

SEQ ID NO: 52767 - RNA, 18 nt, Artificial Sequence
  Description of Artificial Sequence: Synthetic oligonucleotide
cagauggaagucaccaga

SEQ ID NO: 52768 - RNA, 18 nt, Artificial Sequence
  Description of Artificial Sequence: Synthetic oligonucleotide
agaggcagauggaaguca

SEQ ID NO: 52769 - RNA, 18 nt, Artificial Sequence
  Description of Artificial Sequence: Synthetic oligonucleotide
gagugagaggcagaugga

SEQ ID NO: 52770 - RNA, 18 nt, Artificial Sequence
  Description of Artificial Sequence: Synthetic oligonucleotide
agggagagugagaggcag

SEQ ID NO: 52771 - RNA, 18 nt, Artificial Sequence
  Description of Artificial Sequence: Synthetic oligonucleotide
aguggagggagagugaga

SEQ ID NO: 52772 - RNA, 18 nt, Artificial Sequence
  Description of Artificial Sequence: Synthetic oligonucleotide
ggguaguggagggagagu

SEQ ID NO: 52773 - RNA, 18 nt, Artificial Sequence
  Description of Artificial Sequence: Synthetic oligonucleotide
cacaucugcacacauggg

SEQ ID NO: 52774 - RNA, 18 nt, Artificial Sequence
  Description of Artificial Sequence: Synthetic oligonucleotide
cuacacacaucugcacac

SEQ ID NO: 52775 - RNA, 18 nt, Artificial Sequence
  Description of Artificial Sequence: Synthetic oligonucleotide
gaggccuacacacaucug

SEQ ID NO: 52776 - RNA, 18 nt, Artificial Sequence
  Description of Artificial Sequence: Synthetic oligonucleotide
ggauagaggccuacacac

SEQ ID NO: 52777 - RNA, 18 nt, Artificial Sequence
  Description of Artificial Sequence: Synthetic oligonucleotide
ccccaggauagaggccua

SEQ ID NO: 52778 - RNA, 18 nt, Artificial Sequence
  Description of Artificial Sequence: Synthetic oligonucleotide
ccaccccccaggauagag

SEQ ID NO: 52779 - RNA, 18 nt, Artificial Sequence
  Description of Artificial Sequence: Synthetic oligonucleotide
uccucccaccccccagga

SEQ ID NO: 52780 - RNA, 18 nt, Artificial Sequence
  Description of Artificial Sequence: Synthetic oligonucleotide
cacucuccucccaccccc

SEQ ID NO: 52781 - RNA, 18 nt, Artificial Sequence
  Description of Artificial Sequence: Synthetic oligonucleotide
cucaccacucuccuccca

SEQ ID NO: 52782 - RNA, 18 nt, Artificial Sequence
  Description of Artificial Sequence: Synthetic oligonucleotide
ccagccucaccacucucc

SEQ ID NO: 52783 - RNA, 18 nt, Artificial Sequence
  Description of Artificial Sequence: Synthetic oligonucleotide
ggaguccagccucaccac

SEQ ID NO: 52784 - RNA, 18 nt, Artificial Sequence
  Description of Artificial Sequence: Synthetic oligonucleotide
agaagggaguccagccuc

SEQ ID NO: 52785 - RNA, 18 nt, Artificial Sequence
  Description of Artificial Sequence: Synthetic oligonucleotide
caaggagaagggagucca

SEQ ID NO: 52786 - RNA, 18 nt, Artificial Sequence
  Description of Artificial Sequence: Synthetic oligonucleotide
ggccccaaggagaaggga

SEQ ID NO: 52787 - RNA, 18 nt, Artificial Sequence
  Description of Artificial Sequence: Synthetic oligonucleotide
ggaguggccccaaggaga

SEQ ID NO: 52788 - RNA, 18 nt, Artificial Sequence
  Description of Artificial Sequence: Synthetic oligonucleotide
aaccaggaguggccccaa

SEQ ID NO: 52789 - RNA, 18 nt, Artificial Sequence
  Description of Artificial Sequence: Synthetic oligonucleotide
cagucaaccaggaguggc

SEQ ID NO: 52790 - RNA, 18 nt, Artificial Sequence
  Description of Artificial Sequence: Synthetic oligonucleotide
ccucacagucaaccagga

SEQ ID NO: 52791 - RNA, 18 nt, Artificial Sequence
  Description of Artificial Sequence: Synthetic oligonucleotide
uguccccucacagucaac

SEQ ID NO: 52792 - RNA, 18 nt, Artificial Sequence
  Description of Artificial Sequence: Synthetic oligonucleotide
ugcccuguccccucacag

SEQ ID NO: 52793 - RNA, 18 nt, Artificial Sequence
  Description of Artificial Sequence: Synthetic oligonucleotide
cagccugcccuguccccu

SEQ ID NO: 52794 - RNA, 18 nt, Artificial Sequence
  Description of Artificial Sequence: Synthetic oligonucleotide
gcucccagccugcccugu

SEQ ID NO: 52795 - RNA, 18 nt, Artificial Sequence
  Description of Artificial Sequence: Synthetic oligonucleotide
gggcucccagccugcccu

SEQ ID NO: 52796 - RNA, 18 nt, Artificial Sequence
  Description of Artificial Sequence: Synthetic oligonucleotide
gcucagggucucccaggg

SEQ ID NO: 52797 - RNA, 18 nt, Artificial Sequence
  Description of Artificial Sequence: Synthetic oligonucleotide
cacagucaaccaggagug

SEQ ID NO: 52798 - RNA, 18 nt, Artificial Sequence
  Description of Artificial Sequence: Synthetic oligonucleotide
ccccucacagucaaccag

SEQ ID NO: 52799 - RNA, 18 nt, Artificial Sequence
  Description of Artificial Sequence: Synthetic oligonucleotide
ccuguccccucacaguca

SEQ ID NO: 52800 - RNA, 18 nt, Artificial Sequence
  Description of Artificial Sequence: Synthetic oligonucleotide
ccugcccuguccccucac

SEQ ID NO: 52801 - RNA, 18 nt, Artificial Sequence
  Description of Artificial Sequence: Synthetic oligonucleotide
cccagccugcccuguccc

SEQ ID NO: 52802 - RNA, 18 nt, Artificial Sequence
  Description of Artificial Sequence: Synthetic oligonucleotide
gggcucccagccugcccu

SEQ ID NO: 52803 - RNA, 18 nt, Artificial Sequence
  Description of Artificial Sequence: Synthetic oligonucleotide
gcucagggucucccaggg

SEQ ID NO: 52804 - RNA, 18 nt, Artificial Sequence
  Description of Artificial Sequence: Synthetic oligonucleotide
gggcucagggucucccag

SEQ ID NO: 52805 - RNA, 18 nt, Artificial Sequence
  Description of Artificial Sequence: Synthetic oligonucleotide
ccagaggagccaccaggg

SEQ ID NO: 52806 - RNA, 18 nt, Artificial Sequence
  Description of Artificial Sequence: Synthetic oligonucleotide
aggcccagaggagccacc

SEQ ID NO: 52807 - RNA, 18 nt, Artificial Sequence
  Description of Artificial Sequence: Synthetic oligonucleotide
cugccaggcccagaggag

SEQ ID NO: 52808 - RNA, 18 nt, Artificial Sequence
  Description of Artificial Sequence: Synthetic oligonucleotide
gggcucugccaggcccag

SEQ ID NO: 52809 - RNA, 18 nt, Artificial Sequence
  Description of Artificial Sequence: Synthetic oligonucleotide
ugcagacauggaccuggg

SEQ ID NO: 52810 - RNA, 18 nt, Artificial Sequence
  Description of Artificial Sequence: Synthetic oligonucleotide
cuggcugcagacauggac

SEQ ID NO: 52811 - RNA, 18 nt, Artificial Sequence
  Description of Artificial Sequence: Synthetic oligonucleotide
ggguucuggcugcagaca

SEQ ID NO: 52812 - RNA, 18 nt, Artificial Sequence
  Description of Artificial Sequence: Synthetic oligonucleotide
gcccaggguucuggcugc

SEQ ID NO: 52813 - RNA, 18 nt, Artificial Sequence
  Description of Artificial Sequence: Synthetic oligonucleotide
ugguggcccaggguucug

SEQ ID NO: 52814 - RNA, 18 nt, Artificial Sequence
  Description of Artificial Sequence: Synthetic oligonucleotide
ugaagugguggcccaggg

SEQ ID NO: 52815 - RNA, 18 nt, Artificial Sequence
  Description of Artificial Sequence: Synthetic oligonucleotide
ggccaugaagugguggcc

SEQ ID NO: 52816 - RNA, 18 nt, Artificial Sequence
  Description of Artificial Sequence: Synthetic oligonucleotide
aggcuggccaugaagugg

SEQ ID NO: 52817 - RNA, 18 nt, Artificial Sequence
  Description of Artificial Sequence: Synthetic oligonucleotide
uuauaaggcuggccauga

SEQ ID NO: 52818 - RNA, 18 nt, Artificial Sequence
  Description of Artificial Sequence: Synthetic oligonucleotide
ggcuguuauaaggcuggc

SEQ ID NO: 52819 - RNA, 18 nt, Artificial Sequence
  Description of Artificial Sequence: Synthetic oligonucleotide
uuuacggcuguuauaagg

SEQ ID NO: 52820 - RNA, 18 nt, Artificial Sequence
  Description of Artificial Sequence: Synthetic oligonucleotide
acagguuuacggcuguua

SEQ ID NO: 52821 - RNA, 18 nt, Artificial Sequence
  Description of Artificial Sequence: Synthetic oligonucleotide
uuagcacagguuuacggc

SEQ ID NO: 52822 - RNA, 18 nt, Artificial Sequence
  Description of Artificial Sequence: Synthetic oligonucleotide
ugagcuuagcacagguuu

SEQ ID NO: 52823 - RNA, 18 nt, Artificial Sequence
  Description of Artificial Sequence: Synthetic oligonucleotide
accagugagcuuagcaca

SEQ ID NO: 52824 - RNA, 18 nt, Artificial Sequence
  Description of Artificial Sequence: Synthetic oligonucleotide
uccuucaggccccgcguc

SEQ ID NO: 52825 - RNA, 18 nt, Artificial Sequence
  Description of Artificial Sequence: Synthetic oligonucleotide
caggauccuucaggcccc

SEQ ID NO: 52826 - RNA, 18 nt, Artificial Sequence
  Description of Artificial Sequence: Synthetic oligonucleotide
gugcucaggauccuucag

SEQ ID NO: 52827 - RNA, 18 nt, Artificial Sequence
  Description of Artificial Sequence: Synthetic oligonucleotide
ucuacgugcucaggaucc

SEQ ID NO: 52828 - RNA, 18 nt, Artificial Sequence
  Description of Artificial Sequence: Synthetic oligonucleotide
aggccucuacgugcucag

SEQ ID NO: 52829 - RNA, 18 nt, Artificial Sequence
  Description of Artificial Sequence: Synthetic oligonucleotide
cugcaaggccucuacgug

SEQ ID NO: 52830 - RNA, 18 nt, Artificial Sequence
  Description of Artificial Sequence: Synthetic oligonucleotide
ugguccugcaaggccucu

SEQ ID NO: 52831 - RNA, 18 nt, Artificial Sequence
  Description of Artificial Sequence: Synthetic oligonucleotide
gggacugguccugcaagg

SEQ ID NO: 52832 - RNA, 18 nt, Artificial Sequence
  Description of Artificial Sequence: Synthetic oligonucleotide
cacuugggacugguccug

SEQ ID NO: 52833 - RNA, 18 nt, Artificial Sequence
  Description of Artificial Sequence: Synthetic oligonucleotide
agcaucacuugggacugg

SEQ ID NO: 52834 - RNA, 18 nt, Artificial Sequence
  Description of Artificial Sequence: Synthetic oligonucleotide
ggcucagcaucacuuggg

SEQ ID NO: 52835 - RNA, 18 nt, Artificial Sequence
  Description of Artificial Sequence: Synthetic oligonucleotide
gugcuggcucagcaucac

SEQ ID NO: 52836 - RNA, 18 nt, Artificial Sequence
  Description of Artificial Sequence: Synthetic oligonucleotide
uugcugugcuggcucagc

SEQ ID NO: 52837 - RNA, 18 nt, Artificial Sequence
  Description of Artificial Sequence: Synthetic oligonucleotide
gggccuugcugugcuggc

SEQ ID NO: 52838 - RNA, 18 nt, Artificial Sequence
  Description of Artificial Sequence: Synthetic oligonucleotide
guggugggccuugcugug

SEQ ID NO: 52839 - RNA, 18 nt, Artificial Sequence
  Description of Artificial Sequence: Synthetic oligonucleotide
ggguggugggccuugcug

SEQ ID NO: 52840 - RNA, 18 nt, Artificial Sequence
  Description of Artificial Sequence: Synthetic oligonucleotide
ccucacgggcuggcuggg

SEQ ID NO: 52841 - RNA, 18 nt, Artificial Sequence
  Description of Artificial Sequence: Synthetic oligonucleotide
ggucaccucacgggcugg

SEQ ID NO: 52842 - RNA, 18 nt, Artificial Sequence
  Description of Artificial Sequence: Synthetic oligonucleotide
gcucaggucaccucacgg

SEQ ID NO: 52843 - RNA, 18 nt, Artificial Sequence
  Description of Artificial Sequence: Synthetic oligonucleotide
cgcaugcucaggucaccu

SEQ ID NO: 52844 - RNA, 18 nt, Artificial Sequence
  Description of Artificial Sequence: Synthetic oligonucleotide
gugggcgcaugcucaggu

SEQ ID NO: 52845 - RNA, 18 nt, Artificial Sequence
  Description of Artificial Sequence: Synthetic oligonucleotide
agugggugggcgcaugcu

SEQ ID NO: 52846 - RNA, 18 nt, Artificial Sequence
  Description of Artificial Sequence: Synthetic oligonucleotide
agaugagugggugggcgc

SEQ ID NO: 52847 - RNA, 18 nt, Artificial Sequence
  Description of Artificial Sequence: Synthetic oligonucleotide
gggacagaugagugggug

SEQ ID NO: 52848 - RNA, 18 nt, Artificial Sequence
  Description of Artificial Sequence: Synthetic oligonucleotide
ggucagggacagaugagu

SEQ ID NO: 52849 - RNA, 18 nt, Artificial Sequence
  Description of Artificial Sequence: Synthetic oligonucleotide
uuagaggucagggacaga

SEQ ID NO: 52850 - RNA, 18 nt, Artificial Sequence
  Description of Artificial Sequence: Synthetic oligonucleotide
aaagguuagaggucaggg

SEQ ID NO: 52851 - RNA, 18 nt, Artificial Sequence
  Description of Artificial Sequence: Synthetic oligonucleotide
cagagaaagguuagaggu

SEQ ID NO: 52852 - RNA, 18 nt, Artificial Sequence
  Description of Artificial Sequence: Synthetic oligonucleotide
agaggcagagaaagguua

SEQ ID NO: 52853 - RNA, 18 nt, Artificial Sequence
  Description of Artificial Sequence: Synthetic oligonucleotide
gugggagaggcagagaaa

SEQ ID NO: 52854 - RNA, 18 nt, Artificial Sequence
  Description of Artificial Sequence: Synthetic oligonucleotide
agagugugggagaggcag

SEQ ID NO: 52855 - RNA, 18 nt, Artificial Sequence
  Description of Artificial Sequence: Synthetic oligonucleotide
cugggagagugugggaga

SEQ ID NO: 52856 - RNA, 18 nt, Artificial Sequence
  Description of Artificial Sequence: Synthetic oligonucleotide
gagcucugggagagugug

SEQ ID NO: 52857 - RNA, 18 nt, Artificial Sequence
  Description of Artificial Sequence: Synthetic oligonucleotide
ucagugagcucugggaga

SEQ ID NO: 52858 - RNA, 18 nt, Artificial Sequence
  Description of Artificial Sequence: Synthetic oligonucleotide
ucuaaucagugagcucug

SEQ ID NO: 52859 - RNA, 18 nt, Artificial Sequence
  Description of Artificial Sequence: Synthetic oligonucleotide
ugcugucuaaucagugag

SEQ ID NO: 52860 - RNA, 18 nt, Artificial Sequence
  Description of Artificial Sequence: Synthetic oligonucleotide
ccuugugcugucuaauca

SEQ ID NO: 52861 - RNA, 18 nt, Artificial Sequence
  Description of Artificial Sequence: Synthetic oligonucleotide
gagacccuugugcugucu

SEQ ID NO: 52862 - RNA, 18 nt, Artificial Sequence
  Description of Artificial Sequence: Synthetic oligonucleotide
gaacugagacccuugugc

SEQ ID NO: 52863 - RNA, 18 nt, Artificial Sequence
  Description of Artificial Sequence: Synthetic oligonucleotide
cuguugaacugagacccu

SEQ ID NO: 52864 - RNA, 18 nt, Artificial Sequence
  Description of Artificial Sequence: Synthetic oligonucleotide
guaugcuguugaacugag

SEQ ID NO: 52865 - RNA, 18 nt, Artificial Sequence
  Description of Artificial Sequence: Synthetic oligonucleotide
uggcuguaugcuguugaa

SEQ ID NO: 52866 - RNA, 18 nt, Artificial Sequence
  Description of Artificial Sequence: Synthetic oligonucleotide
gauguuggcuguaugcug

SEQ ID NO: 52867 - RNA, 18 nt, Artificial Sequence
  Description of Artificial Sequence: Synthetic oligonucleotide
ccauagauguuggcugua

SEQ ID NO: 52868 - RNA, 18 nt, Artificial Sequence
  Description of Artificial Sequence: Synthetic oligonucleotide
ggacaccauagauguugg

SEQ ID NO: 52869 - RNA, 18 nt, Artificial Sequence
  Description of Artificial Sequence: Synthetic oligonucleotide
gccugggacaccauagau

SEQ ID NO: 52870 - RNA, 18 nt, Artificial Sequence
  Description of Artificial Sequence: Synthetic oligonucleotide
acugugccugggacacca

SEQ ID NO: 52871 - RNA, 18 nt, Artificial Sequence
  Description of Artificial Sequence: Synthetic oligonucleotide
cuggcacugugccuggga

SEQ ID NO: 52872 - RNA, 18 nt, Artificial Sequence
  Description of Artificial Sequence: Synthetic oligonucleotide
gggccuggcacugugccu

SEQ ID NO: 52873 - RNA, 18 nt, Artificial Sequence
  Description of Artificial Sequence: Synthetic oligonucleotide
uugguccccacucccggg

SEQ ID NO: 52874 - RNA, 18 nt, Artificial Sequence
  Description of Artificial Sequence: Synthetic oligonucleotide
acaucuugguccccacuc

SEQ ID NO: 52875 - RNA, 18 nt, Artificial Sequence
  Description of Artificial Sequence: Synthetic oligonucleotide
uauguacaucuugguccc

SEQ ID NO: 52876 - RNA, 18 nt, Artificial Sequence
  Description of Artificial Sequence: Synthetic oligonucleotide
ugucuuauguacaucuug

SEQ ID NO: 52877 - RNA, 18 nt, Artificial Sequence
  Description of Artificial Sequence: Synthetic oligonucleotide
agcuuugucuuauguaca

SEQ ID NO: 52878 - RNA, 18 nt, Artificial Sequence
  Description of Artificial Sequence: Synthetic oligonucleotide
gcaguagcuuugucuuau

SEQ ID NO: 52879 - RNA, 18 nt, Artificial Sequence
  Description of Artificial Sequence: Synthetic oligonucleotide
agaaggcaguagcuuugu

SEQ ID NO: 52880 - RNA, 18 nt, Artificial Sequence
  Description of Artificial Sequence: Synthetic oligonucleotide
ucucuagaaggcaguagc

SEQ ID NO: 52881 - RNA, 18 nt, Artificial Sequence
  Description of Artificial Sequence: Synthetic oligonucleotide
gguugucucuagaaggca

SEQ ID NO: 52882 - RNA, 18 nt, Artificial Sequence
  Description of Artificial Sequence: Synthetic oligonucleotide
cugccgguugucucuaga

SEQ ID NO: 52883 - RNA, 18 nt, Artificial Sequence
  Description of Artificial Sequence: Synthetic oligonucleotide
ggucacugccgguugucu

SEQ ID NO: 52884 - RNA, 18 nt, Artificial Sequence
  Description of Artificial Sequence: Synthetic oligonucleotide
agugaggucacugccggu

SEQ ID NO: 52885 - RNA, 18 nt, Artificial Sequence
  Description of Artificial Sequence: Synthetic oligonucleotide
ucuucagugaggucacug

SEQ ID NO: 52886 - RNA, 18 nt, Artificial Sequence
  Description of Artificial Sequence: Synthetic oligonucleotide
uuuugucuucagugaggu

SEQ ID NO: 52887 - RNA, 18 nt, Artificial Sequence
  Description of Artificial Sequence: Synthetic oligonucleotide
gcaguuuuugucuucagu

SEQ ID NO: 52888 - RNA, 18 nt, Artificial Sequence
  Description of Artificial Sequence: Synthetic oligonucleotide
cuagggcaguuuuugucu

SEQ ID NO: 52889 - RNA, 18 nt, Artificial Sequence
  Description of Artificial Sequence: Synthetic oligonucleotide
ccuggcuagggcaguuuu

SEQ ID NO: 52890 - RNA, 18 nt, Artificial Sequence
  Description of Artificial Sequence: Synthetic oligonucleotide
caguaccuggcuagggca

SEQ ID NO: 52891 - RNA, 18 nt, Artificial Sequence
  Description of Artificial Sequence: Synthetic oligonucleotide
acccucaguaccuggcua

SEQ ID NO: 52892 - RNA, 18 nt, Artificial Sequence
  Description of Artificial Sequence: Synthetic oligonucleotide
augcaacccucaguaccu

SEQ ID NO: 52893 - RNA, 18 nt, Artificial Sequence
  Description of Artificial Sequence: Synthetic oligonucleotide
gauucaugcaacccucag

SEQ ID NO: 52894 - RNA, 18 nt, Artificial Sequence
  Description of Artificial Sequence: Synthetic oligonucleotide
cugcagauucaugcaacc

SEQ ID NO: 52895 - RNA, 18 nt, Artificial Sequence
  Description of Artificial Sequence: Synthetic oligonucleotide
gucuccugcagauucaug

SEQ ID NO: 52896 - RNA, 18 nt, Artificial Sequence
  Description of Artificial Sequence: Synthetic oligonucleotide
ucucugucuccugcagau

SEQ ID NO: 52897 - RNA, 18 nt, Artificial Sequence
  Description of Artificial Sequence: Synthetic oligonucleotide
gggaucucugucuccugc

SEQ ID NO: 52898 - RNA, 18 nt, Artificial Sequence
  Description of Artificial Sequence: Synthetic oligonucleotide
auguuucccaugcaaggg

SEQ ID NO: 52899 - RNA, 18 nt, Artificial Sequence
  Description of Artificial Sequence: Synthetic oligonucleotide
gcuuuauguuucccaugc

SEQ ID NO: 52900 - RNA, 18 nt, Artificial Sequence
  Description of Artificial Sequence: Synthetic oligonucleotide
auucugcuuuauguuucc

SEQ ID NO: 52901 - RNA, 18 nt, Artificial Sequence
  Description of Artificial Sequence: Synthetic oligonucleotide
ucccaauucugcuuuaug

SEQ ID NO: 52902 - RNA, 18 nt, Artificial Sequence
  Description of Artificial Sequence: Synthetic oligonucleotide
gucccucccaauucugcu

SEQ ID NO: 52903 - RNA, 18 nt, Artificial Sequence
  Description of Artificial Sequence: Synthetic oligonucleotide
acaaagucccucccaauu

SEQ ID NO: 52904 - RNA, 18 nt, Artificial Sequence
  Description of Artificial Sequence: Synthetic oligonucleotide
ucuccacaaagucccucc

SEQ ID NO: 52905 - RNA, 18 nt, Artificial Sequence
  Description of Artificial Sequence: Synthetic oligonucleotide
cccugucuccacaaaguc

SEQ ID NO: 52906 - RNA, 18 nt, Artificial Sequence
  Description of Artificial Sequence: Synthetic oligonucleotide
uccagcccugucuccaca

SEQ ID NO: 52907 - RNA, 18 nt, Artificial Sequence
  Description of Artificial Sequence: Synthetic oligonucleotide
ucaaguccagcccugucu

SEQ ID NO: 52908 - RNA, 18 nt, Artificial Sequence
  Description of Artificial Sequence: Synthetic oligonucleotide
uccuuucaaguccagccc

SEQ ID NO: 52909 - RNA, 18 nt, Artificial Sequence
  Description of Artificial Sequence: Synthetic oligonucleotide
cuucuuccuuucaagucc

SEQ ID NO: 52910 - RNA, 18 nt, Artificial Sequence
  Description of Artificial Sequence: Synthetic oligonucleotide
gacuucuucuuccuuuca

SEQ ID NO: 52911 - RNA, 18 nt, Artificial Sequence
  Description of Artificial Sequence: Synthetic oligonucleotide
uuuuagacuucuucuucc

SEQ ID NO: 52912 - RNA, 18 nt, Artificial Sequence
  Description of Artificial Sequence: Synthetic oligonucleotide
uuuucuuuuagacuucuu

SEQ ID NO: 52913 - RNA, 18 nt, Artificial Sequence
  Description of Artificial Sequence: Synthetic oligonucleotide
ugauguuuucuuuuagac

SEQ ID NO: 52914 - RNA, 18 nt, Artificial Sequence
  Description of Artificial Sequence: Synthetic oligonucleotide
gcaaaugauguuuucuuu

SEQ ID NO: 52915 - RNA, 18 nt, Artificial Sequence
  Description of Artificial Sequence: Synthetic oligonucleotide
ccuuugcaaaugauguuu

SEQ ID NO: 52916 - RNA, 18 nt, Artificial Sequence
  Description of Artificial Sequence: Synthetic oligonucleotide
cucucccuuugcaaauga

SEQ ID NO: 52917 - RNA, 18 nt, Artificial Sequence
  Description of Artificial Sequence: Synthetic oligonucleotide
ccccucucucccuuugca

SEQ ID NO: 52918 - RNA, 18 nt, Artificial Sequence
  Description of Artificial Sequence: Synthetic oligonucleotide
gcuugccccucucucccu

SEQ ID NO: 52919 - RNA, 18 nt, Artificial Sequence
  Description of Artificial Sequence: Synthetic oligonucleotide
aucaugcuugccccucuc

SEQ ID NO: 52920 - RNA, 18 nt, Artificial Sequence
  Description of Artificial Sequence: Synthetic oligonucleotide
aacauaucaugcuugccc

SEQ ID NO: 52921 - RNA, 18 nt, Artificial Sequence
  Description of Artificial Sequence: Synthetic oligonucleotide
cuaacaacauaucaugcu

SEQ ID NO: 52922 - RNA, 18 nt, Artificial Sequence
  Description of Artificial Sequence: Synthetic oligonucleotide
cuguucuaacaacauauc

SEQ ID NO: 52923 - RNA, 18 nt, Artificial Sequence
  Description of Artificial Sequence: Synthetic oligonucleotide
ggcuccuguucuaacaac

SEQ ID NO: 52924 - RNA, 18 nt, Artificial Sequence
  Description of Artificial Sequence: Synthetic oligonucleotide
aagugggcuccuguucua

SEQ ID NO: 52925 - RNA, 18 nt, Artificial Sequence
  Description of Artificial Sequence: Synthetic oligonucleotide
cuucaaagugggcuccug

SEQ ID NO: 52926 - RNA, 18 nt, Artificial Sequence
  Description of Artificial Sequence: Synthetic oligonucleotide
uauaccuucaaagugggc

SEQ ID NO: 52927 - RNA, 18 nt, Artificial Sequence
  Description of Artificial Sequence: Synthetic oligonucleotide
ccuguuauaccuucaaag

SEQ ID NO: 52928 - RNA, 18 nt, Artificial Sequence
  Description of Artificial Sequence: Synthetic oligonucleotide
aggaaccuguuauaccuu

SEQ ID NO: 52929 - RNA, 18 nt, Artificial Sequence
  Description of Artificial Sequence: Synthetic oligonucleotide
cuggcaggaaccuguuau

SEQ ID NO: 52930 - RNA, 18 nt, Artificial Sequence
  Description of Artificial Sequence: Synthetic oligonucleotide
ucucacuggcaggaaccu

SEQ ID NO: 52931 - RNA, 18 nt, Artificial Sequence
  Description of Artificial Sequence: Synthetic oligonucleotide
ccauuucucacuggcagg

SEQ ID NO: 52932 - RNA, 18 nt, Artificial Sequence
  Description of Artificial Sequence: Synthetic oligonucleotide
ucuccccauuucucacug

SEQ ID NO: 52933 - RNA, 18 nt, Artificial Sequence
  Description of Artificial Sequence: Synthetic oligonucleotide
cuuauucuccccauuucu

SEQ ID NO: 52934 - RNA, 18 nt, Artificial Sequence
  Description of Artificial Sequence: Synthetic oligonucleotide
ucuggcuuauucucccca

SEQ ID NO: 52935 - RNA, 18 nt, Artificial Sequence
  Description of Artificial Sequence: Synthetic oligonucleotide
acuuuucuggcuuauucu

SEQ ID NO: 52936 - RNA, 18 nt, Artificial Sequence
  Description of Artificial Sequence: Synthetic oligonucleotide
aggguacuuuucuggcuu

SEQ ID NO: 52937 - RNA, 18 nt, Artificial Sequence
  Description of Artificial Sequence: Synthetic oligonucleotide
guccuaggguacuuuucu

SEQ ID NO: 52938 - RNA, 18 nt, Artificial Sequence
  Description of Artificial Sequence: Synthetic oligonucleotide
ggcugguccuaggguacu

SEQ ID NO: 52939 - RNA, 18 nt, Artificial Sequence
  Description of Artificial Sequence: Synthetic oligonucleotide
gaacgggcugguccuagg

SEQ ID NO: 52940 - RNA, 18 nt, Artificial Sequence
  Description of Artificial Sequence: Synthetic oligonucleotide
guccugaacgggcugguc

SEQ ID NO: 52941 - RNA, 18 nt, Artificial Sequence
  Description of Artificial Sequence: Synthetic oligonucleotide
ucaaaguccugaacgggc

SEQ ID NO: 52942 - RNA, 18 nt, Artificial Sequence
  Description of Artificial Sequence: Synthetic oligonucleotide
ggcauucaaaguccugaa

SEQ ID NO: 52943 - RNA, 18 nt, Artificial Sequence
  Description of Artificial Sequence: Synthetic oligonucleotide
uggcuggcauucaaaguc

SEQ ID NO: 52944 - RNA, 18 nt, Artificial Sequence
  Description of Artificial Sequence: Synthetic oligonucleotide
gccuuuggcuggcauuca

SEQ ID NO: 52945 - RNA, 18 nt, Artificial Sequence
  Description of Artificial Sequence: Synthetic oligonucleotide
acguggccuuuggcuggc

SEQ ID NO: 52946 - RNA, 18 nt, Artificial Sequence
  Description of Artificial Sequence: Synthetic oligonucleotide
gucagacguggccuuugg

SEQ ID NO: 52947 - RNA, 18 nt, Artificial Sequence
  Description of Artificial Sequence: Synthetic oligonucleotide
cccaagucagacguggcc

SEQ ID NO: 52948 - RNA, 18 nt, Artificial Sequence
  Description of Artificial Sequence: Synthetic oligonucleotide
ugccucccaagucagacg

SEQ ID NO: 52949 - RNA, 18 nt, Artificial Sequence
  Description of Artificial Sequence: Synthetic oligonucleotide
cccucugccucccaaguc

SEQ ID NO: 52950 - RNA, 18 nt, Artificial Sequence
  Description of Artificial Sequence: Synthetic oligonucleotide
agcugcccucugccuccc

SEQ ID NO: 52951 - RNA, 18 nt, Artificial Sequence
  Description of Artificial Sequence: Synthetic oligonucleotide
gcaguagcugcccucugc

SEQ ID NO: 52952 - RNA, 18 nt, Artificial Sequence
  Description of Artificial Sequence: Synthetic oligonucleotide
aaccugcaguagcugccc

SEQ ID NO: 52953 - RNA, 18 nt, Artificial Sequence
  Description of Artificial Sequence: Synthetic oligonucleotide
ucggaaaccugcaguagc

SEQ ID NO: 52954 - RNA, 18 nt, Artificial Sequence
  Description of Artificial Sequence: Synthetic oligonucleotide
ucugcucggaaaccugca

SEQ ID NO: 52955 - RNA, 18 nt, Artificial Sequence
  Description of Artificial Sequence: Synthetic oligonucleotide
gacccucugcucggaaac

SEQ ID NO: 52956 - RNA, 18 nt, Artificial Sequence
  Description of Artificial Sequence: Synthetic oligonucleotide
uguaugacccucugcucg

SEQ ID NO: 52957 - RNA, 18 nt, Artificial Sequence
  Description of Artificial Sequence: Synthetic oligonucleotide
cccuguguaugacccucu

SEQ ID NO: 52958 - RNA, 18 nt, Artificial Sequence
  Description of Artificial Sequence: Synthetic oligonucleotide
uccagcccuguguaugac

SEQ ID NO: 52959 - RNA, 18 nt, Artificial Sequence
  Description of Artificial Sequence: Synthetic oligonucleotide
ugagguccagcccugugu

SEQ ID NO: 52960 - RNA, 18 nt, Artificial Sequence
  Description of Artificial Sequence: Synthetic oligonucleotide
cugcgugagguccagccc

SEQ ID NO: 52961 - RNA, 18 nt, Artificial Sequence
  Description of Artificial Sequence: Synthetic oligonucleotide
ccagucugcgugaggucc

SEQ ID NO: 52962 - RNA, 18 nt, Artificial Sequence
  Description of Artificial Sequence: Synthetic oligonucleotide
ccaugccagucugcguga

SEQ ID NO: 52963 - RNA, 18 nt, Artificial Sequence
  Description of Artificial Sequence: Synthetic oligonucleotide
cauggccaugccagucug

SEQ ID NO: 52964 - RNA, 18 nt, Artificial Sequence
  Description of Artificial Sequence: Synthetic oligonucleotide
ggacccauggccaugcca

SEQ ID NO: 52965 - RNA, 18 nt, Artificial Sequence
  Description of Artificial Sequence: Synthetic oligonucleotide
ccucuggacccauggcca

SEQ ID NO: 52966 - RNA, 18 nt, Artificial Sequence
  Description of Artificial Sequence: Synthetic oligonucleotide
aguauccucuggacccau

SEQ ID NO: 52967 - RNA, 18 nt, Artificial Sequence
  Description of Artificial Sequence: Synthetic oligonucleotide
ccaguaguauccucugga

SEQ ID NO: 52968 - RNA, 18 nt, Artificial Sequence
  Description of Artificial Sequence: Synthetic oligonucleotide
ccuucccaguaguauccu

SEQ ID NO: 52969 - RNA, 18 nt, Artificial Sequence
  Description of Artificial Sequence: Synthetic oligonucleotide
cauccccuucccaguagu

SEQ ID NO: 52970 - RNA, 18 nt, Artificial Sequence
  Description of Artificial Sequence: Synthetic oligonucleotide
gcugccauccccuuccca

SEQ ID NO: 52971 - RNA, 18 nt, Artificial Sequence
  Description of Artificial Sequence: Synthetic oligonucleotide
caguagcugccauccccu

SEQ ID NO: 52972 - RNA, 18 nt, Artificial Sequence
  Description of Artificial Sequence: Synthetic oligonucleotide
gguggcaguagcugccau

SEQ ID NO: 52973 - RNA, 18 nt, Artificial Sequence
  Description of Artificial Sequence: Synthetic oligonucleotide
uggaagguggcaguagcu

SEQ ID NO: 52974 - RNA, 18 nt, Artificial Sequence
  Description of Artificial Sequence: Synthetic oligonucleotide
ccaucuggaagguggcag

SEQ ID NO: 52975 - RNA, 18 nt, Artificial Sequence
  Description of Artificial Sequence: Synthetic oligonucleotide
uggaaccaucuggaaggu

SEQ ID NO: 52976 - RNA, 18 nt, Artificial Sequence
  Description of Artificial Sequence: Synthetic oligonucleotide
cuccauggaaccaucugg

SEQ ID NO: 52977 - RNA, 18 nt, Artificial Sequence
  Description of Artificial Sequence: Synthetic oligonucleotide
cagaacuccauggaacca

SEQ ID NO: 52978 - RNA, 18 nt, Artificial Sequence
  Description of Artificial Sequence: Synthetic oligonucleotide
aagaucagaacuccaugg

SEQ ID NO: 52979 - RNA, 18 nt, Artificial Sequence
  Description of Artificial Sequence: Synthetic oligonucleotide
gcccaaagaucagaacuc

SEQ ID NO: 52980 - RNA, 18 nt, Artificial Sequence
  Description of Artificial Sequence: Synthetic oligonucleotide
gccaugcccaaagaucag

SEQ ID NO: 52981 - RNA, 18 nt, Artificial Sequence
  Description of Artificial Sequence: Synthetic oligonucleotide
cccuggccaugcccaaag

SEQ ID NO: 52982 - RNA, 18 nt, Artificial Sequence
  Description of Artificial Sequence: Synthetic oligonucleotide
gcuuccccuggccaugcc

SEQ ID NO: 52983 - RNA, 18 nt, Artificial Sequence
  Description of Artificial Sequence: Synthetic oligonucleotide
cuucugcuuccccuggcc

SEQ ID NO: 52984 - RNA, 18 nt, Artificial Sequence
  Description of Artificial Sequence: Synthetic oligonucleotide
ucucccuucugcuucccc

SEQ ID NO: 52985 - RNA, 18 nt, Artificial Sequence
  Description of Artificial Sequence: Synthetic oligonucleotide
uagagucucccuucugcu

SEQ ID NO: 52986 - RNA, 18 nt, Artificial Sequence
  Description of Artificial Sequence: Synthetic oligonucleotide
acuccuagagucucccuu

SEQ ID NO: 52987 - RNA, 18 nt, Artificial Sequence
  Description of Artificial Sequence: Synthetic oligonucleotide
uuucaacuccuagagucu

SEQ ID NO: 52988 - RNA, 18 nt, Artificial Sequence
  Description of Artificial Sequence: Synthetic oligonucleotide
acccauuucaacuccuag

SEQ ID NO: 52989 - RNA, 18 nt, Artificial Sequence
  Description of Artificial Sequence: Synthetic oligonucleotide
gucugacccauuucaacu

SEQ ID NO: 52990 - RNA, 18 nt, Artificial Sequence
  Description of Artificial Sequence: Synthetic oligonucleotide
accgggucugacccauuu

SEQ ID NO: 52991 - RNA, 18 nt, Artificial Sequence
  Description of Artificial Sequence: Synthetic oligonucleotide
caaacaccgggucugacc

SEQ ID NO: 52992 - RNA, 18 nt, Artificial Sequence
  Description of Artificial Sequence: Synthetic oligonucleotide
ucacccaaacaccggguc

SEQ ID NO: 52993 - RNA, 18 nt, Artificial Sequence
  Description of Artificial Sequence: Synthetic oligonucleotide
uaccuucacccaaacacc

SEQ ID NO: 52994 - RNA, 18 nt, Artificial Sequence
  Description of Artificial Sequence: Synthetic oligonucleotide
uuccuuaccuucacccaa

SEQ ID NO: 52995 - RNA, 18 nt, Artificial Sequence
  Description of Artificial Sequence: Synthetic oligonucleotide
ccucauuccuuaccuuca

SEQ ID NO: 52996 - RNA, 18 nt, Artificial Sequence
  Description of Artificial Sequence: Synthetic oligonucleotide
ucuucccucauuccuuac

SEQ ID NO: 52997 - RNA, 18 nt, Artificial Sequence
  Description of Artificial Sequence: Synthetic oligonucleotide
gcuccucuucccucauuc

SEQ ID NO: 52998 - RNA, 18 nt, Artificial Sequence
  Description of Artificial Sequence: Synthetic oligonucleotide
aaagagcuccucuucccu

SEQ ID NO: 52999 - RNA, 18 nt, Artificial Sequence
  Description of Artificial Sequence: Synthetic oligonucleotide
accccagucuugguuguu

SEQ ID NO: 53000 - RNA, 18 nt, Artificial Sequence
  Description of Artificial Sequence: Synthetic oligonucleotide
auuuaaccccagucuugg

SEQ ID NO: 53001 - RNA, 18 nt, Artificial Sequence
  Description of Artificial Sequence: Synthetic oligonucleotide
gugagauuuaaccccagu

SEQ ID NO: 53002 - RNA, 18 nt, Artificial Sequence
  Description of Artificial Sequence: Synthetic oligonucleotide
aggcugugagauuuaacc

SEQ ID NO: 53003 - RNA, 18 nt, Artificial Sequence
  Description of Artificial Sequence: Synthetic oligonucleotide
cuugcaggcugugagauu

SEQ ID NO: 53004 - RNA, 18 nt, Artificial Sequence
  Description of Artificial Sequence: Synthetic oligonucleotide
uuccacuugcaggcugug

SEQ ID NO: 53005 - RNA, 18 nt, Artificial Sequence
  Description of Artificial Sequence: Synthetic oligonucleotide
uucucuuccacuugcagg

SEQ ID NO: 53006 - RNA, 18 nt, Artificial Sequence
  Description of Artificial Sequence: Synthetic oligonucleotide
aguucuucucuuccacuu

SEQ ID NO: 53007 - RNA, 18 nt, Artificial Sequence
  Description of Artificial Sequence: Synthetic oligonucleotide
guucaaguucuucucuuc

SEQ ID NO: 53008 - RNA, 18 nt, Artificial Sequence
  Description of Artificial Sequence: Synthetic oligonucleotide
ccuggguucaaguucuuc

SEQ ID NO: 53009 - RNA, 18 nt, Artificial Sequence
  Description of Artificial Sequence: Synthetic oligonucleotide
uuggaccuggguucaagu

SEQ ID NO: 53010 - RNA, 18 nt, Artificial Sequence
  Description of Artificial Sequence: Synthetic oligonucleotide
aaaaguuggaccuggguu

SEQ ID NO: 53011 - RNA, 18 nt, Artificial Sequence
  Description of Artificial Sequence: Synthetic oligonucleotide
ggcgcaaaaguuggaccu

SEQ ID NO: 53012 - RNA, 18 nt, Artificial Sequence
  Description of Artificial Sequence: Synthetic oligonucleotide
gcuguggcgcaaaaguug

SEQ ID NO: 53013 - RNA, 18 nt, Artificial Sequence
  Description of Artificial Sequence: Synthetic oligonucleotide
agccugcuguggcgcaaa

SEQ ID NO: 53014 - RNA, 18 nt, Artificial Sequence
  Description of Artificial Sequence: Synthetic oligonucleotide
gaggcagccugcuguggc

SEQ ID NO: 53015 - RNA, 18 nt, Artificial Sequence
  Description of Artificial Sequence: Synthetic oligonucleotide
accaagaggcagccugcu

SEQ ID NO: 53016 - RNA, 18 nt, Artificial Sequence
  Description of Artificial Sequence: Synthetic oligonucleotide
ucaggaccaagaggcagc

SEQ ID NO: 53017 - RNA, 18 nt, Artificial Sequence
  Description of Artificial Sequence: Synthetic oligonucleotide
uccugucaggaccaagag

SEQ ID NO: 53018 - RNA, 18 nt, Artificial Sequence
  Description of Artificial Sequence: Synthetic oligonucleotide
ugacuuccugucaggacc

SEQ ID NO: 53019 - RNA, 18 nt, Artificial Sequence
  Description of Artificial Sequence: Synthetic oligonucleotide
aguugugacuuccuguca

SEQ ID NO: 53020 - RNA, 18 nt, Artificial Sequence
  Description of Artificial Sequence: Synthetic oligonucleotide
uagccagggaucaguacu

SEQ ID NO: 53021 - RNA, 18 nt, Artificial Sequence
  Description of Artificial Sequence: Synthetic oligonucleotide
aaaaauagccagggauca

SEQ ID NO: 53022 - RNA, 18 nt, Artificial Sequence
  Description of Artificial Sequence: Synthetic oligonucleotide
agccaaaaaauagccagg

SEQ ID NO: 53023 - RNA, 18 nt, Artificial Sequence
  Description of Artificial Sequence: Synthetic oligonucleotide
aacacagccaaaaaauag

SEQ ID NO: 53024 - RNA, 18 nt, Artificial Sequence
  Description of Artificial Sequence: Synthetic oligonucleotide
aagguaacacagccaaaa

SEQ ID NO: 53025 - RNA, 18 nt, Artificial Sequence
  Description of Artificial Sequence: Synthetic oligonucleotide
uguccaagguaacacagc

SEQ ID NO: 53026 - RNA, 18 nt, Artificial Sequence
  Description of Artificial Sequence: Synthetic oligonucleotide
ugacuuguccaagguaac

SEQ ID NO: 53027 - RNA, 18 nt, Artificial Sequence
  Description of Artificial Sequence: Synthetic oligonucleotide
auaagugacuuguccaag

SEQ ID NO: 53028 - RNA, 18 nt, Artificial Sequence
  Description of Artificial Sequence: Synthetic oligonucleotide
gaggaauaagugacuugu

SEQ ID NO: 53029 - RNA, 18 nt, Artificial Sequence
  Description of Artificial Sequence: Synthetic oligonucleotide
gggaggaggaauaaguga

SEQ ID NO: 53030 - RNA, 18 nt, Artificial Sequence
  Description of Artificial Sequence: Synthetic oligonucleotide
gaaacgggaggaggaaua

SEQ ID NO: 53031 - RNA, 18 nt, Artificial Sequence
  Description of Artificial Sequence: Synthetic oligonucleotide
aggaggaaacgggaggag

SEQ ID NO: 53032 - RNA, 18 nt, Artificial Sequence
  Description of Artificial Sequence: Synthetic oligonucleotide
uacauaggaggaaacggg

SEQ ID NO: 53033 - RNA, 18 nt, Artificial Sequence
  Description of Artificial Sequence: Synthetic oligonucleotide
cauuuuacauaggaggaa

SEQ ID NO: 53034 - RNA, 18 nt, Artificial Sequence
  Description of Artificial Sequence: Synthetic oligonucleotide
auuuccauuuuacauagg

SEQ ID NO: 53035 - RNA, 18 nt, Artificial Sequence
  Description of Artificial Sequence: Synthetic oligonucleotide
uuauuauuuccauuuuac

SEQ ID NO: 53036 - RNA, 18 nt, Artificial Sequence
  Description of Artificial Sequence: Synthetic oligonucleotide
caacauuauuauuuccau

SEQ ID NO: 53037 - RNA, 18 nt, Artificial Sequence
  Description of Artificial Sequence: Synthetic oligonucleotide
agggucaacauuauuauu

SEQ ID NO: 53038 - RNA, 18 nt, Artificial Sequence
  Description of Artificial Sequence: Synthetic oligonucleotide
gacccagggucaacauua

SEQ ID NO: 53039 - RNA, 18 nt, Artificial Sequence
  Description of Artificial Sequence: Synthetic oligonucleotide
ucucagacccagggucaa

SEQ ID NO: 53040 - RNA, 18 nt, Artificial Sequence
  Description of Artificial Sequence: Synthetic oligonucleotide
cacucucucagacccagg

SEQ ID NO: 53041 - RNA, 18 nt, Artificial Sequence
  Description of Artificial Sequence: Synthetic oligonucleotide
aaauccacucucucagac

SEQ ID NO: 53042 - RNA, 18 nt, Artificial Sequence
  Description of Artificial Sequence: Synthetic oligonucleotide
cuuucaaauccacucucu

SEQ ID NO: 53043 - RNA, 18 nt, Artificial Sequence
  Description of Artificial Sequence: Synthetic oligonucleotide
aaguacuuucaaauccac

SEQ ID NO: 53044 - RNA, 18 nt, Artificial Sequence
  Description of Artificial Sequence: Synthetic oligonucleotide
gcacuaaguacuuucaaa

SEQ ID NO: 53045 - RNA, 18 nt, Artificial Sequence
  Description of Artificial Sequence: Synthetic oligonucleotide
gugaugcacuaaguacuu

SEQ ID NO: 53046 - RNA, 18 nt, Artificial Sequence
  Description of Artificial Sequence: Synthetic oligonucleotide
gcuuugugaugcacuaag

SEQ ID NO: 53047 - RNA, 18 nt, Artificial Sequence
  Description of Artificial Sequence: Synthetic oligonucleotide
ucugugcuuugugaugca

SEQ ID NO: 53048 - RNA, 18 nt, Artificial Sequence
  Description of Artificial Sequence: Synthetic oligonucleotide
uguguucugugcuuugug

SEQ ID NO: 53049 - RNA, 18 nt, Artificial Sequence
  Description of Artificial Sequence: Synthetic oligonucleotide
ggaaguguguucugugcu

SEQ ID NO: 53050 - RNA, 18 nt, Artificial Sequence
  Description of Artificial Sequence: Synthetic oligonucleotide
agacuggaaguguguucu

SEQ ID NO: 53051 - RNA, 18 nt, Artificial Sequence
  Description of Artificial Sequence: Synthetic oligonucleotide
ucacgagacuggaagugu

SEQ ID NO: 53052 - RNA, 18 nt, Artificial Sequence
  Description of Artificial Sequence: Synthetic oligonucleotide
cauaaucacgagacugga

SEQ ID NO: 53053 - RNA, 18 nt, Artificial Sequence
  Description of Artificial Sequence: Synthetic oligonucleotide
aaguacauaaucacgaga

SEQ ID NO: 53054 - RNA, 18 nt, Artificial Sequence
  Description of Artificial Sequence: Synthetic oligonucleotide
uacauaaguacauaauca

SEQ ID NO: 53055 - RNA, 18 nt, Artificial Sequence
  Description of Artificial Sequence: Synthetic oligonucleotide
ccaguuacauaaguacau

SEQ ID NO: 53056 - RNA, 18 nt, Artificial Sequence
  Description of Artificial Sequence: Synthetic oligonucleotide
gaugaccaguuacauaag

SEQ ID NO: 53057 - RNA, 18 nt, Artificial Sequence
  Description of Artificial Sequence: Synthetic oligonucleotide
ugggugaugaccaguuac

SEQ ID NO: 53058 - RNA, 18 nt, Artificial Sequence
  Description of Artificial Sequence: Synthetic oligonucleotide
caagaugggugaugacca

SEQ ID NO: 53059 - RNA, 18 nt, Artificial Sequence
  Description of Artificial Sequence: Synthetic oligonucleotide
auucucaagaugggugau

SEQ ID NO: 53060 - RNA, 18 nt, Artificial Sequence
  Description of Artificial Sequence: Synthetic oligonucleotide
cauucauucucaagaugg

SEQ ID NO: 53061 - RNA, 18 nt, Artificial Sequence
  Description of Artificial Sequence: Synthetic oligonucleotide
caaugcauucauucucaa

SEQ ID NO: 53062 - RNA, 18 nt, Artificial Sequence
  Description of Artificial Sequence: Synthetic oligonucleotide
uuccccaaugcauucauu

SEQ ID NO: 53063 - RNA, 18 nt, Artificial Sequence
  Description of Artificial Sequence: Synthetic oligonucleotide
gcccuuuccccaaugcau

SEQ ID NO: 53064 - RNA, 18 nt, Artificial Sequence
  Description of Artificial Sequence: Synthetic oligonucleotide
ggauggcccuuuccccaa

SEQ ID NO: 53065 - RNA, 18 nt, Artificial Sequence
  Description of Artificial Sequence: Synthetic oligonucleotide
cuaguggauggcccuuuc

SEQ ID NO: 53066 - RNA, 18 nt, Artificial Sequence
  Description of Artificial Sequence: Synthetic oligonucleotide
gcagccuaguggauggcc

SEQ ID NO: 53067 - RNA, 18 nt, Artificial Sequence
  Description of Artificial Sequence: Synthetic oligonucleotide
acuucgcagccuagugga

SEQ ID NO: 53068 - RNA, 18 nt, Artificial Sequence
  Description of Artificial Sequence: Synthetic oligonucleotide
cagaaacuucgcagccua

SEQ ID NO: 53069 - RNA, 18 nt, Artificial Sequence
  Description of Artificial Sequence: Synthetic oligonucleotide
ucccucagaaacuucgca

SEQ ID NO: 53070 - RNA, 18 nt, Artificial Sequence
  Description of Artificial Sequence: Synthetic oligonucleotide
aggagucccucagaaacu

SEQ ID NO: 53071 - RNA, 18 nt, Artificial Sequence
  Description of Artificial Sequence: Synthetic oligonucleotide
cccgaaggagucccucag

SEQ ID NO: 53072 - RNA, 18 nt, Artificial Sequence
  Description of Artificial Sequence: Synthetic oligonucleotide
uccagcccgaaggagucc

SEQ ID NO: 53073 - RNA, 18 nt, Artificial Sequence
  Description of Artificial Sequence: Synthetic oligonucleotide
ccuucuccagcccgaagg

SEQ ID NO: 53074 - RNA, 18 nt, Artificial Sequence
  Description of Artificial Sequence: Synthetic oligonucleotide
gccauccuucuccagccc

SEQ ID NO: 53075 - RNA, 18 nt, Artificial Sequence
  Description of Artificial Sequence: Synthetic oligonucleotide
cuguggccauccuucucc

SEQ ID NO: 53076 - RNA, 18 nt, Artificial Sequence
  Description of Artificial Sequence: Synthetic oligonucleotide
cccuccuguggccauccu

SEQ ID NO: 53077 - RNA, 18 nt, Artificial Sequence
  Description of Artificial Sequence: Synthetic oligonucleotide
cuccucccuccuguggcc

SEQ ID NO: 53078 - RNA, 18 nt, Artificial Sequence
  Description of Artificial Sequence: Synthetic oligonucleotide
aaucucuccucccuccug

SEQ ID NO: 53079 - RNA, 18 nt, Artificial Sequence
  Description of Artificial Sequence: Synthetic oligonucleotide
aaggcaaucucuccuccc

SEQ ID NO: 53080 - RNA, 18 nt, Artificial Sequence
  Description of Artificial Sequence: Synthetic oligonucleotide
aggauaaggcaaucucuc

SEQ ID NO: 53081 - RNA, 18 nt, Artificial Sequence
  Description of Artificial Sequence: Synthetic oligonucleotide
acugcaggauaaggcaau

SEQ ID NO: 53082 - RNA, 18 nt, Artificial Sequence
  Description of Artificial Sequence: Synthetic oligonucleotide
ugaucacugcaggauaag

SEQ ID NO: 53083 - RNA, 18 nt, Artificial Sequence
  Description of Artificial Sequence: Synthetic oligonucleotide
ugacaugaucacugcagg

SEQ ID NO: 53084 - RNA, 18 nt, Artificial Sequence
  Description of Artificial Sequence: Synthetic oligonucleotide
cucaaugacaugaucacu

SEQ ID NO: 53085 - RNA, 18 nt, Artificial Sequence
  Description of Artificial Sequence: Synthetic oligonucleotide
cuguucucaaugacauga

SEQ ID NO: 53086 - RNA, 18 nt, Artificial Sequence
  Description of Artificial Sequence: Synthetic oligonucleotide
uggcucuguucucaauga

SEQ ID NO: 53087 - RNA, 18 nt, Artificial Sequence
  Description of Artificial Sequence: Synthetic oligonucleotide
gaaucuggcucuguucuc

SEQ ID NO: 53088 - RNA, 18 nt, Artificial Sequence
  Description of Artificial Sequence: Synthetic oligonucleotide
gauaaggcaaucucuccu

SEQ ID NO: 53089 - RNA, 18 nt, Artificial Sequence
  Description of Artificial Sequence: Synthetic oligonucleotide
ugcaggauaaggcaaucu

SEQ ID NO: 53090 - RNA, 18 nt, Artificial Sequence
  Description of Artificial Sequence: Synthetic oligonucleotide
aucacugcaggauaaggc

SEQ ID NO: 53091 - RNA, 18 nt, Artificial Sequence
  Description of Artificial Sequence: Synthetic oligonucleotide
acaugaucacugcaggau

SEQ ID NO: 53092 - RNA, 18 nt, Artificial Sequence
  Description of Artificial Sequence: Synthetic oligonucleotide
caaugacaugaucacugc

SEQ ID NO: 53093 - RNA, 18 nt, Artificial Sequence
  Description of Artificial Sequence: Synthetic oligonucleotide
guucucaaugacaugauc

SEQ ID NO: 53094 - RNA, 18 nt, Artificial Sequence
  Description of Artificial Sequence: Synthetic oligonucleotide
gcucuguucucaaugaca

SEQ ID NO: 53095 - RNA, 18 nt, Artificial Sequence
  Description of Artificial Sequence: Synthetic oligonucleotide
aucuggcucuguucucaa

SEQ ID NO: 53096 - RNA, 18 nt, Artificial Sequence
  Description of Artificial Sequence: Synthetic oligonucleotide
aaagaaucuggcucuguu

SEQ ID NO: 53097 - RNA, 18 nt, Artificial Sequence
  Description of Artificial Sequence: Synthetic oligonucleotide
gaaaaaaagaaucuggcu

SEQ ID NO: 53098 - RNA, 18 nt, Artificial Sequence
  Description of Artificial Sequence: Synthetic oligonucleotide
gccaggaaaaaaagaauc

SEQ ID NO: 53099 - RNA, 18 nt, Artificial Sequence
  Description of Artificial Sequence: Synthetic oligonucleotide
gcccugccaggaaaaaaa

SEQ ID NO: 53100 - RNA, 18 nt, Artificial Sequence
  Description of Artificial Sequence: Synthetic oligonucleotide
aguuggcccugccaggaa

SEQ ID NO: 53101 - RNA, 18 nt, Artificial Sequence
  Description of Artificial Sequence: Synthetic oligonucleotide
aaacaaguuggcccugcc

SEQ ID NO: 53102 - RNA, 18 nt, Artificial Sequence
  Description of Artificial Sequence: Synthetic oligonucleotide
uguuaaaacaaguuggcc

SEQ ID NO: 53103 - RNA, 18 nt, Artificial Sequence
  Description of Artificial Sequence: Synthetic oligonucleotide
uuagauguuaaaacaagu

SEQ ID NO: 53104 - RNA, 18 nt, Artificial Sequence
  Description of Artificial Sequence: Synthetic oligonucleotide
aguccuuagauguuaaaa

SEQ ID NO: 53105 - RNA, 18 nt, Artificial Sequence
  Description of Artificial Sequence: Synthetic oligonucleotide
agcucaguccuuagaugu

SEQ ID NO: 53106 - RNA, 18 nt, Artificial Sequence
  Description of Artificial Sequence: Synthetic oligonucleotide
caaauagcucaguccuua

SEQ ID NO: 53107 - RNA, 18 nt, Artificial Sequence
  Description of Artificial Sequence: Synthetic oligonucleotide
agacacaaauagcucagu

SEQ ID NO: 53108 - RNA, 18 nt, Artificial Sequence
  Description of Artificial Sequence: Synthetic oligonucleotide
ggcacagacacaaauagc

SEQ ID NO: 53109 - RNA, 18 nt, Artificial Sequence
  Description of Artificial Sequence: Synthetic oligonucleotide
caaagggcacagacacaa

SEQ ID NO: 53110 - RNA, 18 nt, Artificial Sequence
  Description of Artificial Sequence: Synthetic oligonucleotide
uuggacaaagggcacaga

SEQ ID NO: 53111 - RNA, 18 nt, Artificial Sequence
  Description of Artificial Sequence: Synthetic oligonucleotide
acugcuuggacaaagggc

SEQ ID NO: 53112 - RNA, 18 nt, Artificial Sequence
  Description of Artificial Sequence: Synthetic oligonucleotide
gaaacacugcuuggacaa

SEQ ID NO: 53113 - RNA, 18 nt, Artificial Sequence
  Description of Artificial Sequence: Synthetic oligonucleotide
uuugggaaacacugcuug

SEQ ID NO: 53114 - RNA, 18 nt, Artificial Sequence
  Description of Artificial Sequence: Synthetic oligonucleotide
uacacuuugggaaacacu

SEQ ID NO: 53115 - RNA, 18 nt, Artificial Sequence
  Description of Artificial Sequence: Synthetic oligonucleotide
ugggcuacacuuugggaa

SEQ ID NO: 53116 - RNA, 18 nt, Artificial Sequence
  Description of Artificial Sequence: Synthetic oligonucleotide
guucuugggcuacacuuu

SEQ ID NO: 53117 - RNA, 18 nt, Artificial Sequence
  Description of Artificial Sequence: Synthetic oligonucleotide
agaugguucuugggcuac

SEQ ID NO: 53118 - RNA, 18 nt, Artificial Sequence
  Description of Artificial Sequence: Synthetic oligonucleotide
gagggagaugguucuugg

SEQ ID NO: 53119 - RNA, 18 nt, Artificial Sequence
  Description of Artificial Sequence: Synthetic oligonucleotide
gcucugagggagaugguu

SEQ ID NO: 53120 - RNA, 18 nt, Artificial Sequence
  Description of Artificial Sequence: Synthetic oligonucleotide
ugguggcucugagggaga

SEQ ID NO: 53121 - RNA, 18 nt, Artificial Sequence
  Description of Artificial Sequence: Synthetic oligonucleotide
cuuccugguggcucugag

SEQ ID NO: 53122 - RNA, 18 nt, Artificial Sequence
  Description of Artificial Sequence: Synthetic oligonucleotide
aagcacuuccugguggcu

SEQ ID NO: 53123 - RNA, 18 nt, Artificial Sequence
  Description of Artificial Sequence: Synthetic oligonucleotide
auuuaaagcacuuccugg

SEQ ID NO: 53124 - RNA, 18 nt, Artificial Sequence
  Description of Artificial Sequence: Synthetic oligonucleotide
cugcaauuuaaagcacuu

SEQ ID NO: 53125 - RNA, 18 nt, Artificial Sequence
  Description of Artificial Sequence: Synthetic oligonucleotide
ggaaccugcaauuuaaag

SEQ ID NO: 53126 - RNA, 18 nt, Artificial Sequence
  Description of Artificial Sequence: Synthetic oligonucleotide
gccuaggaaccugcaauu

SEQ ID NO: 53127 - RNA, 18 nt, Artificial Sequence
  Description of Artificial Sequence: Synthetic oligonucleotide
cuguggccuaggaaccug

SEQ ID NO: 53128 - RNA, 18 nt, Artificial Sequence
  Description of Artificial Sequence: Synthetic oligonucleotide
gcaggcuguggccuagga

SEQ ID NO: 53129 - RNA, 18 nt, Artificial Sequence
  Description of Artificial Sequence: Synthetic oligonucleotide
caggugcaggcuguggcc

SEQ ID NO: 53130 - RNA, 18 nt, Artificial Sequence
  Description of Artificial Sequence: Synthetic oligonucleotide
cucugcaggugcaggcug

SEQ ID NO: 53131 - RNA, 18 nt, Artificial Sequence
  Description of Artificial Sequence: Synthetic oligonucleotide
ucugacucugcaggugca

SEQ ID NO: 53132 - RNA, 18 nt, Artificial Sequence
  Description of Artificial Sequence: Synthetic oligonucleotide
augauucugacucugcag

SEQ ID NO: 53133 - RNA, 18 nt, Artificial Sequence
  Description of Artificial Sequence: Synthetic oligonucleotide
ccuccaugauucugacuc

SEQ ID NO: 53134 - RNA, 18 nt, Artificial Sequence
  Description of Artificial Sequence: Synthetic oligonucleotide
cccaaccuccaugauucu

SEQ ID NO: 53135 - RNA, 18 nt, Artificial Sequence
  Description of Artificial Sequence: Synthetic oligonucleotide
ugggucccaaccuccaug

SEQ ID NO: 53136 - RNA, 18 nt, Artificial Sequence
  Description of Artificial Sequence: Synthetic oligonucleotide
gugccugggucccaaccu

SEQ ID NO: 53137 - RNA, 18 nt, Artificial Sequence
  Description of Artificial Sequence: Synthetic oligonucleotide
cgcaggugccuggguccc

SEQ ID NO: 53138 - RNA, 18 nt, Artificial Sequence
  Description of Artificial Sequence: Synthetic oligonucleotide
agaaacgcaggugccugg

SEQ ID NO: 53139 - RNA, 18 nt, Artificial Sequence
  Description of Artificial Sequence: Synthetic oligonucleotide
uuguuagaaacgcaggug

SEQ ID NO: 53140 - RNA, 18 nt, Artificial Sequence
  Description of Artificial Sequence: Synthetic oligonucleotide
ggcauuuguuagaaacgc

SEQ ID NO: 53141 - RNA, 18 nt, Artificial Sequence
  Description of Artificial Sequence: Synthetic oligonucleotide
cccgaggcauuuguuaga

SEQ ID NO: 53142 - RNA, 18 nt, Artificial Sequence
  Description of Artificial Sequence: Synthetic oligonucleotide
aaucacccgaggcauuug

SEQ ID NO: 53143 - RNA, 18 nt, Artificial Sequence
  Description of Artificial Sequence: Synthetic oligonucleotide
aucagaaucacccgaggc

SEQ ID NO: 53144 - RNA, 18 nt, Artificial Sequence
  Description of Artificial Sequence: Synthetic oligonucleotide
auugcaucagaaucaccc

SEQ ID NO: 53145 - RNA, 18 nt, Artificial Sequence
  Description of Artificial Sequence: Synthetic oligonucleotide
uuucaauugcaucagaau

SEQ ID NO: 53146 - RNA, 18 nt, Artificial Sequence
  Description of Artificial Sequence: Synthetic oligonucleotide
caaacuuucaauugcauc

SEQ ID NO: 53147 - RNA, 18 nt, Artificial Sequence
  Description of Artificial Sequence: Synthetic oligonucleotide
gaucucaaacuuucaauu

SEQ ID NO: 53148 - RNA, 18 nt, Artificial Sequence
  Description of Artificial Sequence: Synthetic oligonucleotide
cuguggaucucaaacuuu

SEQ ID NO: 53149 - RNA, 18 nt, Artificial Sequence
  Description of Artificial Sequence: Synthetic oligonucleotide
cagaacuguggaucucaa

SEQ ID NO: 53150 - RNA, 18 nt, Artificial Sequence
  Description of Artificial Sequence: Synthetic oligonucleotide
ugucucagaacuguggau

SEQ ID NO: 53151 - RNA, 18 nt, Artificial Sequence
  Description of Artificial Sequence: Synthetic oligonucleotide
guuauugucucagaacug

SEQ ID NO: 53152 - RNA, 18 nt, Artificial Sequence
  Description of Artificial Sequence: Synthetic oligonucleotide
auucuguuauugucucag

SEQ ID NO: 53153 - RNA, 18 nt, Artificial Sequence
  Description of Artificial Sequence: Synthetic oligonucleotide
aaaccauucuguuauugu

SEQ ID NO: 53154 - RNA, 18 nt, Artificial Sequence
  Description of Artificial Sequence: Synthetic oligonucleotide
cuaggauaggaagucagg

SEQ ID NO: 53155 - RNA, 18 nt, Artificial Sequence
  Description of Artificial Sequence: Synthetic oligonucleotide
cuucccuaggauaggaag

SEQ ID NO: 53156 - RNA, 18 nt, Artificial Sequence
  Description of Artificial Sequence: Synthetic oligonucleotide
ggccccuucccuaggaua

SEQ ID NO: 53157 - RNA, 18 nt, Artificial Sequence
  Description of Artificial Sequence: Synthetic oligonucleotide
cagccggccccuucccua

SEQ ID NO: 53158 - RNA, 18 nt, Artificial Sequence
  Description of Artificial Sequence: Synthetic oligonucleotide
cucuccagccggccccuu

SEQ ID NO: 53159 - RNA, 18 nt, Artificial Sequence
  Description of Artificial Sequence: Synthetic oligonucleotide
cuggccucuccagccggc

SEQ ID NO: 53160 - RNA, 18 nt, Artificial Sequence
  Description of Artificial Sequence: Synthetic oligonucleotide
cuguccuggccucuccag

SEQ ID NO: 53161 - RNA, 18 nt, Artificial Sequence
  Description of Artificial Sequence: Synthetic oligonucleotide
uuucucuguccuggccuc

SEQ ID NO: 53162 - RNA, 18 nt, Artificial Sequence
  Description of Artificial Sequence: Synthetic oligonucleotide
ucugcuuucucuguccug

SEQ ID NO: 53163 - RNA, 18 nt, Artificial Sequence
  Description of Artificial Sequence: Synthetic oligonucleotide
agggaucugcuuucucug

SEQ ID NO: 53164 - RNA, 18 nt, Artificial Sequence
  Description of Artificial Sequence: Synthetic oligonucleotide
aaagaagggaucugcuuu

SEQ ID NO: 53165 - RNA, 18 nt, Artificial Sequence
  Description of Artificial Sequence: Synthetic oligonucleotide
uggaaaaagaagggaucu

SEQ ID NO: 53166 - RNA, 18 nt, Artificial Sequence
  Description of Artificial Sequence: Synthetic oligonucleotide
guccuuggaaaaagaagg

SEQ ID NO: 53167 - RNA, 18 nt, Artificial Sequence
  Description of Artificial Sequence: Synthetic oligonucleotide
acagaguccuuggaaaaa

SEQ ID NO: 53168 - RNA, 18 nt, Artificial Sequence
  Description of Artificial Sequence: Synthetic oligonucleotide
aagacacagaguccuugg

SEQ ID NO: 53169 - RNA, 18 nt, Artificial Sequence
  Description of Artificial Sequence: Synthetic oligonucleotide
uauggaagacacagaguc

SEQ ID NO: 53170 - RNA, 18 nt, Artificial Sequence
  Description of Artificial Sequence: Synthetic oligonucleotide
uugccuauggaagacaca

SEQ ID NO: 53171 - RNA, 18 nt, Artificial Sequence
  Description of Artificial Sequence: Synthetic oligonucleotide
acauguugccuauggaag

SEQ ID NO: 53172 - RNA, 18 nt, Artificial Sequence
  Description of Artificial Sequence: Synthetic oligonucleotide
uucugacauguugccuau

SEQ ID NO: 53173 - RNA, 18 nt, Artificial Sequence
  Description of Artificial Sequence: Synthetic oligonucleotide
ucucguucagcucauccu

SEQ ID NO: 53174 - RNA, 18 nt, Artificial Sequence
  Description of Artificial Sequence: Synthetic oligonucleotide
cucucucucguucagcuc

SEQ ID NO: 53175 - RNA, 18 nt, Artificial Sequence
  Description of Artificial Sequence: Synthetic oligonucleotide
gucuccucucucucguuc

SEQ ID NO: 53176 - RNA, 18 nt, Artificial Sequence
  Description of Artificial Sequence: Synthetic oligonucleotide
cccgggucuccucucucu

SEQ ID NO: 53177 - RNA, 18 nt, Artificial Sequence
  Description of Artificial Sequence: Synthetic oligonucleotide
cuccucccgggucuccuc

SEQ ID NO: 53178 - RNA, 18 nt, Artificial Sequence
  Description of Artificial Sequence: Synthetic oligonucleotide
acugccuccucccggguc

SEQ ID NO: 53179 - RNA, 18 nt, Artificial Sequence
  Description of Artificial Sequence: Synthetic oligonucleotide
cucgcacugccuccuccc

SEQ ID NO: 53180 - RNA, 18 nt, Artificial Sequence
  Description of Artificial Sequence: Synthetic oligonucleotide
cagcucucgcacugccuc

SEQ ID NO: 53181 - RNA, 18 nt, Artificial Sequence
  Description of Artificial Sequence: Synthetic oligonucleotide
uccugcagcucucgcacu

SEQ ID NO: 53182 - RNA, 18 nt, Artificial Sequence
  Description of Artificial Sequence: Synthetic oligonucleotide
ccaucuccugcagcucuc

SEQ ID NO: 53183 - RNA, 18 nt, Artificial Sequence
  Description of Artificial Sequence: Synthetic oligonucleotide
cugcaccaucuccugcag

SEQ ID NO: 53184 - RNA, 18 nt, Artificial Sequence
  Description of Artificial Sequence: Synthetic oligonucleotide
ugcgccugcaccaucucc

SEQ ID NO: 53185 - RNA, 18 nt, Artificial Sequence
  Description of Artificial Sequence: Synthetic oligonucleotide
ccgccugcgccugcacca

SEQ ID NO: 53186 - RNA, 18 nt, Artificial Sequence
  Description of Artificial Sequence: Synthetic oligonucleotide
cgaggccgccugcgccug

SEQ ID NO: 53187 - RNA, 18 nt, Artificial Sequence
  Description of Artificial Sequence: Synthetic oligonucleotide
ucccccgaggccgccugc

SEQ ID NO: 53188 - RNA, 18 nt, Artificial Sequence
  Description of Artificial Sequence: Synthetic oligonucleotide
gcuccucccccgaggccg

SEQ ID NO: 53189 - RNA, 18 nt, Artificial Sequence
  Description of Artificial Sequence: Synthetic oligonucleotide
cgccagcuccucccccga

SEQ ID NO: 53190 - RNA, 18 nt, Artificial Sequence
  Description of Artificial Sequence: Synthetic oligonucleotide
gccaccgccagcuccucc

SEQ ID NO: 53191 - RNA, 18 nt, Artificial Sequence
  Description of Artificial Sequence: Synthetic oligonucleotide
ccacggccaccgccagcu

SEQ ID NO: 53192 - RNA, 18 nt, Artificial Sequence
  Description of Artificial Sequence: Synthetic oligonucleotide
cuccgccacggccaccgc

SEQ ID NO: 53193 - RNA, 18 nt, Artificial Sequence
  Description of Artificial Sequence: Synthetic oligonucleotide
acccucuccgccacggcc

SEQ ID NO: 53194 - RNA, 18 nt, Artificial Sequence
  Description of Artificial Sequence: Synthetic oligonucleotide
cuugcacccucuccgcca

SEQ ID NO: 53195 - RNA, 18 nt, Artificial Sequence
  Description of Artificial Sequence: Synthetic oligonucleotide
cuucucuugcacccucuc

SEQ ID NO: 53196 - RNA, 18 nt, Artificial Sequence
  Description of Artificial Sequence: Synthetic oligonucleotide
cuguccuucucuugcacc

SEQ ID NO: 53197 - RNA, 18 nt, Artificial Sequence
  Description of Artificial Sequence: Synthetic oligonucleotide
agccgcuguccuucucuu

SEQ ID NO: 53198 - RNA, 18 nt, Artificial Sequence
  Description of Artificial Sequence: Synthetic oligonucleotide
gaagaagccgcuguccuu

SEQ ID NO: 53199 - RNA, 18 nt, Artificial Sequence
  Description of Artificial Sequence: Synthetic oligonucleotide
cgcaggaagaagccgcug

SEQ ID NO: 53200 - RNA, 18 nt, Artificial Sequence
  Description of Artificial Sequence: Synthetic oligonucleotide
ugaagcgcaggaagaagc

SEQ ID NO: 53201 - RNA, 18 nt, Artificial Sequence
  Description of Artificial Sequence: Synthetic oligonucleotide
gcggaugaagcgcaggaa

SEQ ID NO: 53202 - RNA, 18 nt, Artificial Sequence
  Description of Artificial Sequence: Synthetic oligonucleotide
cgugcgcggaugaagcgc

SEQ ID NO: 53203 - RNA, 18 nt, Artificial Sequence
  Description of Artificial Sequence: Synthetic oligonucleotide
acuuccgugcgcggauga

SEQ ID NO: 53204 - RNA, 18 nt, Artificial Sequence
  Description of Artificial Sequence: Synthetic oligonucleotide
guugaacuuccgugcgcg

SEQ ID NO: 53205 - RNA, 18 nt, Artificial Sequence
  Description of Artificial Sequence: Synthetic oligonucleotide
cccacguugaacuuccgu

SEQ ID NO: 53206 - RNA, 18 nt, Artificial Sequence
  Description of Artificial Sequence: Synthetic oligonucleotide
cacggcccacguugaacu

SEQ ID NO: 53207 - RNA, 18 nt, Artificial Sequence
  Description of Artificial Sequence: Synthetic oligonucleotide
auaggcacggcccacguu

SEQ ID NO: 53208 - RNA, 18 nt, Artificial Sequence
  Description of Artificial Sequence: Synthetic oligonucleotide
agcucauaggcacggccc

SEQ ID NO: 53209 - RNA, 18 nt, Artificial Sequence
  Description of Artificial Sequence: Synthetic oligonucleotide
ugagcagcucauaggcac

SEQ ID NO: 53210 - RNA, 18 nt, Artificial Sequence
  Description of Artificial Sequence: Synthetic oligonucleotide
gucccuccaagcacuggc

SEQ ID NO: 53211 - RNA, 18 nt, Artificial Sequence
  Description of Artificial Sequence: Synthetic oligonucleotide
gggccgucccuccaagca

SEQ ID NO: 53212 - RNA, 18 nt, Artificial Sequence
  Description of Artificial Sequence: Synthetic oligonucleotide
ucccagggccgucccucc

SEQ ID NO: 53213 - RNA, 18 nt, Artificial Sequence
  Description of Artificial Sequence: Synthetic oligonucleotide
cgucuucccagggccguc

SEQ ID NO: 53214 - RNA, 18 nt, Artificial Sequence
  Description of Artificial Sequence: Synthetic oligonucleotide
ccucccgucuucccaggg

SEQ ID NO: 53215 - RNA, 18 nt, Artificial Sequence
  Description of Artificial Sequence: Synthetic oligonucleotide
cauggccucccgucuucc

SEQ ID NO: 53216 - RNA, 18 nt, Artificial Sequence
  Description of Artificial Sequence: Synthetic oligonucleotide
auccucauggccucccgu

SEQ ID NO: 53217 - RNA, 18 nt, Artificial Sequence
  Description of Artificial Sequence: Synthetic oligonucleotide
auagcauccucauggccu

SEQ ID NO: 53218 - RNA, 18 nt, Artificial Sequence
  Description of Artificial Sequence: Synthetic oligonucleotide
agcggauagcauccucau

SEQ ID NO: 53219 - RNA, 18 nt, Artificial Sequence
  Description of Artificial Sequence: Synthetic oligonucleotide
augagagcggauagcauc

SEQ ID NO: 53220 - RNA, 18 nt, Artificial Sequence
  Description of Artificial Sequence: Synthetic oligonucleotide
ccaggaugagagcggaua

SEQ ID NO: 53221 - RNA, 18 nt, Artificial Sequence
  Description of Artificial Sequence: Synthetic oligonucleotide
cagugccaggaugagagc

SEQ ID NO: 53222 - RNA, 18 nt, Artificial Sequence
  Description of Artificial Sequence: Synthetic oligonucleotide
cuguucagugccaggaug

SEQ ID NO: 53223 - RNA, 18 nt, Artificial Sequence
  Description of Artificial Sequence: Synthetic oligonucleotide
caggccuguucagugcca

SEQ ID NO: 53224 - RNA, 18 nt, Artificial Sequence
  Description of Artificial Sequence: Synthetic oligonucleotide
ggaagcaggccuguucag

SEQ ID NO: 53225 - RNA, 18 nt, Artificial Sequence
  Description of Artificial Sequence: Synthetic oligonucleotide
aguauggaagcaggccug

SEQ ID NO: 53226 - RNA, 18 nt, Artificial Sequence
  Description of Artificial Sequence: Synthetic oligonucleotide
cccacaguauggaagcag

SEQ ID NO: 53227 - RNA, 18 nt, Artificial Sequence
  Description of Artificial Sequence: Synthetic oligonucleotide
acuugcccacaguaugga

SEQ ID NO: 53228 - RNA, 18 nt, Artificial Sequence
  Description of Artificial Sequence: Synthetic oligonucleotide
aacugacuugcccacagu

SEQ ID NO: 53229 - RNA, 18 nt, Artificial Sequence
  Description of Artificial Sequence: Synthetic oligonucleotide
agagaaacugacuugccc

SEQ ID NO: 53230 - RNA, 18 nt, Artificial Sequence
  Description of Artificial Sequence: Synthetic oligonucleotide
ggcucagagaaacugacu

SEQ ID NO: 53231 - RNA, 18 nt, Artificial Sequence
  Description of Artificial Sequence: Synthetic oligonucleotide
guggaggcucagagaaac

SEQ ID NO: 53232 - RNA, 18 nt, Artificial Sequence
  Description of Artificial Sequence: Synthetic oligonucleotide
aggauguggaggcucaga

SEQ ID NO: 53233 - RNA, 18 nt, Artificial Sequence
  Description of Artificial Sequence: Synthetic oligonucleotide
agguaaggauguggaggc

SEQ ID NO: 53234 - RNA, 18 nt, Artificial Sequence
  Description of Artificial Sequence: Synthetic oligonucleotide
uuuacagguaaggaugug

SEQ ID NO: 53235 - RNA, 18 nt, Artificial Sequence
  Description of Artificial Sequence: Synthetic oligonucleotide
cccauuuuacagguaagg

SEQ ID NO: 53236 - RNA, 18 nt, Artificial Sequence
  Description of Artificial Sequence: Synthetic oligonucleotide
gcugacccauuuuacagg

SEQ ID NO: 53237 - RNA, 18 nt, Artificial Sequence
  Description of Artificial Sequence: Synthetic oligonucleotide
ucagagcugacccauuuu

SEQ ID NO: 53238 - RNA, 18 nt, Artificial Sequence
  Description of Artificial Sequence: Synthetic oligonucleotide
cauuaucagagcugaccc

SEQ ID NO: 53239 - RNA, 18 nt, Artificial Sequence
  Description of Artificial Sequence: Synthetic oligonucleotide
ucgcucauuaucagagcu

SEQ ID NO: 53240 - RNA, 18 nt, Artificial Sequence
  Description of Artificial Sequence: Synthetic oligonucleotide
uucguucgcucauuauca

SEQ ID NO: 53241 - RNA, 18 nt, Artificial Sequence
  Description of Artificial Sequence: Synthetic oligonucleotide
auucauucguucgcucau

SEQ ID NO: 53242 - RNA, 18 nt, Artificial Sequence
  Description of Artificial Sequence: Synthetic oligonucleotide
cauucauucauucguucg

SEQ ID NO: 53243 - RNA, 18 nt, Artificial Sequence
  Description of Artificial Sequence: Synthetic oligonucleotide
cacuucauucauucauuc

SEQ ID NO: 53244 - RNA, 18 nt, Artificial Sequence
  Description of Artificial Sequence: Synthetic oligonucleotide
ugacacacuucauucauu

SEQ ID NO: 53245 - RNA, 18 nt, Artificial Sequence
  Description of Artificial Sequence: Synthetic oligonucleotide
gcuccugacacacuucau

SEQ ID NO: 53246 - RNA, 18 nt, Artificial Sequence
  Description of Artificial Sequence: Synthetic oligonucleotide
aaucugcuccugacacac

SEQ ID NO: 53247 - RNA, 18 nt, Artificial Sequence
  Description of Artificial Sequence: Synthetic oligonucleotide
ccagaaaucugcuccuga

SEQ ID NO: 53248 - RNA, 18 nt, Artificial Sequence
  Description of Artificial Sequence: Synthetic oligonucleotide
gaccuccagaaaucugcu

SEQ ID NO: 53249 - RNA, 18 nt, Artificial Sequence
  Description of Artificial Sequence: Synthetic oligonucleotide
acucagaccuccagaaau

SEQ ID NO: 53250 - RNA, 18 nt, Artificial Sequence
  Description of Artificial Sequence: Synthetic oligonucleotide
agaggacucagaccucca

SEQ ID NO: 53251 - RNA, 18 nt, Artificial Sequence
  Description of Artificial Sequence: Synthetic oligonucleotide
aguugagaggacucagac

SEQ ID NO: 53252 - RNA, 18 nt, Artificial Sequence
  Description of Artificial Sequence: Synthetic oligonucleotide
gagagaguugagaggacu

SEQ ID NO: 53253 - RNA, 18 nt, Artificial Sequence
  Description of Artificial Sequence: Synthetic oligonucleotide
acugggagagaguugaga

SEQ ID NO: 53254 - RNA, 18 nt, Artificial Sequence
  Description of Artificial Sequence: Synthetic oligonucleotide
ccaagacugggagagagu

SEQ ID NO: 53255 - RNA, 18 nt, Artificial Sequence
  Description of Artificial Sequence: Synthetic oligonucleotide
gaaucccaagacugggag

SEQ ID NO: 53256 - RNA, 18 nt, Artificial Sequence
  Description of Artificial Sequence: Synthetic oligonucleotide
ucauugaaucccaagacu

SEQ ID NO: 53257 - RNA, 18 nt, Artificial Sequence
  Description of Artificial Sequence: Synthetic oligonucleotide
uuuacucauugaauccca

SEQ ID NO: 53258 - RNA, 18 nt, Artificial Sequence
  Description of Artificial Sequence: Synthetic oligonucleotide
caaguuuuacucauugaa

SEQ ID NO: 53259 - RNA, 18 nt, Artificial Sequence
  Description of Artificial Sequence: Synthetic oligonucleotide
guacccaaguuuuacuca

SEQ ID NO: 53260 - RNA, 18 nt, Artificial Sequence
  Description of Artificial Sequence: Synthetic oligonucleotide
ggguacccaaguuuuacu

SEQ ID NO: 53261 - RNA, 18 nt, Artificial Sequence
  Description of Artificial Sequence: Synthetic oligonucleotide
ccucgucacccaaauggg

SEQ ID NO: 53262 - RNA, 18 nt, Artificial Sequence
  Description of Artificial Sequence: Synthetic oligonucleotide
ccuccccucgucacccaa

SEQ ID NO: 53263 - RNA, 18 nt, Artificial Sequence
  Description of Artificial Sequence: Synthetic oligonucleotide
aaauuccuccccucguca

SEQ ID NO: 53264 - RNA, 18 nt, Artificial Sequence
  Description of Artificial Sequence: Synthetic oligonucleotide
gggaaauuccuccccucg

SEQ ID NO: 53265 - RNA, 18 nt, Artificial Sequence
  Description of Artificial Sequence: Synthetic oligonucleotide
uuagguucucaugguggg

SEQ ID NO: 53266 - RNA, 18 nt, Artificial Sequence
  Description of Artificial Sequence: Synthetic oligonucleotide
aaagcuuagguucucaug

SEQ ID NO: 53267 - RNA, 18 nt, Artificial Sequence
  Description of Artificial Sequence: Synthetic oligonucleotide
gagccaaagcuuagguuc

SEQ ID NO: 53268 - RNA, 18 nt, Artificial Sequence
  Description of Artificial Sequence: Synthetic oligonucleotide
uuccagagccaaagcuua

SEQ ID NO: 53269 - RNA, 18 nt, Artificial Sequence
  Description of Artificial Sequence: Synthetic oligonucleotide
cagcauuccagagccaaa

SEQ ID NO: 53270 - RNA, 18 nt, Artificial Sequence
  Description of Artificial Sequence: Synthetic oligonucleotide
uccugcagcauuccagag

SEQ ID NO: 53271 - RNA, 18 nt, Artificial Sequence
  Description of Artificial Sequence: Synthetic oligonucleotide
caccuuccugcagcauuc

SEQ ID NO: 53272 - RNA, 18 nt, Artificial Sequence
  Description of Artificial Sequence: Synthetic oligonucleotide
cuauccaccuuccugcag

SEQ ID NO: 53273 - RNA, 18 nt, Artificial Sequence
  Description of Artificial Sequence: Synthetic oligonucleotide
aggcacuauccaccuucc

SEQ ID NO: 53274 - RNA, 18 nt, Artificial Sequence
  Description of Artificial Sequence: Synthetic oligonucleotide
gagagaggcacuauccac

SEQ ID NO: 53275 - RNA, 18 nt, Artificial Sequence
  Description of Artificial Sequence: Synthetic oligonucleotide
gcccugagagaggcacua

SEQ ID NO: 53276 - RNA, 18 nt, Artificial Sequence
  Description of Artificial Sequence: Synthetic oligonucleotide
uaacugcccugagagagg

SEQ ID NO: 53277 - RNA, 18 nt, Artificial Sequence
  Description of Artificial Sequence: Synthetic oligonucleotide
uuagguaacugcccugag

SEQ ID NO: 53278 - RNA, 18 nt, Artificial Sequence
  Description of Artificial Sequence: Synthetic oligonucleotide
gaggcuuagguaacugcc

SEQ ID NO: 53279 - RNA, 18 nt, Artificial Sequence
  Description of Artificial Sequence: Synthetic oligonucleotide
cacaugaggcuuagguaa

SEQ ID NO: 53280 - RNA, 18 nt, Artificial Sequence
  Description of Artificial Sequence: Synthetic oligonucleotide
cacugcacaugaggcuua

SEQ ID NO: 53281 - RNA, 18 nt, Artificial Sequence
  Description of Artificial Sequence: Synthetic oligonucleotide
aguuccacugcacaugag

SEQ ID NO: 53282 - RNA, 18 nt, Artificial Sequence
  Description of Artificial Sequence: Synthetic oligonucleotide
ucuucaguuccacugcac

SEQ ID NO: 53283 - RNA, 18 nt, Artificial Sequence
  Description of Artificial Sequence: Synthetic oligonucleotide
caccaucuucaguuccac

SEQ ID NO: 53284 - RNA, 18 nt, Artificial Sequence
  Description of Artificial Sequence: Synthetic oligonucleotide
ucugacaccaucuucagu

SEQ ID NO: 53285 - RNA, 18 nt, Artificial Sequence
  Description of Artificial Sequence: Synthetic oligonucleotide
ccaggucugacaccaucu

SEQ ID NO: 53286 - RNA, 18 nt, Artificial Sequence
  Description of Artificial Sequence: Synthetic oligonucleotide
cauucccaggucugacac

SEQ ID NO: 53287 - RNA, 18 nt, Artificial Sequence
  Description of Artificial Sequence: Synthetic oligonucleotide
ggguucauucccaggucu

SEQ ID NO: 53288 - RNA, 18 nt, Artificial Sequence
  Description of Artificial Sequence: Synthetic oligonucleotide
ccagagcgguucuguccc

SEQ ID NO: 53289 - RNA, 18 nt, Artificial Sequence
  Description of Artificial Sequence: Synthetic oligonucleotide
cagugccagagcgguucu

SEQ ID NO: 53290 - RNA, 18 nt, Artificial Sequence
  Description of Artificial Sequence: Synthetic oligonucleotide
gccagcagugccagagcg

SEQ ID NO: 53291 - RNA, 18 nt, Artificial Sequence
  Description of Artificial Sequence: Synthetic oligonucleotide
auccagccagcagugcca

SEQ ID NO: 53292 - RNA, 18 nt, Artificial Sequence
  Description of Artificial Sequence: Synthetic oligonucleotide
ucuucauccagccagcag

SEQ ID NO: 53293 - RNA, 18 nt, Artificial Sequence
  Description of Artificial Sequence: Synthetic oligonucleotide
uccugucuucauccagcc

SEQ ID NO: 53294 - RNA, 18 nt, Artificial Sequence
  Description of Artificial Sequence: Synthetic oligonucleotide
aggcauccugucuucauc

SEQ ID NO: 53295 - RNA, 18 nt, Artificial Sequence
  Description of Artificial Sequence: Synthetic oligonucleotide
ucuugaggcauccugucu

SEQ ID NO: 53296 - RNA, 18 nt, Artificial Sequence
  Description of Artificial Sequence: Synthetic oligonucleotide
ugauuucuugaggcaucc

SEQ ID NO: 53297 - RNA, 18 nt, Artificial Sequence
  Description of Artificial Sequence: Synthetic oligonucleotide
gccgaugauuucuugagg

SEQ ID NO: 53298 - RNA, 18 nt, Artificial Sequence
  Description of Artificial Sequence: Synthetic oligonucleotide
aaccggccgaugauuucu

SEQ ID NO: 53299 - RNA, 18 nt, Artificial Sequence
  Description of Artificial Sequence: Synthetic oligonucleotide
accgcaaccggccgauga

SEQ ID NO: 53300 - RNA, 18 nt, Artificial Sequence
  Description of Artificial Sequence: Synthetic oligonucleotide
gagccaccgcaaccggcc

SEQ ID NO: 53301 - RNA, 18 nt, Artificial Sequence
  Description of Artificial Sequence: Synthetic oligonucleotide
ugagcaguuccccaccuc

SEQ ID NO: 53302 - RNA, 18 nt, Artificial Sequence
  Description of Artificial Sequence: Synthetic oligonucleotide
cauccugagcaguucccc

SEQ ID NO: 53303 - RNA, 18 nt, Artificial Sequence
  Description of Artificial Sequence: Synthetic oligonucleotide
uuacccauccugagcagu

SEQ ID NO: 53304 - RNA, 18 nt, Artificial Sequence
  Description of Artificial Sequence: Synthetic oligonucleotide
cauccuuacccauccuga

SEQ ID NO: 53305 - RNA, 18 nt, Artificial Sequence
  Description of Artificial Sequence: Synthetic oligonucleotide
aacaccauccuuacccau

SEQ ID NO: 53306 - RNA, 18 nt, Artificial Sequence
  Description of Artificial Sequence: Synthetic oligonucleotide
ccacaaacaccauccuua

SEQ ID NO: 53307 - RNA, 18 nt, Artificial Sequence
  Description of Artificial Sequence: Synthetic oligonucleotide
acgguccacaaacaccau

SEQ ID NO: 53308 - RNA, 18 nt, Artificial Sequence
  Description of Artificial Sequence: Synthetic oligonucleotide
ccucuacgguccacaaac

SEQ ID NO: 53309 - RNA, 18 nt, Artificial Sequence
  Description of Artificial Sequence: Synthetic oligonucleotide
cagcaccucuacggucca

SEQ ID NO: 53310 - RNA, 18 nt, Artificial Sequence
  Description of Artificial Sequence: Synthetic oligonucleotide
uccagcagcaccucuacg

SEQ ID NO: 53311 - RNA, 18 nt, Artificial Sequence
  Description of Artificial Sequence: Synthetic oligonucleotide
cugauuccagcagcaccu

SEQ ID NO: 53312 - RNA, 18 nt, Artificial Sequence
  Description of Artificial Sequence: Synthetic oligonucleotide
agcuccugauuccagcag

SEQ ID NO: 53313 - RNA, 18 nt, Artificial Sequence
  Description of Artificial Sequence: Synthetic oligonucleotide
cacagagcuccugauucc

SEQ ID NO: 53314 - RNA, 18 nt, Artificial Sequence
  Description of Artificial Sequence: Synthetic oligonucleotide
caggacacagagcuccug

SEQ ID NO: 53315 - RNA, 18 nt, Artificial Sequence
  Description of Artificial Sequence: Synthetic oligonucleotide
ccaagcaggacacagagc

SEQ ID NO: 53316 - RNA, 18 nt, Artificial Sequence
  Description of Artificial Sequence: Synthetic oligonucleotide
aaaccccaagcaggacac

SEQ ID NO: 53317 - RNA, 18 nt, Artificial Sequence
  Description of Artificial Sequence: Synthetic oligonucleotide
aauccaaaccccaagcag

SEQ ID NO: 53318 - RNA, 18 nt, Artificial Sequence
  Description of Artificial Sequence: Synthetic oligonucleotide
aguaaaauccaaacccca

SEQ ID NO: 53319 - RNA, 18 nt, Artificial Sequence
  Description of Artificial Sequence: Synthetic oligonucleotide
ucccaaguaaaauccaaa

SEQ ID NO: 53320 - RNA, 18 nt, Artificial Sequence
  Description of Artificial Sequence: Synthetic oligonucleotide
gaagcucccaaguaaaau

SEQ ID NO: 53321 - RNA, 18 nt, Artificial Sequence
  Description of Artificial Sequence: Synthetic oligonucleotide
gaggagaagcucccaagu

SEQ ID NO: 53322 - RNA, 18 nt, Artificial Sequence
  Description of Artificial Sequence: Synthetic oligonucleotide
gggcugaggagaagcucc

SEQ ID NO: 53323 - RNA, 18 nt, Artificial Sequence
  Description of Artificial Sequence: Synthetic oligonucleotide
gcacagggcugaggagaa

SEQ ID NO: 53324 - RNA, 18 nt, Artificial Sequence
  Description of Artificial Sequence: Synthetic oligonucleotide
ggugugcacagggcugag

SEQ ID NO: 53325 - RNA, 18 nt, Artificial Sequence
  Description of Artificial Sequence: Synthetic oligonucleotide
ggugaggugugcacaggg

SEQ ID NO: 53326 - RNA, 18 nt, Artificial Sequence
  Description of Artificial Sequence: Synthetic oligonucleotide
ugaguggugaggugugca

SEQ ID NO: 53327 - RNA, 18 nt, Artificial Sequence
  Description of Artificial Sequence: Synthetic oligonucleotide
uaagcugaguggugaggu

SEQ ID NO: 53328 - RNA, 18 nt, Artificial Sequence
  Description of Artificial Sequence: Synthetic oligonucleotide
caggauaagcugaguggu

SEQ ID NO: 53329 - RNA, 18 nt, Artificial Sequence
  Description of Artificial Sequence: Synthetic oligonucleotide
gggcacaggauaagcuga

SEQ ID NO: 53330 - RNA, 18 nt, Artificial Sequence
  Description of Artificial Sequence: Synthetic oligonucleotide
cagcugggcacaggauaa

SEQ ID NO: 53331 - RNA, 18 nt, Artificial Sequence
  Description of Artificial Sequence: Synthetic oligonucleotide
uuuuucagcugggcacag

SEQ ID NO: 53332 - RNA, 18 nt, Artificial Sequence
  Description of Artificial Sequence: Synthetic oligonucleotide
acagauuuuucagcuggg

SEQ ID NO: 53333 - RNA, 18 nt, Artificial Sequence
  Description of Artificial Sequence: Synthetic oligonucleotide
aagacacagauuuuucag

SEQ ID NO: 53334 - RNA, 18 nt, Artificial Sequence
  Description of Artificial Sequence: Synthetic oligonucleotide
gggacaagacacagauuu

SEQ ID NO: 53335 - RNA, 18 nt, Artificial Sequence
  Description of Artificial Sequence: Synthetic oligonucleotide
uauuuucuuccccauggg

SEQ ID NO: 53336 - RNA, 18 nt, Artificial Sequence
  Description of Artificial Sequence: Synthetic oligonucleotide
uuauuuucuuccccaugg

SEQ ID NO: 53337 - RNA, 18 nt, Artificial Sequence
  Description of Artificial Sequence: Synthetic oligonucleotide
acuuguuauuuucuuccc

SEQ ID NO: 53338 - RNA, 18 nt, Artificial Sequence
  Description of Artificial Sequence: Synthetic oligonucleotide
ucauuacuuguuauuuuc

SEQ ID NO: 53339 - RNA, 18 nt, Artificial Sequence
  Description of Artificial Sequence: Synthetic oligonucleotide
gauaaucauuacuuguua

SEQ ID NO: 53340 - RNA, 18 nt, Artificial Sequence
  Description of Artificial Sequence: Synthetic oligonucleotide
augaggauaaucauuacu

SEQ ID NO: 53341 - RNA, 18 nt, Artificial Sequence
  Description of Artificial Sequence: Synthetic oligonucleotide
uaaauaugaggauaauca

SEQ ID NO: 53342 - RNA, 18 nt, Artificial Sequence
  Description of Artificial Sequence: Synthetic oligonucleotide
agucuuaaauaugaggau

SEQ ID NO: 53343 - RNA, 18 nt, Artificial Sequence
  Description of Artificial Sequence: Synthetic oligonucleotide
ggcauagucuuaaauaug

SEQ ID NO: 53344 - RNA, 18 nt, Artificial Sequence
  Description of Artificial Sequence: Synthetic oligonucleotide
caugaggcauagucuuaa

SEQ ID NO: 53345 - RNA, 18 nt, Artificial Sequence
  Description of Artificial Sequence: Synthetic oligonucleotide
gcaaacaugaggcauagu

SEQ ID NO: 53346 - RNA, 18 nt, Artificial Sequence
  Description of Artificial Sequence: Synthetic oligonucleotide
cuugggcaaacaugaggc

SEQ ID NO: 53347 - RNA, 18 nt, Artificial Sequence
  Description of Artificial Sequence: Synthetic oligonucleotide
auaagcuugggcaaacau

SEQ ID NO: 53348 - RNA, 18 nt, Artificial Sequence
  Description of Artificial Sequence: Synthetic oligonucleotide
ucaucauaagcuugggca

SEQ ID NO: 53349 - RNA, 18 nt, Artificial Sequence
  Description of Artificial Sequence: Synthetic oligonucleotide
aaacaucaucauaagcuu

SEQ ID NO: 53350 - RNA, 18 nt, Artificial Sequence
  Description of Artificial Sequence: Synthetic oligonucleotide
gguguaaacaucaucaua

SEQ ID NO: 53351 - RNA, 18 nt, Artificial Sequence
  Description of Artificial Sequence: Synthetic oligonucleotide
uucaagguguaaacauca

SEQ ID NO: 53352 - RNA, 18 nt, Artificial Sequence
  Description of Artificial Sequence: Synthetic oligonucleotide
ugagauucaagguguaaa

SEQ ID NO: 53353 - RNA, 18 nt, Artificial Sequence
  Description of Artificial Sequence: Synthetic oligonucleotide
ucaaaugagauucaaggu

SEQ ID NO: 53354 - RNA, 18 nt, Artificial Sequence
  Description of Artificial Sequence: Synthetic oligonucleotide
ggcaaucaaaugagauuc

SEQ ID NO: 53355 - RNA, 18 nt, Artificial Sequence
  Description of Artificial Sequence: Synthetic oligonucleotide
guuguggcaaucaaauga

SEQ ID NO: 53356 - RNA, 18 nt, Artificial Sequence
  Description of Artificial Sequence: Synthetic oligonucleotide
aaauuguuguggcaauca

SEQ ID NO: 53357 - RNA, 18 nt, Artificial Sequence
  Description of Artificial Sequence: Synthetic oligonucleotide
ucaccaaauuguuguggc

SEQ ID NO: 53358 - RNA, 18 nt, Artificial Sequence
  Description of Artificial Sequence: Synthetic oligonucleotide
cuaucucaccaaauuguu

SEQ ID NO: 53359 - RNA, 18 nt, Artificial Sequence
  Description of Artificial Sequence: Synthetic oligonucleotide
guggccuaucucaccaaa

SEQ ID NO: 53360 - RNA, 18 nt, Artificial Sequence
  Description of Artificial Sequence: Synthetic oligonucleotide
agauaguggccuaucuca

SEQ ID NO: 53361 - RNA, 18 nt, Artificial Sequence
  Description of Artificial Sequence: Synthetic oligonucleotide
agucuagauaguggccua

SEQ ID NO: 53362 - RNA, 18 nt, Artificial Sequence
  Description of Artificial Sequence: Synthetic oligonucleotide
uagauagucuagauagug

SEQ ID NO: 53363 - RNA, 18 nt, Artificial Sequence
  Description of Artificial Sequence: Synthetic oligonucleotide
uauucuagauagucuaga

SEQ ID NO: 53364 - RNA, 18 nt, Artificial Sequence
  Description of Artificial Sequence: Synthetic oligonucleotide
cuaucuauucuagauagu

SEQ ID NO: 53365 - RNA, 18 nt, Artificial Sequence
  Description of Artificial Sequence: Synthetic oligonucleotide
uugaccuaucuauucuag

SEQ ID NO: 53366 - RNA, 18 nt, Artificial Sequence
  Description of Artificial Sequence: Synthetic oligonucleotide
cgauauugaccuaucuau

SEQ ID NO: 53367 - RNA, 18 nt, Artificial Sequence
  Description of Artificial Sequence: Synthetic oligonucleotide
gaucucgauauugaccua

SEQ ID NO: 53368 - RNA, 18 nt, Artificial Sequence
  Description of Artificial Sequence: Synthetic oligonucleotide
aaugggaucucgauauug

SEQ ID NO: 53369 - RNA, 18 nt, Artificial Sequence
  Description of Artificial Sequence: Synthetic oligonucleotide
caaaaaaugggaucucga

SEQ ID NO: 53370 - RNA, 18 nt, Artificial Sequence
  Description of Artificial Sequence: Synthetic oligonucleotide
cucuccaaaaaaugggau

SEQ ID NO: 53371 - RNA, 18 nt, Artificial Sequence
  Description of Artificial Sequence: Synthetic oligonucleotide
guuuccucuccaaaaaau

SEQ ID NO: 53372 - RNA, 18 nt, Artificial Sequence
  Description of Artificial Sequence: Synthetic oligonucleotide
cccauguuuccucuccaa

SEQ ID NO: 53373 - RNA, 18 nt, Artificial Sequence
  Description of Artificial Sequence: Synthetic oligonucleotide
cgagccccauguuuccuc

SEQ ID NO: 53374 - RNA, 18 nt, Artificial Sequence
  Description of Artificial Sequence: Synthetic oligonucleotide
cuauccgagccccauguu

SEQ ID NO: 53375 - RNA, 18 nt, Artificial Sequence
  Description of Artificial Sequence: Synthetic oligonucleotide
ucaaccuauccgagcccc

SEQ ID NO: 53376 - RNA, 18 nt, Artificial Sequence
  Description of Artificial Sequence: Synthetic oligonucleotide
gcuacucaaccuauccga

SEQ ID NO: 53377 - RNA, 18 nt, Artificial Sequence
  Description of Artificial Sequence: Synthetic oligonucleotide
agcuggcuacucaaccua

SEQ ID NO: 53378 - RNA, 18 nt, Artificial Sequence
  Description of Artificial Sequence: Synthetic oligonucleotide
gaccgagcuggcuacuca

SEQ ID NO: 53379 - RNA, 18 nt, Artificial Sequence
  Description of Artificial Sequence: Synthetic oligonucleotide
ugugugaccgagcuggcu

SEQ ID NO: 53380 - RNA, 18 nt, Artificial Sequence
  Description of Artificial Sequence: Synthetic oligonucleotide
uccuaugugugaccgagc

SEQ ID NO: 53381 - RNA, 18 nt, Artificial Sequence
  Description of Artificial Sequence: Synthetic oligonucleotide
ccagguccuaugugugac

SEQ ID NO: 53382 - RNA, 18 nt, Artificial Sequence
  Description of Artificial Sequence: Synthetic oligonucleotide
uccugccagguccuaugu

SEQ ID NO: 53383 - RNA, 18 nt, Artificial Sequence
  Description of Artificial Sequence: Synthetic oligonucleotide
ugaccuccugccaggucc

SEQ ID NO: 53384 - RNA, 18 nt, Artificial Sequence
  Description of Artificial Sequence: Synthetic oligonucleotide
agaccugaccuccugcca

SEQ ID NO: 53385 - RNA, 18 nt, Artificial Sequence
  Description of Artificial Sequence: Synthetic oligonucleotide
cucagagaccugaccucc

SEQ ID NO: 53386 - RNA, 18 nt, Artificial Sequence
  Description of Artificial Sequence: Synthetic oligonucleotide
ugggacucagagaccuga

SEQ ID NO: 53387 - RNA, 18 nt, Artificial Sequence
  Description of Artificial Sequence: Synthetic oligonucleotide
ccuagugggacucagaga

SEQ ID NO: 53388 - RNA, 18 nt, Artificial Sequence
  Description of Artificial Sequence: Synthetic oligonucleotide
ucccuccuagugggacuc

SEQ ID NO: 53389 - RNA, 18 nt, Artificial Sequence
  Description of Artificial Sequence: Synthetic oligonucleotide
ccccaucccuccuagugg

SEQ ID NO: 53390 - RNA, 18 nt, Artificial Sequence
  Description of Artificial Sequence: Synthetic oligonucleotide
cccuaccccaucccuccu

SEQ ID NO: 53391 - RNA, 18 nt, Artificial Sequence
  Description of Artificial Sequence: Synthetic oligonucleotide
cccaucccuaccccaucc

SEQ ID NO: 53392 - RNA, 18 nt, Artificial Sequence
  Description of Artificial Sequence: Synthetic oligonucleotide
gccaucccaucccuaccc

SEQ ID NO: 53393 - RNA, 18 nt, Artificial Sequence
  Description of Artificial Sequence: Synthetic oligonucleotide
agggagccaucccauccc

SEQ ID NO: 53394 - RNA, 18 nt, Artificial Sequence
  Description of Artificial Sequence: Synthetic oligonucleotide
cccucagggagccauccc

SEQ ID NO: 53395 - RNA, 18 nt, Artificial Sequence
  Description of Artificial Sequence: Synthetic oligonucleotide
gaacccccucagggagcc

SEQ ID NO: 53396 - RNA, 18 nt, Artificial Sequence
  Description of Artificial Sequence: Synthetic oligonucleotide
cagaggaacccccucagg

SEQ ID NO: 53397 - RNA, 18 nt, Artificial Sequence
  Description of Artificial Sequence: Synthetic oligonucleotide
agccggaaauucacauag

SEQ ID NO: 53398 - RNA, 18 nt, Artificial Sequence
  Description of Artificial Sequence: Synthetic oligonucleotide
acugcagccggaaauuca

SEQ ID NO: 53399 - RNA, 18 nt, Artificial Sequence
  Description of Artificial Sequence: Synthetic oligonucleotide
aggguacugcagccggaa

SEQ ID NO: 53400 - RNA, 18 nt, Artificial Sequence
  Description of Artificial Sequence: Synthetic oligonucleotide
agcucaggguacugcagc

SEQ ID NO: 53401 - RNA, 18 nt, Artificial Sequence
  Description of Artificial Sequence: Synthetic oligonucleotide
caaagagcucaggguacu

SEQ ID NO: 53402 - RNA, 18 nt, Artificial Sequence
  Description of Artificial Sequence: Synthetic oligonucleotide
gcugucaaagagcucagg

SEQ ID NO: 53403 - RNA, 18 nt, Artificial Sequence
  Description of Artificial Sequence: Synthetic oligonucleotide
gacaggcugucaaagagc

SEQ ID NO: 53404 - RNA, 18 nt, Artificial Sequence
  Description of Artificial Sequence: Synthetic oligonucleotide
gggacaggcugucaaaga

SEQ ID NO: 53405 - RNA, 18 nt, Artificial Sequence
  Description of Artificial Sequence: Synthetic oligonucleotide
cagcggacagccucuggg

SEQ ID NO: 53406 - RNA, 18 nt, Artificial Sequence
  Description of Artificial Sequence: Synthetic oligonucleotide
uggugcagcggacagccu

SEQ ID NO: 53407 - RNA, 18 nt, Artificial Sequence
  Description of Artificial Sequence: Synthetic oligonucleotide
uucaauggugcagcggac

SEQ ID NO: 53408 - RNA, 18 nt, Artificial Sequence
  Description of Artificial Sequence: Synthetic oligonucleotide
ccagcuucaauggugcag

SEQ ID NO: 53409 - RNA, 18 nt, Artificial Sequence
  Description of Artificial Sequence: Synthetic oligonucleotide
gguagccagcuucaaugg

SEQ ID NO: 53410 - RNA, 18 nt, Artificial Sequence
  Description of Artificial Sequence: Synthetic oligonucleotide
accaggguagccagcuuc

SEQ ID NO: 53411 - RNA, 18 nt, Artificial Sequence
  Description of Artificial Sequence: Synthetic oligonucleotide
aggacaccaggguagcca

SEQ ID NO: 53412 - RNA, 18 nt, Artificial Sequence
  Description of Artificial Sequence: Synthetic oligonucleotide
uagagaggacaccagggu

SEQ ID NO: 53413 - RNA, 18 nt, Artificial Sequence
  Description of Artificial Sequence: Synthetic oligonucleotide
ccgacuagagaggacacc

SEQ ID NO: 53414 - RNA, 18 nt, Artificial Sequence
  Description of Artificial Sequence: Synthetic oligonucleotide
uugucccgacuagagagg

SEQ ID NO: 53415 - RNA, 18 nt, Artificial Sequence
  Description of Artificial Sequence: Synthetic oligonucleotide
cauacuugucccgacuag

SEQ ID NO: 53416 - RNA, 18 nt, Artificial Sequence
  Description of Artificial Sequence: Synthetic oligonucleotide
ucggccauacuugucccg

SEQ ID NO: 53417 - RNA, 18 nt, Artificial Sequence
  Description of Artificial Sequence: Synthetic oligonucleotide
accacucggccauacuug

SEQ ID NO: 53418 - RNA, 18 nt, Artificial Sequence
  Description of Artificial Sequence: Synthetic oligonucleotide
gcaugaccacucggccau

SEQ ID NO: 53419 - RNA, 18 nt, Artificial Sequence
  Description of Artificial Sequence: Synthetic oligonucleotide
gaagagcaugaccacucg

SEQ ID NO: 53420 - RNA, 18 nt, Artificial Sequence
  Description of Artificial Sequence: Synthetic oligonucleotide
auguugaagagcaugacc

SEQ ID NO: 53421 - RNA, 18 nt, Artificial Sequence
  Description of Artificial Sequence: Synthetic oligonucleotide
ucucaauguugaagagca

SEQ ID NO: 53422 - RNA, 18 nt, Artificial Sequence
  Description of Artificial Sequence: Synthetic oligonucleotide
ccaguucucaauguugaa

SEQ ID NO: 53423 - RNA, 18 nt, Artificial Sequence
  Description of Artificial Sequence: Synthetic oligonucleotide
cuuugccaguucucaaug

SEQ ID NO: 53424 - RNA, 18 nt, Artificial Sequence
  Description of Artificial Sequence: Synthetic oligonucleotide
cuugacuuugccaguucu

SEQ ID NO: 53425 - RNA, 18 nt, Artificial Sequence
  Description of Artificial Sequence: Synthetic oligonucleotide
gauuucuugacuuugcca

SEQ ID NO: 53426 - RNA, 18 nt, Artificial Sequence
  Description of Artificial Sequence: Synthetic oligonucleotide
aaggugauuucuugacuu

SEQ ID NO: 53427 - RNA, 18 nt, Artificial Sequence
  Description of Artificial Sequence: Synthetic oligonucleotide
caucaaaggugauuucuu

SEQ ID NO: 53428 - RNA, 18 nt, Artificial Sequence
  Description of Artificial Sequence: Synthetic oligonucleotide
uuugaggagaaacugcuc

SEQ ID NO: 53429 - RNA, 18 nt, Artificial Sequence
  Description of Artificial Sequence: Synthetic oligonucleotide
ggguauuugaggagaaac

SEQ ID NO: 53430 - RNA, 18 nt, Artificial Sequence
  Description of Artificial Sequence: Synthetic oligonucleotide
gucguugcuguucacggg

SEQ ID NO: 53431 - RNA, 18 nt, Artificial Sequence
  Description of Artificial Sequence: Synthetic oligonucleotide
gacgucguugcuguucac

SEQ ID NO: 53432 - RNA, 18 nt, Artificial Sequence
  Description of Artificial Sequence: Synthetic oligonucleotide
aagaagacgucguugcug

SEQ ID NO: 53433 - RNA, 18 nt, Artificial Sequence
  Description of Artificial Sequence: Synthetic oligonucleotide
ggcugaagaagacgucgu

SEQ ID NO: 53434 - RNA, 18 nt, Artificial Sequence
  Description of Artificial Sequence: Synthetic oligonucleotide
gugcaggcugaagaagac

SEQ ID NO: 53435 - RNA, 18 nt, Artificial Sequence
  Description of Artificial Sequence: Synthetic oligonucleotide
accgcgugcaggcugaag

SEQ ID NO: 53436 - RNA, 18 nt, Artificial Sequence
  Description of Artificial Sequence: Synthetic oligonucleotide
ggacaaccgcgugcaggc

SEQ ID NO: 53437 - RNA, 18 nt, Artificial Sequence
  Description of Artificial Sequence: Synthetic oligonucleotide
cgugaggacaaccgcgug

SEQ ID NO: 53438 - RNA, 18 nt, Artificial Sequence
  Description of Artificial Sequence: Synthetic oligonucleotide
aucagcgugaggacaacc

SEQ ID NO: 53439 - RNA, 18 nt, Artificial Sequence
  Description of Artificial Sequence: Synthetic oligonucleotide
ugaugaucagcgugagga

SEQ ID NO: 53440 - RNA, 18 nt, Artificial Sequence
  Description of Artificial Sequence: Synthetic oligonucleotide
cacgaugaugaucagcgu

SEQ ID NO: 53441 - RNA, 18 nt, Artificial Sequence
  Description of Artificial Sequence: Synthetic oligonucleotide
cacugcacgaugaugauc

SEQ ID NO: 53442 - RNA, 18 nt, Artificial Sequence
  Description of Artificial Sequence: Synthetic oligonucleotide
ggcagcacugcacgauga

SEQ ID NO: 53443 - RNA, 18 nt, Artificial Sequence
  Description of Artificial Sequence: Synthetic oligonucleotide
auacaggcagcacugcac

SEQ ID NO: 53444 - RNA, 18 nt, Artificial Sequence
  Description of Artificial Sequence: Synthetic oligonucleotide
gggccagggcuggucuca

SEQ ID NO: 53445 - RNA, 18 nt, Artificial Sequence
  Description of Artificial Sequence: Synthetic oligonucleotide
uggcggguguuggcuggg

SEQ ID NO: 53446 - RNA, 18 nt, Artificial Sequence
  Description of Artificial Sequence: Synthetic oligonucleotide
ggguggcggguguuggcu

SEQ ID NO: 53447 - RNA, 18 nt, Artificial Sequence
  Description of Artificial Sequence: Synthetic oligonucleotide
ugucaaaggugagguggg

SEQ ID NO: 53448 - RNA, 18 nt, Artificial Sequence
  Description of Artificial Sequence: Synthetic oligonucleotide
ucuucugucaaaggugag

SEQ ID NO: 53449 - RNA, 18 nt, Artificial Sequence
  Description of Artificial Sequence: Synthetic oligonucleotide
ccgugucuucugucaaag

SEQ ID NO: 53450 - RNA, 18 nt, Artificial Sequence
  Description of Artificial Sequence: Synthetic oligonucleotide
cucugccgugucuucugu

SEQ ID NO: 53451 - RNA, 18 nt, Artificial Sequence
  Description of Artificial Sequence: Synthetic oligonucleotide
ccaggcucugccgugucu

SEQ ID NO: 53452 - RNA, 18 nt, Artificial Sequence
  Description of Artificial Sequence: Synthetic oligonucleotide
cuuucccaggcucugccg

SEQ ID NO: 53453 - RNA, 18 nt, Artificial Sequence
  Description of Artificial Sequence: Synthetic oligonucleotide
ccuuccuuucccaggcuc

SEQ ID NO: 53454 - RNA, 18 nt, Artificial Sequence
  Description of Artificial Sequence: Synthetic oligonucleotide
cacacccuuccuuuccca

SEQ ID NO: 53455 - RNA, 18 nt, Artificial Sequence
  Description of Artificial Sequence: Synthetic oligonucleotide
gaacacacacccuuccuu

SEQ ID NO: 53456 - RNA, 18 nt, Artificial Sequence
  Description of Artificial Sequence: Synthetic oligonucleotide
ugaaugaacacacacccu

SEQ ID NO: 53457 - RNA, 18 nt, Artificial Sequence
  Description of Artificial Sequence: Synthetic oligonucleotide
cuggaugaaugaacacac

SEQ ID NO: 53458 - RNA, 18 nt, Artificial Sequence
  Description of Artificial Sequence: Synthetic oligonucleotide
aggaccuggaugaaugaa

SEQ ID NO: 53459 - RNA, 18 nt, Artificial Sequence
  Description of Artificial Sequence: Synthetic oligonucleotide
agcacaggaccuggauga

SEQ ID NO: 53460 - RNA, 18 nt, Artificial Sequence
  Description of Artificial Sequence: Synthetic oligonucleotide
ugcccagcacaggaccug

SEQ ID NO: 53461 - RNA, 18 nt, Artificial Sequence
  Description of Artificial Sequence: Synthetic oligonucleotide
uucuaugcccagcacagg

SEQ ID NO: 53462 - RNA, 18 nt, Artificial Sequence
  Description of Artificial Sequence: Synthetic oligonucleotide
gugucuucuaugcccagc

SEQ ID NO: 53463 - RNA, 18 nt, Artificial Sequence
  Description of Artificial Sequence: Synthetic oligonucleotide
caugggugucuucuaugc

SEQ ID NO: 53464 - RNA, 18 nt, Artificial Sequence
  Description of Artificial Sequence: Synthetic oligonucleotide
ggacucaugggugucuuc

SEQ ID NO: 53465 - RNA, 18 nt, Artificial Sequence
  Description of Artificial Sequence: Synthetic oligonucleotide
ggccuggacucaugggug

SEQ ID NO: 53466 - RNA, 18 nt, Artificial Sequence
  Description of Artificial Sequence: Synthetic oligonucleotide
cugagggccuggacucau

SEQ ID NO: 53467 - RNA, 18 nt, Artificial Sequence
  Description of Artificial Sequence: Synthetic oligonucleotide
gggcucugagggccugga

SEQ ID NO: 53468 - RNA, 18 nt, Artificial Sequence
  Description of Artificial Sequence: Synthetic oligonucleotide
ucccucaccccagacuug

SEQ ID NO: 53469 - RNA, 18 nt, Artificial Sequence
  Description of Artificial Sequence: Synthetic oligonucleotide
cugagucccucaccccag

SEQ ID NO: 53470 - RNA, 18 nt, Artificial Sequence
  Description of Artificial Sequence: Synthetic oligonucleotide
ucucccugagucccucac

SEQ ID NO: 53471 - RNA, 18 nt, Artificial Sequence
  Description of Artificial Sequence: Synthetic oligonucleotide
cugccucucccugagucc

SEQ ID NO: 53472 - RNA, 18 nt, Artificial Sequence
  Description of Artificial Sequence: Synthetic oligonucleotide
aggcacugccucucccug

SEQ ID NO: 53473 - RNA, 18 nt, Artificial Sequence
  Description of Artificial Sequence: Synthetic oligonucleotide
aguccaggcacugccucu

SEQ ID NO: 53474 - RNA, 18 nt, Artificial Sequence
  Description of Artificial Sequence: Synthetic oligonucleotide
gccugaguccaggcacug

SEQ ID NO: 53475 - RNA, 18 nt, Artificial Sequence
  Description of Artificial Sequence: Synthetic oligonucleotide
ucucagccugaguccagg

SEQ ID NO: 53476 - RNA, 18 nt, Artificial Sequence
  Description of Artificial Sequence: Synthetic oligonucleotide
acggcucucagccugagu

SEQ ID NO: 53477 - RNA, 18 nt, Artificial Sequence
  Description of Artificial Sequence: Synthetic oligonucleotide
ugugcacggcucucagcc

SEQ ID NO: 53478 - RNA, 18 nt, Artificial Sequence
  Description of Artificial Sequence: Synthetic oligonucleotide
uccucugugcacggcucu

SEQ ID NO: 53479 - RNA, 18 nt, Artificial Sequence
  Description of Artificial Sequence: Synthetic oligonucleotide
ugugcuccucugugcacg

SEQ ID NO: 53480 - RNA, 18 nt, Artificial Sequence
  Description of Artificial Sequence: Synthetic oligonucleotide
cugucugugcuccucugu

SEQ ID NO: 53481 - RNA, 18 nt, Artificial Sequence
  Description of Artificial Sequence: Synthetic oligonucleotide
augagcugucugugcucc

SEQ ID NO: 53482 - RNA, 18 nt, Artificial Sequence
  Description of Artificial Sequence: Synthetic oligonucleotide
ccuccaugagcugucugu

SEQ ID NO: 53483 - RNA, 18 nt, Artificial Sequence
  Description of Artificial Sequence: Synthetic oligonucleotide
gcacuccuccaugagcug

SEQ ID NO: 53484 - RNA, 18 nt, Artificial Sequence
  Description of Artificial Sequence: Synthetic oligonucleotide
gccuugcacuccuccaug

SEQ ID NO: 53485 - RNA, 18 nt, Artificial Sequence
  Description of Artificial Sequence: Synthetic oligonucleotide
ucagggccuugcacuccu

SEQ ID NO: 53486 - RNA, 18 nt, Artificial Sequence
  Description of Artificial Sequence: Synthetic oligonucleotide
agggcucagggccuugca

SEQ ID NO: 53487 - RNA, 18 nt, Artificial Sequence
  Description of Artificial Sequence: Synthetic oligonucleotide
cuggcagggcucagggcc

SEQ ID NO: 53488 - RNA, 18 nt, Artificial Sequence
  Description of Artificial Sequence: Synthetic oligonucleotide
ccucccuggcagggcuca

SEQ ID NO: 53489 - RNA, 18 nt, Artificial Sequence
  Description of Artificial Sequence: Synthetic oligonucleotide
ucccuccucccuggcagg

SEQ ID NO: 53490 - RNA, 18 nt, Artificial Sequence
  Description of Artificial Sequence: Synthetic oligonucleotide
ccuccucccuccucccug

SEQ ID NO: 53491 - RNA, 18 nt, Artificial Sequence
  Description of Artificial Sequence: Synthetic oligonucleotide
ugugcccuccucccuccu

SEQ ID NO: 53492 - RNA, 18 nt, Artificial Sequence
  Description of Artificial Sequence: Synthetic oligonucleotide
ccuucugugcccuccucc

SEQ ID NO: 53493 - RNA, 18 nt, Artificial Sequence
  Description of Artificial Sequence: Synthetic oligonucleotide
uccucccuucugugcccu

SEQ ID NO: 53494 - RNA, 18 nt, Artificial Sequence
  Description of Artificial Sequence: Synthetic oligonucleotide
cucccuccucccuucugu

SEQ ID NO: 53495 - RNA, 18 nt, Artificial Sequence
  Description of Artificial Sequence: Synthetic oligonucleotide
cccuccucccuccucccu

SEQ ID NO: 53496 - RNA, 18 nt, Artificial Sequence
  Description of Artificial Sequence: Synthetic oligonucleotide
cugugcccuccucccucc

SEQ ID NO: 53497 - RNA, 18 nt, Artificial Sequence
  Description of Artificial Sequence: Synthetic oligonucleotide
cccuucugugcccuccuc

SEQ ID NO: 53498 - RNA, 18 nt, Artificial Sequence
  Description of Artificial Sequence: Synthetic oligonucleotide
cuccucccuucugugccc

SEQ ID NO: 53499 - RNA, 18 nt, Artificial Sequence
  Description of Artificial Sequence: Synthetic oligonucleotide
cugcccuccucccuucug

SEQ ID NO: 53500 - RNA, 18 nt, Artificial Sequence
  Description of Artificial Sequence: Synthetic oligonucleotide
uuccucugcccuccuccc

SEQ ID NO: 53501 - RNA, 18 nt, Artificial Sequence
  Description of Artificial Sequence: Synthetic oligonucleotide
gcgucuuccucugcccuc

SEQ ID NO: 53502 - RNA, 18 nt, Artificial Sequence
  Description of Artificial Sequence: Synthetic oligonucleotide
accaagcgucuuccucug

SEQ ID NO: 53503 - RNA, 18 nt, Artificial Sequence
  Description of Artificial Sequence: Synthetic oligonucleotide
gcccaaccaagcgucuuc

SEQ ID NO: 53504 - RNA, 18 nt, Artificial Sequence
  Description of Artificial Sequence: Synthetic oligonucleotide
uuggagcccaaccaagcg

SEQ ID NO: 53505 - RNA, 18 nt, Artificial Sequence
  Description of Artificial Sequence: Synthetic oligonucleotide
cauccuuggagcccaacc

SEQ ID NO: 53506 - RNA, 18 nt, Artificial Sequence
  Description of Artificial Sequence: Synthetic oligonucleotide
ucacucauccuuggagcc

SEQ ID NO: 53507 - RNA, 18 nt, Artificial Sequence
  Description of Artificial Sequence: Synthetic oligonucleotide
gaacuucacucauccuug

SEQ ID NO: 53508 - RNA, 18 nt, Artificial Sequence
  Description of Artificial Sequence: Synthetic oligonucleotide
cauaggaacuucacucau

SEQ ID NO: 53509 - RNA, 18 nt, Artificial Sequence
  Description of Artificial Sequence: Synthetic oligonucleotide
uccuccauaggaacuuca

SEQ ID NO: 53510 - RNA, 18 nt, Artificial Sequence
  Description of Artificial Sequence: Synthetic oligonucleotide
uccccuccuccauaggaa

SEQ ID NO: 53511 - RNA, 18 nt, Artificial Sequence
  Description of Artificial Sequence: Synthetic oligonucleotide
gccccuccccuccuccau

SEQ ID NO: 53512 - RNA, 18 nt, Artificial Sequence
  Description of Artificial Sequence: Synthetic oligonucleotide
cccuggccccuccccucc

SEQ ID NO: 53513 - RNA, 18 nt, Artificial Sequence
  Description of Artificial Sequence: Synthetic oligonucleotide
gcccacccuggccccucc

SEQ ID NO: 53514 - RNA, 18 nt, Artificial Sequence
  Description of Artificial Sequence: Synthetic oligonucleotide
caggagcccacccuggcc

SEQ ID NO: 53515 - RNA, 18 nt, Artificial Sequence
  Description of Artificial Sequence: Synthetic oligonucleotide
cccuccaggagcccaccc

SEQ ID NO: 53516 - RNA, 18 nt, Artificial Sequence
  Description of Artificial Sequence: Synthetic oligonucleotide
cugaccccuccaggagcc

SEQ ID NO: 53517 - RNA, 18 nt, Artificial Sequence
  Description of Artificial Sequence: Synthetic oligonucleotide
gugaccugaccccuccag

SEQ ID NO: 53518 - RNA, 18 nt, Artificial Sequence
  Description of Artificial Sequence: Synthetic oligonucleotide
ccucugugaccugacccc

SEQ ID NO: 53519 - RNA, 18 nt, Artificial Sequence
  Description of Artificial Sequence: Synthetic oligonucleotide
cuuggccucugugaccug

SEQ ID NO: 53520 - RNA, 18 nt, Artificial Sequence
  Description of Artificial Sequence: Synthetic oligonucleotide
ugccccuuggccucugug

SEQ ID NO: 53521 - RNA, 18 nt, Artificial Sequence
  Description of Artificial Sequence: Synthetic oligonucleotide
ucaaaugccccuuggccu

SEQ ID NO: 53522 - RNA, 18 nt, Artificial Sequence
  Description of Artificial Sequence: Synthetic oligonucleotide
cccucucaaaugccccuu

SEQ ID NO: 53523 - RNA, 18 nt, Artificial Sequence
  Description of Artificial Sequence: Synthetic oligonucleotide
agggucccucucaaaugc

SEQ ID NO: 53524 - RNA, 18 nt, Artificial Sequence
  Description of Artificial Sequence: Synthetic oligonucleotide
ugcucagggucccucuca

SEQ ID NO: 53525 - RNA, 18 nt, Artificial Sequence
  Description of Artificial Sequence: Synthetic oligonucleotide
ccgccugcucaggguccc

SEQ ID NO: 53526 - RNA, 18 nt, Artificial Sequence
  Description of Artificial Sequence: Synthetic oligonucleotide
ugcacccgccugcucagg

SEQ ID NO: 53527 - RNA, 18 nt, Artificial Sequence
  Description of Artificial Sequence: Synthetic oligonucleotide
ccagcugcacccgccugc

SEQ ID NO: 53528 - RNA, 18 nt, Artificial Sequence
  Description of Artificial Sequence: Synthetic oligonucleotide
gaagcccagcugcacccg

SEQ ID NO: 53529 - RNA, 18 nt, Artificial Sequence
  Description of Artificial Sequence: Synthetic oligonucleotide
acccugaagcccagcugc

SEQ ID NO: 53530 - RNA, 18 nt, Artificial Sequence
  Description of Artificial Sequence: Synthetic oligonucleotide
cuggcacccugaagccca

SEQ ID NO: 53531 - RNA, 18 nt, Artificial Sequence
  Description of Artificial Sequence: Synthetic oligonucleotide
cccuccuggcacccugaa

SEQ ID NO: 53532 - RNA, 18 nt, Artificial Sequence
  Description of Artificial Sequence: Synthetic oligonucleotide
gggcccccuccuggcacc

SEQ ID NO: 53533 - RNA, 18 nt, Artificial Sequence
  Description of Artificial Sequence: Synthetic oligonucleotide
cacgcgggcccccuccug

SEQ ID NO: 53534 - RNA, 18 nt, Artificial Sequence
  Description of Artificial Sequence: Synthetic oligonucleotide
gcuaagaaagccuagaag

SEQ ID NO: 53535 - RNA, 18 nt, Artificial Sequence
  Description of Artificial Sequence: Synthetic oligonucleotide
caaaagcuaagaaagccu

SEQ ID NO: 53536 - RNA, 18 nt, Artificial Sequence
  Description of Artificial Sequence: Synthetic oligonucleotide
cacaccaaaagcuaagaa

SEQ ID NO: 53537 - RNA, 18 nt, Artificial Sequence
  Description of Artificial Sequence: Synthetic oligonucleotide
cgcuucacaccaaaagcu

SEQ ID NO: 53538 - RNA, 18 nt, Artificial Sequence
  Description of Artificial Sequence: Synthetic oligonucleotide
acucucgcuucacaccaa

SEQ ID NO: 53539 - RNA, 18 nt, Artificial Sequence
  Description of Artificial Sequence: Synthetic oligonucleotide
ccuucacucucgcuucac

SEQ ID NO: 53540 - RNA, 18 nt, Artificial Sequence
  Description of Artificial Sequence: Synthetic oligonucleotide
ggccaccuucacucucgc

SEQ ID NO: 53541 - RNA, 18 nt, Artificial Sequence
  Description of Artificial Sequence: Synthetic oligonucleotide
augugggccaccuucacu

SEQ ID NO: 53542 - RNA, 18 nt, Artificial Sequence
  Description of Artificial Sequence: Synthetic oligonucleotide
gcccaaugugggccaccu

SEQ ID NO: 53543 - RNA, 18 nt, Artificial Sequence
  Description of Artificial Sequence: Synthetic oligonucleotide
cacgggcccaaugugggc

SEQ ID NO: 53544 - RNA, 18 nt, Artificial Sequence
  Description of Artificial Sequence: Synthetic oligonucleotide
cugaacacgggcccaaug

SEQ ID NO: 53545 - RNA, 18 nt, Artificial Sequence
  Description of Artificial Sequence: Synthetic oligonucleotide
uuucccugaacacgggcc

SEQ ID NO: 53546 - RNA, 18 nt, Artificial Sequence
  Description of Artificial Sequence: Synthetic oligonucleotide
uugccuuucccugaacac

SEQ ID NO: 53547 - RNA, 18 nt, Artificial Sequence
  Description of Artificial Sequence: Synthetic oligonucleotide
ucgccuugccuuucccug

SEQ ID NO: 53548 - RNA, 18 nt, Artificial Sequence
  Description of Artificial Sequence: Synthetic oligonucleotide
uccccucgccuugccuuu

SEQ ID NO: 53549 - RNA, 18 nt, Artificial Sequence
  Description of Artificial Sequence: Synthetic oligonucleotide
aucuguccccucgccuug

SEQ ID NO: 53550 - RNA, 18 nt, Artificial Sequence
  Description of Artificial Sequence: Synthetic oligonucleotide
caggaaucuguccccucg

SEQ ID NO: 53551 - RNA, 18 nt, Artificial Sequence
  Description of Artificial Sequence: Synthetic oligonucleotide
gaucucaggaaucugucc

SEQ ID NO: 53552 - RNA, 18 nt, Artificial Sequence
  Description of Artificial Sequence: Synthetic oligonucleotide
cugaggaucucaggaauc

SEQ ID NO: 53553 - RNA, 18 nt, Artificial Sequence
  Description of Artificial Sequence: Synthetic oligonucleotide
gcagccugaggaucucag

SEQ ID NO: 53554 - RNA, 18 nt, Artificial Sequence
  Description of Artificial Sequence: Synthetic oligonucleotide
cggcagcagccugaggau

SEQ ID NO: 53555 - RNA, 18 nt, Artificial Sequence
  Description of Artificial Sequence: Synthetic oligonucleotide
cgacccggcagcagccug

SEQ ID NO: 53556 - RNA, 18 nt, Artificial Sequence
  Description of Artificial Sequence: Synthetic oligonucleotide
ucccacgacccggcagca

SEQ ID NO: 53557 - RNA, 18 nt, Artificial Sequence
  Description of Artificial Sequence: Synthetic oligonucleotide
acucgucccacgacccgg

SEQ ID NO: 53558 - RNA, 18 nt, Artificial Sequence
  Description of Artificial Sequence: Synthetic oligonucleotide
uacugacucgucccacga

SEQ ID NO: 53559 - RNA, 18 nt, Artificial Sequence
  Description of Artificial Sequence: Synthetic oligonucleotide
ccagguacugacucgucc

SEQ ID NO: 53560 - RNA, 18 nt, Artificial Sequence
  Description of Artificial Sequence: Synthetic oligonucleotide
cccagccagguacugacu

SEQ ID NO: 53561 - RNA, 18 nt, Artificial Sequence
  Description of Artificial Sequence: Synthetic oligonucleotide
ccucucccagccagguac

SEQ ID NO: 53562 - RNA, 18 nt, Artificial Sequence
  Description of Artificial Sequence: Synthetic oligonucleotide
uggugccucucccagcca

SEQ ID NO: 53563 - RNA, 18 nt, Artificial Sequence
  Description of Artificial Sequence: Synthetic oligonucleotide
uggccuggugccucuccc

SEQ ID NO: 53564 - RNA, 18 nt, Artificial Sequence
  Description of Artificial Sequence: Synthetic oligonucleotide
ucugguggccuggugccu

SEQ ID NO: 53565 - RNA, 18 nt, Artificial Sequence
  Description of Artificial Sequence: Synthetic oligonucleotide
ggaacucugguggccugg

SEQ ID NO: 53566 - RNA, 18 nt, Artificial Sequence
  Description of Artificial Sequence: Synthetic oligonucleotide
gggucggaacucuggugg

SEQ ID NO: 53567 - RNA, 18 nt, Artificial Sequence
  Description of Artificial Sequence: Synthetic oligonucleotide
cucacuuggagacguggg

SEQ ID NO: 53568 - RNA, 18 nt, Artificial Sequence
  Description of Artificial Sequence: Synthetic oligonucleotide
acucacuuggagacgugg

SEQ ID NO: 53569 - RNA, 18 nt, Artificial Sequence
  Description of Artificial Sequence: Synthetic oligonucleotide
ucagcacucacuuggaga

SEQ ID NO: 53570 - RNA, 18 nt, Artificial Sequence
  Description of Artificial Sequence: Synthetic oligonucleotide
gccucucagcacucacuu

SEQ ID NO: 53571 - RNA, 18 nt, Artificial Sequence
  Description of Artificial Sequence: Synthetic oligonucleotide
ugggcgccucucagcacu

SEQ ID NO: 53572 - RNA, 18 nt, Artificial Sequence
  Description of Artificial Sequence: Synthetic oligonucleotide
agaacugggcgccucuca

SEQ ID NO: 53573 - RNA, 18 nt, Artificial Sequence
  Description of Artificial Sequence: Synthetic oligonucleotide
uuggcagaacugggcgcc

SEQ ID NO: 53574 - RNA, 18 nt, Artificial Sequence
  Description of Artificial Sequence: Synthetic oligonucleotide
ccuacuuggcagaacugg

SEQ ID NO: 53575 - RNA, 18 nt, Artificial Sequence
  Description of Artificial Sequence: Synthetic oligonucleotide
uuguuccuacuuggcaga

SEQ ID NO: 53576 - RNA, 18 nt, Artificial Sequence
  Description of Artificial Sequence: Synthetic oligonucleotide
cugcuuuguuccuacuug

SEQ ID NO: 53577 - RNA, 18 nt, Artificial Sequence
  Description of Artificial Sequence: Synthetic oligonucleotide
ucugucugcuuuguuccu

SEQ ID NO: 53578 - RNA, 18 nt, Artificial Sequence
  Description of Artificial Sequence: Synthetic oligonucleotide
caagcucugucugcuuug

SEQ ID NO: 53579 - RNA, 18 nt, Artificial Sequence
  Description of Artificial Sequence: Synthetic oligonucleotide
acucucaagcucugucug

SEQ ID NO: 53580 - RNA, 18 nt, Artificial Sequence
  Description of Artificial Sequence: Synthetic oligonucleotide
cuuggacucucaagcucu

SEQ ID NO: 53581 - RNA, 18 nt, Artificial Sequence
  Description of Artificial Sequence: Synthetic oligonucleotide
ggcugcuuggacucucaa

SEQ ID NO: 53582 - RNA, 18 nt, Artificial Sequence
  Description of Artificial Sequence: Synthetic oligonucleotide
guucaggcugcuuggacu

SEQ ID NO: 53583 - RNA, 18 nt, Artificial Sequence
  Description of Artificial Sequence: Synthetic oligonucleotide
cuccuguucaggcugcuu

SEQ ID NO: 53584 - RNA, 18 nt, Artificial Sequence
  Description of Artificial Sequence: Synthetic oligonucleotide
agggccuccuguucaggc

SEQ ID NO: 53585 - RNA, 18 nt, Artificial Sequence
  Description of Artificial Sequence: Synthetic oligonucleotide
ucgccagggccuccuguu

SEQ ID NO: 53586 - RNA, 18 nt, Artificial Sequence
  Description of Artificial Sequence: Synthetic oligonucleotide
ucucaucgccagggccuc

SEQ ID NO: 53587 - RNA, 18 nt, Artificial Sequence
  Description of Artificial Sequence: Synthetic oligonucleotide
caccuucucaucgccagg

SEQ ID NO: 53588 - RNA, 18 nt, Artificial Sequence
  Description of Artificial Sequence: Synthetic oligonucleotide
aaccacaccuucucaucg

SEQ ID NO: 53589 - RNA, 18 nt, Artificial Sequence
  Description of Artificial Sequence: Synthetic oligonucleotide
gcaccaaccacaccuucu

SEQ ID NO: 53590 - RNA, 18 nt, Artificial Sequence
  Description of Artificial Sequence: Synthetic oligonucleotide
ccccagcaccaaccacac

SEQ ID NO: 53591 - RNA, 18 nt, Artificial Sequence
  Description of Artificial Sequence: Synthetic oligonucleotide
gacauccccagcaccaac

SEQ ID NO: 53592 - RNA, 18 nt, Artificial Sequence
  Description of Artificial Sequence: Synthetic oligonucleotide
ugcuggacauccccagca

SEQ ID NO: 53593 - RNA, 18 nt, Artificial Sequence
  Description of Artificial Sequence: Synthetic oligonucleotide
gcuggugcuggacauccc

SEQ ID NO: 53594 - RNA, 18 nt, Artificial Sequence
  Description of Artificial Sequence: Synthetic oligonucleotide
ccugggcuggugcuggac

SEQ ID NO: 53595 - RNA, 18 nt, Artificial Sequence
  Description of Artificial Sequence: Synthetic oligonucleotide
ucacaccugggcuggugc

SEQ ID NO: 53596 - RNA, 18 nt, Artificial Sequence
  Description of Artificial Sequence: Synthetic oligonucleotide
aagcaucacaccugggcu

SEQ ID NO: 53597 - RNA, 18 nt, Artificial Sequence
  Description of Artificial Sequence: Synthetic oligonucleotide
acagaaagcaucacaccu

SEQ ID NO: 53598 - RNA, 18 nt, Artificial Sequence
  Description of Artificial Sequence: Synthetic oligonucleotide
ggaccacagaaagcauca

SEQ ID NO: 53599 - RNA, 18 nt, Artificial Sequence
  Description of Artificial Sequence: Synthetic oligonucleotide
cauguggaccacagaaag

SEQ ID NO: 53600 - RNA, 18 nt, Artificial Sequence
  Description of Artificial Sequence: Synthetic oligonucleotide
gggaacauguggaccaca

SEQ ID NO: 53601 - RNA, 18 nt, Artificial Sequence
  Description of Artificial Sequence: Synthetic oligonucleotide
gagccccugcaagguggg

SEQ ID NO: 53602 - RNA, 18 nt, Artificial Sequence
  Description of Artificial Sequence: Synthetic oligonucleotide
ugaaggagccccugcaag

SEQ ID NO: 53603 - RNA, 18 nt, Artificial Sequence
  Description of Artificial Sequence: Synthetic oligonucleotide
ggccuugaaggagccccu

SEQ ID NO: 53604 - RNA, 18 nt, Artificial Sequence
  Description of Artificial Sequence: Synthetic oligonucleotide
acccuggccuugaaggag

SEQ ID NO: 53605 - RNA, 18 nt, Artificial Sequence
  Description of Artificial Sequence: Synthetic oligonucleotide
gcuggacccuggccuuga

SEQ ID NO: 53606 - RNA, 18 nt, Artificial Sequence
  Description of Artificial Sequence: Synthetic oligonucleotide
cggaggcuggacccuggc

SEQ ID NO: 53607 - RNA, 18 nt, Artificial Sequence
  Description of Artificial Sequence: Synthetic oligonucleotide
gggcacggaggcuggacc

SEQ ID NO: 53608 - RNA, 18 nt, Artificial Sequence
  Description of Artificial Sequence: Synthetic oligonucleotide
gggcgggcuuagagaggg

SEQ ID NO: 53609 - RNA, 18 nt, Artificial Sequence
  Description of Artificial Sequence: Synthetic oligonucleotide
agggcgggcuuagagagg

SEQ ID NO: 53610 - RNA, 18 nt, Artificial Sequence
  Description of Artificial Sequence: Synthetic oligonucleotide
cggauagggcgggcuuag

SEQ ID NO: 53611 - RNA, 18 nt, Artificial Sequence
  Description of Artificial Sequence: Synthetic oligonucleotide
ggccccggauagggcggg

SEQ ID NO: 53612 - RNA, 18 nt, Artificial Sequence
  Description of Artificial Sequence: Synthetic oligonucleotide
aggacggccccggauagg

SEQ ID NO: 53613 - RNA, 18 nt, Artificial Sequence
  Description of Artificial Sequence: Synthetic oligonucleotide
gagcaaggacggccccgg

SEQ ID NO: 53614 - RNA, 18 nt, Artificial Sequence
  Description of Artificial Sequence: Synthetic oligonucleotide
gggcugagcaaggacggc

SEQ ID NO: 53615 - RNA, 18 nt, Artificial Sequence
  Description of Artificial Sequence: Synthetic oligonucleotide
cacagaggccacgccggg

SEQ ID NO: 53616 - RNA, 18 nt, Artificial Sequence
  Description of Artificial Sequence: Synthetic oligonucleotide
cccacacagaggccacgc

SEQ ID NO: 53617 - RNA, 18 nt, Artificial Sequence
  Description of Artificial Sequence: Synthetic oligonucleotide
guggacccacacagaggc

SEQ ID NO: 53618 - RNA, 18 nt, Artificial Sequence
  Description of Artificial Sequence: Synthetic oligonucleotide
gagauguggacccacaca

SEQ ID NO: 53619 - RNA, 18 nt, Artificial Sequence
  Description of Artificial Sequence: Synthetic oligonucleotide
gggcagagauguggaccc

SEQ ID NO: 53620 - RNA, 18 nt, Artificial Sequence
  Description of Artificial Sequence: Synthetic oligonucleotide
acacgcgcuggccaccgc

SEQ ID NO: 53621 - RNA, 18 nt, Artificial Sequence
  Description of Artificial Sequence: Synthetic oligonucleotide
ccaggacacgcgcuggcc

SEQ ID NO: 53622 - RNA, 18 nt, Artificial Sequence
  Description of Artificial Sequence: Synthetic oligonucleotide
gcaggccaggacacgcgc

SEQ ID NO: 53623 - RNA, 18 nt, Artificial Sequence
  Description of Artificial Sequence: Synthetic oligonucleotide
cgauggcaggccaggaca

SEQ ID NO: 53624 - RNA, 18 nt, Artificial Sequence
  Description of Artificial Sequence: Synthetic oligonucleotide
gaagccgauggcaggcca

SEQ ID NO: 53625 - RNA, 18 nt, Artificial Sequence
  Description of Artificial Sequence: Synthetic oligonucleotide
accaggaagccgauggca

SEQ ID NO: 53626 - RNA, 18 nt, Artificial Sequence
  Description of Artificial Sequence: Synthetic oligonucleotide
cgagcaccaggaagccga

SEQ ID NO: 53627 - RNA, 18 nt, Artificial Sequence
  Description of Artificial Sequence: Synthetic oligonucleotide
ccacgcgagcaccaggaa

SEQ ID NO: 53628 - RNA, 18 nt, Artificial Sequence
  Description of Artificial Sequence: Synthetic oligonucleotide
aagagccacgcgagcacc

SEQ ID NO: 53629 - RNA, 18 nt, Artificial Sequence
  Description of Artificial Sequence: Synthetic oligonucleotide
augcgaagagccacgcga

SEQ ID NO: 53630 - RNA, 18 nt, Artificial Sequence
  Description of Artificial Sequence: Synthetic oligonucleotide
gacaaaugcgaagagcca

SEQ ID NO: 53631 - RNA, 18 nt, Artificial Sequence
  Description of Artificial Sequence: Synthetic oligonucleotide
auggugacaaaugcgaag

SEQ ID NO: 53632 - RNA, 18 nt, Artificial Sequence
  Description of Artificial Sequence: Synthetic oligonucleotide
cgaucauggugacaaaug

SEQ ID NO: 53633 - RNA, 18 nt, Artificial Sequence
  Description of Artificial Sequence: Synthetic oligonucleotide
agccacgaucauggugac

SEQ ID NO: 53634 - RNA, 18 nt, Artificial Sequence
  Description of Artificial Sequence: Synthetic oligonucleotide
acugcagccacgaucaug

SEQ ID NO: 53635 - RNA, 18 nt, Artificial Sequence
  Description of Artificial Sequence: Synthetic oligonucleotide
cucccacugcagccacga

SEQ ID NO: 53636 - RNA, 18 nt, Artificial Sequence
  Description of Artificial Sequence: Synthetic oligonucleotide
ggucacucccacugcagc

SEQ ID NO: 53637 - RNA, 18 nt, Artificial Sequence
  Description of Artificial Sequence: Synthetic oligonucleotide
cacguggucacucccacu

SEQ ID NO: 53638 - RNA, 18 nt, Artificial Sequence
  Description of Artificial Sequence: Synthetic oligonucleotide
gcagccacguggucacuc

SEQ ID NO: 53639 - RNA, 18 nt, Artificial Sequence
  Description of Artificial Sequence: Synthetic oligonucleotide
aaacugcagccacguggu

SEQ ID NO: 53640 - RNA, 18 nt, Artificial Sequence
  Description of Artificial Sequence: Synthetic oligonucleotide
aagagaaacugcagccac

SEQ ID NO: 53641 - RNA, 18 nt, Artificial Sequence
  Description of Artificial Sequence: Synthetic oligonucleotide
agcagaagagaaacugca

SEQ ID NO: 53642 - RNA, 18 nt, Artificial Sequence
  Description of Artificial Sequence: Synthetic oligonucleotide
ggagaagcagaagagaaa

SEQ ID NO: 53643 - RNA, 18 nt, Artificial Sequence
  Description of Artificial Sequence: Synthetic oligonucleotide
auguaggagaagcagaag

SEQ ID NO: 53644 - RNA, 18 nt, Artificial Sequence
  Description of Artificial Sequence: Synthetic oligonucleotide
gcuugauguaggagaagc

SEQ ID NO: 53645 - RNA, 18 nt, Artificial Sequence
  Description of Artificial Sequence: Synthetic oligonucleotide
ugcgagcuugauguagga

SEQ ID NO: 53646 - RNA, 18 nt, Artificial Sequence
  Description of Artificial Sequence: Synthetic oligonucleotide
gugacugcgagcuugaug

SEQ ID NO: 53647 - RNA, 18 nt, Artificial Sequence
  Description of Artificial Sequence: Synthetic oligonucleotide
ccagcgugacugcgagcu

SEQ ID NO: 53648 - RNA, 18 nt, Artificial Sequence
  Description of Artificial Sequence: Synthetic oligonucleotide
cuugaccagcgugacugc

SEQ ID NO: 53649 - RNA, 18 nt, Artificial Sequence
  Description of Artificial Sequence: Synthetic oligonucleotide
aaauacuugaccagcgug

SEQ ID NO: 53650 - RNA, 18 nt, Artificial Sequence
  Description of Artificial Sequence: Synthetic oligonucleotide
guggaaaauacuugacca

SEQ ID NO: 53651 - RNA, 18 nt, Artificial Sequence
  Description of Artificial Sequence: Synthetic oligonucleotide
cacgcgcuggccaccgcg

SEQ ID NO: 53652 - RNA, 18 nt, Artificial Sequence
  Description of Artificial Sequence: Synthetic oligonucleotide
caggacacgcgcuggcca

SEQ ID NO: 53653 - RNA, 18 nt, Artificial Sequence
  Description of Artificial Sequence: Synthetic oligonucleotide
caggccaggacacgcgcu

SEQ ID NO: 53654 - RNA, 18 nt, Artificial Sequence
  Description of Artificial Sequence: Synthetic oligonucleotide
gauggcaggccaggacac

SEQ ID NO: 53655 - RNA, 18 nt, Artificial Sequence
  Description of Artificial Sequence: Synthetic oligonucleotide
aagccgauggcaggccag

SEQ ID NO: 53656 - RNA, 18 nt, Artificial Sequence
  Description of Artificial Sequence: Synthetic oligonucleotide
ccaggaagccgauggcag

SEQ ID NO: 53657 - RNA, 18 nt, Artificial Sequence
  Description of Artificial Sequence: Synthetic oligonucleotide
gagcaccaggaagccgau

SEQ ID NO: 53658 - RNA, 18 nt, Artificial Sequence
  Description of Artificial Sequence: Synthetic oligonucleotide
cacgcgagcaccaggaag

SEQ ID NO: 53659 - RNA, 18 nt, Artificial Sequence
  Description of Artificial Sequence: Synthetic oligonucleotide
agagccacgcgagcacca

SEQ ID NO: 53660 - RNA, 18 nt, Artificial Sequence
  Description of Artificial Sequence: Synthetic oligonucleotide
ugcgaagagccacgcgag

SEQ ID NO: 53661 - RNA, 18 nt, Artificial Sequence
  Description of Artificial Sequence: Synthetic oligonucleotide
acaaaugcgaagagccac

SEQ ID NO: 53662 - RNA, 18 nt, Artificial Sequence
  Description of Artificial Sequence: Synthetic oligonucleotide
uggugacaaaugcgaaga

SEQ ID NO: 53663 - RNA, 18 nt, Artificial Sequence
  Description of Artificial Sequence: Synthetic oligonucleotide
gaucauggugacaaaugc

SEQ ID NO: 53664 - RNA, 18 nt, Artificial Sequence
  Description of Artificial Sequence: Synthetic oligonucleotide
gccacgaucauggugaca

SEQ ID NO: 53665 - RNA, 18 nt, Artificial Sequence
  Description of Artificial Sequence: Synthetic oligonucleotide
cugcagccacgaucaugg

SEQ ID NO: 53666 - RNA, 18 nt, Artificial Sequence
  Description of Artificial Sequence: Synthetic oligonucleotide
ucccacugcagccacgau

SEQ ID NO: 53667 - RNA, 18 nt, Artificial Sequence
  Description of Artificial Sequence: Synthetic oligonucleotide
gucacucccacugcagcc

SEQ ID NO: 53668 - RNA, 18 nt, Artificial Sequence
  Description of Artificial Sequence: Synthetic oligonucleotide
acguggucacucccacug

SEQ ID NO: 53669 - RNA, 18 nt, Artificial Sequence
  Description of Artificial Sequence: Synthetic oligonucleotide
cagccacguggucacucc

SEQ ID NO: 53670 - RNA, 18 nt, Artificial Sequence
  Description of Artificial Sequence: Synthetic oligonucleotide
aacugcagccacgugguc

SEQ ID NO: 53671 - RNA, 18 nt, Artificial Sequence
  Description of Artificial Sequence: Synthetic oligonucleotide
agagaaacugcagccacg

SEQ ID NO: 53672 - RNA, 18 nt, Artificial Sequence
  Description of Artificial Sequence: Synthetic oligonucleotide
gcagaagagaaacugcag

SEQ ID NO: 53673 - RNA, 18 nt, Artificial Sequence
  Description of Artificial Sequence: Synthetic oligonucleotide
gagaagcagaagagaaac

SEQ ID NO: 53674 - RNA, 18 nt, Artificial Sequence
  Description of Artificial Sequence: Synthetic oligonucleotide
uguaggagaagcagaaga

SEQ ID NO: 53675 - RNA, 18 nt, Artificial Sequence
  Description of Artificial Sequence: Synthetic oligonucleotide
cuugauguaggagaagca

SEQ ID NO: 53676 - RNA, 18 nt, Artificial Sequence
  Description of Artificial Sequence: Synthetic oligonucleotide
gcgagcuugauguaggag

SEQ ID NO: 53677 - RNA, 18 nt, Artificial Sequence
  Description of Artificial Sequence: Synthetic oligonucleotide
ugacugcgagcuugaugu

SEQ ID NO: 53678 - RNA, 18 nt, Artificial Sequence
  Description of Artificial Sequence: Synthetic oligonucleotide
cagcgugacugcgagcuu

SEQ ID NO: 53679 - RNA, 18 nt, Artificial Sequence
  Description of Artificial Sequence: Synthetic oligonucleotide
uugaccagcgugacugcg

SEQ ID NO: 53680 - RNA, 18 nt, Artificial Sequence
  Description of Artificial Sequence: Synthetic oligonucleotide
aauacuugaccagcguga

SEQ ID NO: 53681 - RNA, 18 nt, Artificial Sequence
  Description of Artificial Sequence: Synthetic oligonucleotide
uggaaaauacuugaccag

SEQ ID NO: 53682 - RNA, 18 nt, Artificial Sequence
  Description of Artificial Sequence: Synthetic oligonucleotide
ugugaacagggcccugga

SEQ ID NO: 53683 - RNA, 18 nt, Artificial Sequence
  Description of Artificial Sequence: Synthetic oligonucleotide
ggccaugugaacagggcc

SEQ ID NO: 53684 - RNA, 18 nt, Artificial Sequence
  Description of Artificial Sequence: Synthetic oligonucleotide
ccaccggccaugugaaca

SEQ ID NO: 53685 - RNA, 18 nt, Artificial Sequence
  Description of Artificial Sequence: Synthetic oligonucleotide
uccugccaccggccaugu

SEQ ID NO: 53686 - RNA, 18 nt, Artificial Sequence
  Description of Artificial Sequence: Synthetic oligonucleotide
accucuccugccaccggc

SEQ ID NO: 53687 - RNA, 18 nt, Artificial Sequence
  Description of Artificial Sequence: Synthetic oligonucleotide
cucucaccucuccugcca

SEQ ID NO: 53688 - RNA, 18 nt, Artificial Sequence
  Description of Artificial Sequence: Synthetic oligonucleotide
uguagcucucaccucucc

SEQ ID NO: 53689 - RNA, 18 nt, Artificial Sequence
  Description of Artificial Sequence: Synthetic oligonucleotide
ggccauguagcucucacc

SEQ ID NO: 53690 - RNA, 18 nt, Artificial Sequence
  Description of Artificial Sequence: Synthetic oligonucleotide
gccugggccauguagcuc

SEQ ID NO: 53691 - RNA, 18 nt, Artificial Sequence
  Description of Artificial Sequence: Synthetic oligonucleotide
gcagggccugggccaugu

SEQ ID NO: 53692 - RNA, 18 nt, Artificial Sequence
  Description of Artificial Sequence: Synthetic oligonucleotide
ccggagcagggccugggc

SEQ ID NO: 53693 - RNA, 18 nt, Artificial Sequence
  Description of Artificial Sequence: Synthetic oligonucleotide
ccccaccggagcagggcc

SEQ ID NO: 53694 - RNA, 18 nt, Artificial Sequence
  Description of Artificial Sequence: Synthetic oligonucleotide
agcugccccaccggagca

SEQ ID NO: 53695 - RNA, 18 nt, Artificial Sequence
  Description of Artificial Sequence: Synthetic oligonucleotide
gcaggagcugccccaccg

SEQ ID NO: 53696 - RNA, 18 nt, Artificial Sequence
  Description of Artificial Sequence: Synthetic oligonucleotide
cgccggcaggagcugccc

SEQ ID NO: 53697 - RNA, 18 nt, Artificial Sequence
  Description of Artificial Sequence: Synthetic oligonucleotide
ccucacgccggcaggagc

SEQ ID NO: 53698 - RNA, 18 nt, Artificial Sequence
  Description of Artificial Sequence: Synthetic oligonucleotide
uguuuccucacgccggca

SEQ ID NO: 53699 - RNA, 18 nt, Artificial Sequence
  Description of Artificial Sequence: Synthetic oligonucleotide
cguccuguuuccucacgc

SEQ ID NO: 53700 - RNA, 18 nt, Artificial Sequence
  Description of Artificial Sequence: Synthetic oligonucleotide
cuuuccguccuguuuccu

SEQ ID NO: 53701 - RNA, 18 nt, Artificial Sequence
  Description of Artificial Sequence: Synthetic oligonucleotide
uguggcuuuccguccugu

SEQ ID NO: 53702 - RNA, 18 nt, Artificial Sequence
  Description of Artificial Sequence: Synthetic oligonucleotide
cucccuguggcuuuccgu

SEQ ID NO: 53703 - RNA, 18 nt, Artificial Sequence
  Description of Artificial Sequence: Synthetic oligonucleotide
ccgggcucccuguggcuu

SEQ ID NO: 53704 - RNA, 18 nt, Artificial Sequence
  Description of Artificial Sequence: Synthetic oligonucleotide
ggcucccgggcucccugu

SEQ ID NO: 53705 - RNA, 18 nt, Artificial Sequence
  Description of Artificial Sequence: Synthetic oligonucleotide
cgcugggcucccgggcuc

SEQ ID NO: 53706 - RNA, 18 nt, Artificial Sequence
  Description of Artificial Sequence: Synthetic oligonucleotide
gcucccgcugggcucccg

SEQ ID NO: 53707 - RNA, 18 nt, Artificial Sequence
  Description of Artificial Sequence: Synthetic oligonucleotide
gccccgcucccgcugggc

SEQ ID NO: 53708 - RNA, 18 nt, Artificial Sequence
  Description of Artificial Sequence: Synthetic oligonucleotide
ccaccgccccgcucccgc

SEQ ID NO: 53709 - RNA, 18 nt, Artificial Sequence
  Description of Artificial Sequence: Synthetic oligonucleotide
ccuccccaccgccccgcu

SEQ ID NO: 53710 - RNA, 18 nt, Artificial Sequence
  Description of Artificial Sequence: Synthetic oligonucleotide
gcuggccuccccaccgcc

SEQ ID NO: 53711 - RNA, 18 nt, Artificial Sequence
  Description of Artificial Sequence: Synthetic oligonucleotide
ggcaggcuggccucccca

SEQ ID NO: 53712 - RNA, 18 nt, Artificial Sequence
  Description of Artificial Sequence: Synthetic oligonucleotide
agagcggcaggcuggccu

SEQ ID NO: 53713 - RNA, 18 nt, Artificial Sequence
  Description of Artificial Sequence: Synthetic oligonucleotide
gggaagagcggcaggcug

SEQ ID NO: 53714 - RNA, 18 nt, Artificial Sequence
  Description of Artificial Sequence: Synthetic oligonucleotide
ugugauuccagccccggg

SEQ ID NO: 53715 - RNA, 18 nt, Artificial Sequence
  Description of Artificial Sequence: Synthetic oligonucleotide
ucuccugugauuccagcc

SEQ ID NO: 53716 - RNA, 18 nt, Artificial Sequence
  Description of Artificial Sequence: Synthetic oligonucleotide
agcgaucuccugugauuc

SEQ ID NO: 53717 - RNA, 18 nt, Artificial Sequence
  Description of Artificial Sequence: Synthetic oligonucleotide
ccgcuagcgaucuccugu

SEQ ID NO: 53718 - RNA, 18 nt, Artificial Sequence
  Description of Artificial Sequence: Synthetic oligonucleotide
ggccuccgcuagcgaucu

SEQ ID NO: 53719 - RNA, 18 nt, Artificial Sequence
  Description of Artificial Sequence: Synthetic oligonucleotide
gggccuccgcuagcgauc

SEQ ID NO: 53720 - RNA, 18 nt, Artificial Sequence
  Description of Artificial Sequence: Synthetic oligonucleotide
cacaccugaugcuuaggg

SEQ ID NO: 53721 - RNA, 18 nt, Artificial Sequence
  Description of Artificial Sequence: Synthetic oligonucleotide
acccgcacaccugaugcu

SEQ ID NO: 53722 - RNA, 18 nt, Artificial Sequence
  Description of Artificial Sequence: Synthetic oligonucleotide
gaaccacccgcacaccug

SEQ ID NO: 53723 - RNA, 18 nt, Artificial Sequence
  Description of Artificial Sequence: Synthetic oligonucleotide
gggaaccacccgcacacc

SEQ ID NO: 53724 - RNA, 18 nt, Artificial Sequence
  Description of Artificial Sequence: Synthetic oligonucleotide
gcaucaggaaaggcuggg

SEQ ID NO: 53725 - RNA, 18 nt, Artificial Sequence
  Description of Artificial Sequence: Synthetic oligonucleotide
caaaggcaucaggaaagg

SEQ ID NO: 53726 - RNA, 18 nt, Artificial Sequence
  Description of Artificial Sequence: Synthetic oligonucleotide
agagccaaaggcaucagg

SEQ ID NO: 53727 - RNA, 18 nt, Artificial Sequence
  Description of Artificial Sequence: Synthetic oligonucleotide
agggcagagccaaaggca

SEQ ID NO: 53728 - RNA, 18 nt, Artificial Sequence
  Description of Artificial Sequence: Synthetic oligonucleotide
uggugagggcagagccaa

SEQ ID NO: 53729 - RNA, 18 nt, Artificial Sequence
  Description of Artificial Sequence: Synthetic oligonucleotide
ggcaguggugagggcaga

SEQ ID NO: 53730 - RNA, 18 nt, Artificial Sequence
  Description of Artificial Sequence: Synthetic oligonucleotide
auggaggcaguggugagg

SEQ ID NO: 53731 - RNA, 18 nt, Artificial Sequence
  Description of Artificial Sequence: Synthetic oligonucleotide
uggaaauggaggcagugg

SEQ ID NO: 53732 - RNA, 18 nt, Artificial Sequence
  Description of Artificial Sequence: Synthetic oligonucleotide
ugcuguggaaauggaggc

SEQ ID NO: 53733 - RNA, 18 nt, Artificial Sequence
  Description of Artificial Sequence: Synthetic oligonucleotide
uguccugcuguggaaaug

SEQ ID NO: 53734 - RNA, 18 nt, Artificial Sequence
  Description of Artificial Sequence: Synthetic oligonucleotide
cagaguguccugcugugg

SEQ ID NO: 53735 - RNA, 18 nt, Artificial Sequence
  Description of Artificial Sequence: Synthetic oligonucleotide
cucuccagaguguccugc

SEQ ID NO: 53736 - RNA, 18 nt, Artificial Sequence
  Description of Artificial Sequence: Synthetic oligonucleotide
cucaccucuccagagugu

SEQ ID NO: 53737 - RNA, 18 nt, Artificial Sequence
  Description of Artificial Sequence: Synthetic oligonucleotide
cccaccucaccucuccag

SEQ ID NO: 53738 - RNA, 18 nt, Artificial Sequence
  Description of Artificial Sequence: Synthetic oligonucleotide
cuccucccaccucaccuc

SEQ ID NO: 53739 - RNA, 18 nt, Artificial Sequence
  Description of Artificial Sequence: Synthetic oligonucleotide
gcucccuccucccaccuc

SEQ ID NO: 53740 - RNA, 18 nt, Artificial Sequence
  Description of Artificial Sequence: Synthetic oligonucleotide
gggcucccuccucccacc

SEQ ID NO: 53741 - RNA, 18 nt, Artificial Sequence
  Description of Artificial Sequence: Synthetic oligonucleotide
agcucugcgcgggaaggg

SEQ ID NO: 53742 - RNA, 18 nt, Artificial Sequence
  Description of Artificial Sequence: Synthetic oligonucleotide
ggcugagcucugcgcggg

SEQ ID NO: 53743 - RNA, 18 nt, Artificial Sequence
  Description of Artificial Sequence: Synthetic oligonucleotide
ggacgggcugagcucugc

SEQ ID NO: 53744 - RNA, 18 nt, Artificial Sequence
  Description of Artificial Sequence: Synthetic oligonucleotide
ucauaggacgggcugagc

SEQ ID NO: 53745 - RNA, 18 nt, Artificial Sequence
  Description of Artificial Sequence: Synthetic oligonucleotide
uaugcucauaggacgggc

SEQ ID NO: 53746 - RNA, 18 nt, Artificial Sequence
  Description of Artificial Sequence: Synthetic oligonucleotide
ccggcuaugcucauagga

SEQ ID NO: 53747 - RNA, 18 nt, Artificial Sequence
  Description of Artificial Sequence: Synthetic oligonucleotide
gaggaccggcuaugcuca

SEQ ID NO: 53748 - RNA, 18 nt, Artificial Sequence
  Description of Artificial Sequence: Synthetic oligonucleotide
cugaagaggaccggcuau

SEQ ID NO: 53749 - RNA, 18 nt, Artificial Sequence
  Description of Artificial Sequence: Synthetic oligonucleotide
cggaucugaagaggaccg

SEQ ID NO: 53750 - RNA, 18 nt, Artificial Sequence
  Description of Artificial Sequence: Synthetic oligonucleotide
guccccggaucugaagag

SEQ ID NO: 53751 - RNA, 18 nt, Artificial Sequence
  Description of Artificial Sequence: Synthetic oligonucleotide
ccugaguccccggaucug

SEQ ID NO: 53752 - RNA, 18 nt, Artificial Sequence
  Description of Artificial Sequence: Synthetic oligonucleotide
uggacccugaguccccgg

SEQ ID NO: 53753 - RNA, 18 nt, Artificial Sequence
  Description of Artificial Sequence: Synthetic oligonucleotide
ugugcuggacccugaguc

SEQ ID NO: 53754 - RNA, 18 nt, Artificial Sequence
  Description of Artificial Sequence: Synthetic oligonucleotide
caagaugugcuggacccu

SEQ ID NO: 53755 - RNA, 18 nt, Artificial Sequence
  Description of Artificial Sequence: Synthetic oligonucleotide
gggcaagaugugcuggac

SEQ ID NO: 53756 - RNA, 18 nt, Artificial Sequence
  Description of Artificial Sequence: Synthetic oligonucleotide
ccugucccaggcuguggg

SEQ ID NO: 53757 - RNA, 18 nt, Artificial Sequence
  Description of Artificial Sequence: Synthetic oligonucleotide
cugacccugucccaggcu

SEQ ID NO: 53758 - RNA, 18 nt, Artificial Sequence
  Description of Artificial Sequence: Synthetic oligonucleotide
cagcccugacccuguccc

SEQ ID NO: 53759 - RNA, 18 nt, Artificial Sequence
  Description of Artificial Sequence: Synthetic oligonucleotide
aacuucagcccugacccu

SEQ ID NO: 53760 - RNA, 18 nt, Artificial Sequence
  Description of Artificial Sequence: Synthetic oligonucleotide
gcagcaacuucagcccug

SEQ ID NO: 53761 - RNA, 18 nt, Artificial Sequence
  Description of Artificial Sequence: Synthetic oligonucleotide
cgggugcagcaacuucag

SEQ ID NO: 53762 - RNA, 18 nt, Artificial Sequence
  Description of Artificial Sequence: Synthetic oligonucleotide
guccccgggugcagcaac

SEQ ID NO: 53763 - RNA, 18 nt, Artificial Sequence
  Description of Artificial Sequence: Synthetic oligonucleotide
ccuagguccccgggugca

SEQ ID NO: 53764 - RNA, 18 nt, Artificial Sequence
  Description of Artificial Sequence: Synthetic oligonucleotide
gaggcccuagguccccgg

SEQ ID NO: 53765 - RNA, 18 nt, Artificial Sequence
  Description of Artificial Sequence: Synthetic oligonucleotide
uaaaugaggcccuagguc

SEQ ID NO: 53766 - RNA, 18 nt, Artificial Sequence
  Description of Artificial Sequence: Synthetic oligonucleotide
ugaguuaaaugaggcccu

SEQ ID NO: 53767 - RNA, 18 nt, Artificial Sequence
  Description of Artificial Sequence: Synthetic oligonucleotide
ccccgucuguagagcggg

SEQ ID NO: 53768 - RNA, 18 nt, Artificial Sequence
  Description of Artificial Sequence: Synthetic oligonucleotide
uuccccgucuguagagcg

SEQ ID NO: 53769 - RNA, 18 nt, Artificial Sequence
  Description of Artificial Sequence: Synthetic oligonucleotide
uugguuuccccgucugua

SEQ ID NO: 53770 - RNA, 18 nt, Artificial Sequence
  Description of Artificial Sequence: Synthetic oligonucleotide
uagccuugguuuccccgu

SEQ ID NO: 53771 - RNA, 18 nt, Artificial Sequence
  Description of Artificial Sequence: Synthetic oligonucleotide
ucuccuagccuugguuuc

SEQ ID NO: 53772 - RNA, 18 nt, Artificial Sequence
  Description of Artificial Sequence: Synthetic oligonucleotide
acaguucuccuagccuug

SEQ ID NO: 53773 - RNA, 18 nt, Artificial Sequence
  Description of Artificial Sequence: Synthetic oligonucleotide
aagugacaguucuccuag

SEQ ID NO: 53774 - RNA, 18 nt, Artificial Sequence
  Description of Artificial Sequence: Synthetic oligonucleotide
ugggcaagugacaguucu

SEQ ID NO: 53775 - RNA, 18 nt, Artificial Sequence
  Description of Artificial Sequence: Synthetic oligonucleotide
ugucuugggcaagugaca

SEQ ID NO: 53776 - RNA, 18 nt, Artificial Sequence
  Description of Artificial Sequence: Synthetic oligonucleotide
ccugcugucuugggcaag

SEQ ID NO: 53777 - RNA, 18 nt, Artificial Sequence
  Description of Artificial Sequence: Synthetic oligonucleotide
cggagccugcugucuugg

SEQ ID NO: 53778 - RNA, 18 nt, Artificial Sequence
  Description of Artificial Sequence: Synthetic oligonucleotide
aucaccggagccugcugu

SEQ ID NO: 53779 - RNA, 18 nt, Artificial Sequence
  Description of Artificial Sequence: Synthetic oligonucleotide
gcuccaucaccggagccu

SEQ ID NO: 53780 - RNA, 18 nt, Artificial Sequence
  Description of Artificial Sequence: Synthetic oligonucleotide
uccuggcuccaucaccgg

SEQ ID NO: 53781 - RNA, 18 nt, Artificial Sequence
  Description of Artificial Sequence: Synthetic oligonucleotide
uggaauccuggcuccauc

SEQ ID NO: 53782 - RNA, 18 nt, Artificial Sequence
  Description of Artificial Sequence: Synthetic oligonucleotide
ugguuuggaauccuggcu

SEQ ID NO: 53783 - RNA, 18 nt, Artificial Sequence
  Description of Artificial Sequence: Synthetic oligonucleotide
acuucugguuuggaaucc

SEQ ID NO: 53784 - RNA, 18 nt, Artificial Sequence
  Description of Artificial Sequence: Synthetic oligonucleotide
gugggacuucugguuugg

SEQ ID NO: 53785 - RNA, 18 nt, Artificial Sequence
  Description of Artificial Sequence: Synthetic oligonucleotide
ugggagugggacuucugg

SEQ ID NO: 53786 - RNA, 18 nt, Artificial Sequence
  Description of Artificial Sequence: Synthetic oligonucleotide
acuggugggagugggacu

SEQ ID NO: 53787 - RNA, 18 nt, Artificial Sequence
  Description of Artificial Sequence: Synthetic oligonucleotide
uagggacuggugggagug

SEQ ID NO: 53788 - RNA, 18 nt, Artificial Sequence
  Description of Artificial Sequence: Synthetic oligonucleotide
gugcuuagggacuggugg

SEQ ID NO: 53789 - RNA, 18 nt, Artificial Sequence
  Description of Artificial Sequence: Synthetic oligonucleotide
uucaugugcuuagggacu

SEQ ID NO: 53790 - RNA, 18 nt, Artificial Sequence
  Description of Artificial Sequence: Synthetic oligonucleotide
uggacuucaugugcuuag

SEQ ID NO: 53791 - RNA, 18 nt, Artificial Sequence
  Description of Artificial Sequence: Synthetic oligonucleotide
cagccuggacuucaugug

SEQ ID NO: 53792 - RNA, 18 nt, Artificial Sequence
  Description of Artificial Sequence: Synthetic oligonucleotide
aaacucagccuggacuuc

SEQ ID NO: 53793 - RNA, 18 nt, Artificial Sequence
  Description of Artificial Sequence: Synthetic oligonucleotide
uccccaaacucagccugg

SEQ ID NO: 53794 - RNA, 18 nt, Artificial Sequence
  Description of Artificial Sequence: Synthetic oligonucleotide
ggcuguccccaaacucag

SEQ ID NO: 53795 - RNA, 18 nt, Artificial Sequence
  Description of Artificial Sequence: Synthetic oligonucleotide
ggcaaggcuguccccaaa

SEQ ID NO: 53796 - RNA, 18 nt, Artificial Sequence
  Description of Artificial Sequence: Synthetic oligonucleotide
cuccaggcaaggcugucc

SEQ ID NO: 53797 - RNA, 18 nt, Artificial Sequence
  Description of Artificial Sequence: Synthetic oligonucleotide
cucaccuccaggcaaggc

SEQ ID NO: 53798 - RNA, 18 nt, Artificial Sequence
  Description of Artificial Sequence: Synthetic oligonucleotide
uucuucucaccuccaggc

SEQ ID NO: 53799 - RNA, 18 nt, Artificial Sequence
  Description of Artificial Sequence: Synthetic oligonucleotide
gauucuucuucucaccuc

SEQ ID NO: 53800 - RNA, 18 nt, Artificial Sequence
  Description of Artificial Sequence: Synthetic oligonucleotide
gcuaugauucuucuucuc

SEQ ID NO: 53801 - RNA, 18 nt, Artificial Sequence
  Description of Artificial Sequence: Synthetic oligonucleotide
cuguagcuaugauucuuc

SEQ ID NO: 53802 - RNA, 18 nt, Artificial Sequence
  Description of Artificial Sequence: Synthetic oligonucleotide
uuucccuguagcuaugau

SEQ ID NO: 53803 - RNA, 18 nt, Artificial Sequence
  Description of Artificial Sequence: Synthetic oligonucleotide
gcuaguuucccuguagcu

SEQ ID NO: 53804 - RNA, 18 nt, Artificial Sequence
  Description of Artificial Sequence: Synthetic oligonucleotide
ccugugcuaguuucccug

SEQ ID NO: 53805 - RNA, 18 nt, Artificial Sequence
  Description of Artificial Sequence: Synthetic oligonucleotide
aaggcccugugcuaguuu

SEQ ID NO: 53806 - RNA, 18 nt, Artificial Sequence
  Description of Artificial Sequence: Synthetic oligonucleotide
gggccaaggcccugugcu

SEQ ID NO: 53807 - RNA, 18 nt, Artificial Sequence
  Description of Artificial Sequence: Synthetic oligonucleotide
cuccuccacaucccuggg

SEQ ID NO: 53808 - RNA, 18 nt, Artificial Sequence
  Description of Artificial Sequence: Synthetic oligonucleotide
gucuccuccacaucccug

SEQ ID NO: 53809 - RNA, 18 nt, Artificial Sequence
  Description of Artificial Sequence: Synthetic oligonucleotide
uccccgucuccuccacau

SEQ ID NO: 53810 - RNA, 18 nt, Artificial Sequence
  Description of Artificial Sequence: Synthetic oligonucleotide
ggccuuccccgucuccuc

SEQ ID NO: 53811 - RNA, 18 nt, Artificial Sequence
  Description of Artificial Sequence: Synthetic oligonucleotide
gaugcggccuuccccguc

SEQ ID NO: 53812 - RNA, 18 nt, Artificial Sequence
  Description of Artificial Sequence: Synthetic oligonucleotide
gggccgaugcggccuucc

SEQ ID NO: 53813 - RNA, 18 nt, Artificial Sequence
  Description of Artificial Sequence: Synthetic oligonucleotide
agcuccagcagaggcggg

SEQ ID NO: 53814 - RNA, 18 nt, Artificial Sequence
  Description of Artificial Sequence: Synthetic oligonucleotide
ucacagcuccagcagagg

SEQ ID NO: 53815 - RNA, 18 nt, Artificial Sequence
  Description of Artificial Sequence: Synthetic oligonucleotide
acaccucacagcuccagc

SEQ ID NO: 53816 - RNA, 18 nt, Artificial Sequence
  Description of Artificial Sequence: Synthetic oligonucleotide
cccccacaccucacagcu

SEQ ID NO: 53817 - RNA, 18 nt, Artificial Sequence
  Description of Artificial Sequence: Synthetic oligonucleotide
cgcaccccccacaccuca

SEQ ID NO: 53818 - RNA, 18 nt, Artificial Sequence
  Description of Artificial Sequence: Synthetic oligonucleotide
ggccccgcaccccccaca

SEQ ID NO: 53819 - RNA, 18 nt, Artificial Sequence
  Description of Artificial Sequence: Synthetic oligonucleotide
gcaaaggccccgcacccc

SEQ ID NO: 53820 - RNA, 18 nt, Artificial Sequence
  Description of Artificial Sequence: Synthetic oligonucleotide
agcaagcaaaggccccgc

SEQ ID NO: 53821 - RNA, 18 nt, Artificial Sequence
  Description of Artificial Sequence: Synthetic oligonucleotide
uguacagcaagcaaaggc

SEQ ID NO: 53822 - RNA, 18 nt, Artificial Sequence
  Description of Artificial Sequence: Synthetic oligonucleotide
cugcauguacagcaagca

SEQ ID NO: 53823 - RNA, 18 nt, Artificial Sequence
  Description of Artificial Sequence: Synthetic oligonucleotide
cucaucugcauguacagc

SEQ ID NO: 53824 - RNA, 18 nt, Artificial Sequence
  Description of Artificial Sequence: Synthetic oligonucleotide
ggcgucucaucugcaugu

SEQ ID NO: 53825 - RNA, 18 nt, Artificial Sequence
  Description of Artificial Sequence: Synthetic oligonucleotide
ggguaggcgucucaucug

SEQ ID NO: 53826 - RNA, 18 nt, Artificial Sequence
  Description of Artificial Sequence: Synthetic oligonucleotide
aguuugggugguccuggg

SEQ ID NO: 53827 - RNA, 18 nt, Artificial Sequence
  Description of Artificial Sequence: Synthetic oligonucleotide
gaacaguuuggguggucc

SEQ ID NO: 53828 - RNA, 18 nt, Artificial Sequence
  Description of Artificial Sequence: Synthetic oligonucleotide
ccaaggaacaguuugggu

SEQ ID NO: 53829 - RNA, 18 nt, Artificial Sequence
  Description of Artificial Sequence: Synthetic oligonucleotide
cucagccaaggaacaguu

SEQ ID NO: 53830 - RNA, 18 nt, Artificial Sequence
  Description of Artificial Sequence: Synthetic oligonucleotide
caggccucagccaaggaa

SEQ ID NO: 53831 - RNA, 18 nt, Artificial Sequence
  Description of Artificial Sequence: Synthetic oligonucleotide
uaugacaggccucagcca

SEQ ID NO: 53832 - RNA, 18 nt, Artificial Sequence
  Description of Artificial Sequence: Synthetic oligonucleotide
ugggcuaugacaggccuc

SEQ ID NO: 53833 - RNA, 18 nt, Artificial Sequence
  Description of Artificial Sequence: Synthetic oligonucleotide
accuuugggcuaugacag

SEQ ID NO: 53834 - RNA, 18 nt, Artificial Sequence
  Description of Artificial Sequence: Synthetic oligonucleotide
cggugaccuuugggcuau

SEQ ID NO: 53835 - RNA, 18 nt, Artificial Sequence
  Description of Artificial Sequence: Synthetic oligonucleotide
ggacacggugaccuuugg

SEQ ID NO: 53836 - RNA, 18 nt, Artificial Sequence
  Description of Artificial Sequence: Synthetic oligonucleotide
uccaaggacacggugacc

SEQ ID NO: 53837 - RNA, 18 nt, Artificial Sequence
  Description of Artificial Sequence: Synthetic oligonucleotide
uuggcuccaaggacacgg

SEQ ID NO: 53838 - RNA, 18 nt, Artificial Sequence
  Description of Artificial Sequence: Synthetic oligonucleotide
gggccuuggcuccaagga

SEQ ID NO: 53839 - RNA, 18 nt, Artificial Sequence
  Description of Artificial Sequence: Synthetic oligonucleotide
cucauuccucccacuggg

SEQ ID NO: 53840 - RNA, 18 nt, Artificial Sequence
  Description of Artificial Sequence: Synthetic oligonucleotide
gguucucauuccucccac

SEQ ID NO: 53841 - RNA, 18 nt, Artificial Sequence
  Description of Artificial Sequence: Synthetic oligonucleotide
aaagcgguucucauuccu

SEQ ID NO: 53842 - RNA, 18 nt, Artificial Sequence
  Description of Artificial Sequence: Synthetic oligonucleotide
aaacaaaagcgguucuca

SEQ ID NO: 53843 - RNA, 18 nt, Artificial Sequence
  Description of Artificial Sequence: Synthetic oligonucleotide
ccuccaaacaaaagcggu

SEQ ID NO: 53844 - RNA, 18 nt, Artificial Sequence
  Description of Artificial Sequence: Synthetic oligonucleotide
cugccccuccaaacaaaa

SEQ ID NO: 53845 - RNA, 18 nt, Artificial Sequence
  Description of Artificial Sequence: Synthetic oligonucleotide
cgugacugccccuccaaa

SEQ ID NO: 53846 - RNA, 18 nt, Artificial Sequence
  Description of Artificial Sequence: Synthetic oligonucleotide
cgccucgugacugccccu

SEQ ID NO: 53847 - RNA, 18 nt, Artificial Sequence
  Description of Artificial Sequence: Synthetic oligonucleotide
ucaugcgccucgugacug

SEQ ID NO: 53848 - RNA, 18 nt, Artificial Sequence
  Description of Artificial Sequence: Synthetic oligonucleotide
cugccucaugcgccucgu

SEQ ID NO: 53849 - RNA, 18 nt, Artificial Sequence
  Description of Artificial Sequence: Synthetic oligonucleotide
ggcggcugccucaugcgc

SEQ ID NO: 53850 - RNA, 18 nt, Artificial Sequence
  Description of Artificial Sequence: Synthetic oligonucleotide
ggcugggcggcugccuca

SEQ ID NO: 53851 - RNA, 18 nt, Artificial Sequence
  Description of Artificial Sequence: Synthetic oligonucleotide
gugagggcugggcggcug

SEQ ID NO: 53852 - RNA, 18 nt, Artificial Sequence
  Description of Artificial Sequence: Synthetic oligonucleotide
gggcggugagggcugggc

SEQ ID NO: 53853 - RNA, 18 nt, Artificial Sequence
  Description of Artificial Sequence: Synthetic oligonucleotide
acggagggcggugagggc

SEQ ID NO: 53854 - RNA, 18 nt, Artificial Sequence
  Description of Artificial Sequence: Synthetic oligonucleotide
gacagacggagggcggug

SEQ ID NO: 53855 - RNA, 18 nt, Artificial Sequence
  Description of Artificial Sequence: Synthetic oligonucleotide
ggacagacagacggaggg

SEQ ID NO: 53856 - RNA, 18 nt, Artificial Sequence
  Description of Artificial Sequence: Synthetic oligonucleotide
aguaaaaguucauguagg

SEQ ID NO: 53857 - RNA, 18 nt, Artificial Sequence
  Description of Artificial Sequence: Synthetic oligonucleotide
uuuguaguaaaaguucau

SEQ ID NO: 53858 - RNA, 18 nt, Artificial Sequence
  Description of Artificial Sequence: Synthetic oligonucleotide
gugcuuuuguaguaaaag

SEQ ID NO: 53859 - RNA, 18 nt, Artificial Sequence
  Description of Artificial Sequence: Synthetic oligonucleotide
ccucagugcuuuuguagu

SEQ ID NO: 53860 - RNA, 18 nt, Artificial Sequence
  Description of Artificial Sequence: Synthetic oligonucleotide
ccagcccucagugcuuuu

SEQ ID NO: 53861 - RNA, 18 nt, Artificial Sequence
  Description of Artificial Sequence: Synthetic oligonucleotide
augcuccagcccucagug

SEQ ID NO: 53862 - RNA, 18 nt, Artificial Sequence
  Description of Artificial Sequence: Synthetic oligonucleotide
ugccaaugcuccagcccu

SEQ ID NO: 53863 - RNA, 18 nt, Artificial Sequence
  Description of Artificial Sequence: Synthetic oligonucleotide
cacguugccaaugcucca

SEQ ID NO: 53864 - RNA, 18 nt, Artificial Sequence
  Description of Artificial Sequence: Synthetic oligonucleotide
aggagcacguugccaaug

SEQ ID NO: 53865 - RNA, 18 nt, Artificial Sequence
  Description of Artificial Sequence: Synthetic oligonucleotide
aguccaggagcacguugc

SEQ ID NO: 53866 - RNA, 18 nt, Artificial Sequence
  Description of Artificial Sequence: Synthetic oligonucleotide
ggugaaguccaggagcac

SEQ ID NO: 53867 - RNA, 18 nt, Artificial Sequence
  Description of Artificial Sequence: Synthetic oligonucleotide
cccccggugaaguccagg

SEQ ID NO: 53868 - RNA, 18 nt, Artificial Sequence
  Description of Artificial Sequence: Synthetic oligonucleotide
agcugcccccggugaagu

SEQ ID NO: 53869 - RNA, 18 nt, Artificial Sequence
  Description of Artificial Sequence: Synthetic oligonucleotide
gcugaagcugcccccggu

SEQ ID NO: 53870 - RNA, 18 nt, Artificial Sequence
  Description of Artificial Sequence: Synthetic oligonucleotide
aggaggcugaagcugccc

SEQ ID NO: 53871 - RNA, 18 nt, Artificial Sequence
  Description of Artificial Sequence: Synthetic oligonucleotide
ucugcaggaggcugaagc

SEQ ID NO: 53872 - RNA, 18 nt, Artificial Sequence
  Description of Artificial Sequence: Synthetic oligonucleotide
gaacaucugcaggaggcu

SEQ ID NO: 53873 - RNA, 18 nt, Artificial Sequence
  Description of Artificial Sequence: Synthetic oligonucleotide
uggaggaacaucugcagg

SEQ ID NO: 53874 - RNA, 18 nt, Artificial Sequence
  Description of Artificial Sequence: Synthetic oligonucleotide
aggacuggaggaacaucu

SEQ ID NO: 53875 - RNA, 18 nt, Artificial Sequence
  Description of Artificial Sequence: Synthetic oligonucleotide
guuguaggacuggaggaa

SEQ ID NO: 53876 - RNA, 18 nt, Artificial Sequence
  Description of Artificial Sequence: Synthetic oligonucleotide
uuugaggagaaacugcuc

SEQ ID NO: 53877 - RNA, 18 nt, Artificial Sequence
  Description of Artificial Sequence: Synthetic oligonucleotide
ggguauuugaggagaaac

SEQ ID NO: 53878 - RNA, 18 nt, Artificial Sequence
  Description of Artificial Sequence: Synthetic oligonucleotide
gucguugcuguucacggg

SEQ ID NO: 53879 - RNA, 18 nt, Artificial Sequence
  Description of Artificial Sequence: Synthetic oligonucleotide
gacgucguugcuguucac

SEQ ID NO: 53880 - RNA, 18 nt, Artificial Sequence
  Description of Artificial Sequence: Synthetic oligonucleotide
aagaagacgucguugcug

SEQ ID NO: 53881 - RNA, 18 nt, Artificial Sequence
  Description of Artificial Sequence: Synthetic oligonucleotide
ggcugaagaagacgucgu

SEQ ID NO: 53882 - RNA, 18 nt, Artificial Sequence
  Description of Artificial Sequence: Synthetic oligonucleotide
gugcaggcugaagaagac

SEQ ID NO: 53883 - RNA, 18 nt, Artificial Sequence
  Description of Artificial Sequence: Synthetic oligonucleotide
accgcgugcaggcugaag

SEQ ID NO: 53884 - RNA, 18 nt, Artificial Sequence
  Description of Artificial Sequence: Synthetic oligonucleotide
ggacaaccgcgugcaggc

SEQ ID NO: 53885 - RNA, 18 nt, Artificial Sequence
  Description of Artificial Sequence: Synthetic oligonucleotide
cgugaggacaaccgcgug

SEQ ID NO: 53886 - RNA, 18 nt, Artificial Sequence
  Description of Artificial Sequence: Synthetic oligonucleotide
aucagcgugaggacaacc

SEQ ID NO: 53887 - RNA, 18 nt, Artificial Sequence
  Description of Artificial Sequence: Synthetic oligonucleotide
ugaugaucagcgugagga

SEQ ID NO: 53888 - RNA, 18 nt, Artificial Sequence
  Description of Artificial Sequence: Synthetic oligonucleotide
cacgaugaugaucagcgu

SEQ ID NO: 53889 - RNA, 18 nt, Artificial Sequence
  Description of Artificial Sequence: Synthetic oligonucleotide
cacugcacgaugaugauc

SEQ ID NO: 53890 - RNA, 18 nt, Artificial Sequence
  Description of Artificial Sequence: Synthetic oligonucleotide
ggcagcacugcacgauga

SEQ ID NO: 53891 - RNA, 18 nt, Artificial Sequence
  Description of Artificial Sequence: Synthetic oligonucleotide
auacaggcagcacugcac

SEQ ID NO: 53892 - RNA, 18 nt, Artificial Sequence
  Description of Artificial Sequence: Synthetic oligonucleotide
gggccagggcuggucuca

SEQ ID NO: 53893 - RNA, 18 nt, Artificial Sequence
  Description of Artificial Sequence: Synthetic oligonucleotide
uggcggguguuggcuggg

SEQ ID NO: 53894 - RNA, 18 nt, Artificial Sequence
  Description of Artificial Sequence: Synthetic oligonucleotide
ggguggcggguguuggcu

SEQ ID NO: 53895 - RNA, 18 nt, Artificial Sequence
  Description of Artificial Sequence: Synthetic oligonucleotide
ugucaaaggugagguggg

SEQ ID NO: 53896 - RNA, 18 nt, Artificial Sequence
  Description of Artificial Sequence: Synthetic oligonucleotide
ucuucugucaaaggugag

SEQ ID NO: 53897 - RNA, 18 nt, Artificial Sequence
  Description of Artificial Sequence: Synthetic oligonucleotide
ccgugucuucugucaaag

SEQ ID NO: 53898 - RNA, 18 nt, Artificial Sequence
  Description of Artificial Sequence: Synthetic oligonucleotide
cucugccgugucuucugu

SEQ ID NO: 53899 - RNA, 18 nt, Artificial Sequence
  Description of Artificial Sequence: Synthetic oligonucleotide
ccaggcucugccgugucu

SEQ ID NO: 53900 - RNA, 18 nt, Artificial Sequence
  Description of Artificial Sequence: Synthetic oligonucleotide
cuuucccaggcucugccg

SEQ ID NO: 53901 - RNA, 18 nt, Artificial Sequence
  Description of Artificial Sequence: Synthetic oligonucleotide
ccuuccuuucccaggcuc

SEQ ID NO: 53902 - RNA, 18 nt, Artificial Sequence
  Description of Artificial Sequence: Synthetic oligonucleotide
cacacccuuccuuuccca

SEQ ID NO: 53903 - RNA, 18 nt, Artificial Sequence
  Description of Artificial Sequence: Synthetic oligonucleotide
gaacacacacccuuccuu

SEQ ID NO: 53904 - RNA, 18 nt, Artificial Sequence
  Description of Artificial Sequence: Synthetic oligonucleotide
ugaaugaacacacacccu

SEQ ID NO: 53905 - RNA, 18 nt, Artificial Sequence
  Description of Artificial Sequence: Synthetic oligonucleotide
cuggaugaaugaacacac

SEQ ID NO: 53906 - RNA, 18 nt, Artificial Sequence
  Description of Artificial Sequence: Synthetic oligonucleotide
aggaccuggaugaaugaa

SEQ ID NO: 53907 - RNA, 18 nt, Artificial Sequence
  Description of Artificial Sequence: Synthetic oligonucleotide
agcacaggaccuggauga

SEQ ID NO: 53908 - RNA, 18 nt, Artificial Sequence
  Description of Artificial Sequence: Synthetic oligonucleotide
ugcccagcacaggaccug

SEQ ID NO: 53909 - RNA, 18 nt, Artificial Sequence
  Description of Artificial Sequence: Synthetic oligonucleotide
uucuaugcccagcacagg

SEQ ID NO: 53910 - RNA, 18 nt, Artificial Sequence
  Description of Artificial Sequence: Synthetic oligonucleotide
gugucuucuaugcccagc

SEQ ID NO: 53911 - RNA, 18 nt, Artificial Sequence
  Description of Artificial Sequence: Synthetic oligonucleotide
caugggugucuucuaugc

SEQ ID NO: 53912 - RNA, 18 nt, Artificial Sequence
  Description of Artificial Sequence: Synthetic oligonucleotide
ggacucaugggugucuuc

SEQ ID NO: 53913 - RNA, 18 nt, Artificial Sequence
  Description of Artificial Sequence: Synthetic oligonucleotide
ggccuggacucaugggug

SEQ ID NO: 53914 - RNA, 18 nt, Artificial Sequence
  Description of Artificial Sequence: Synthetic oligonucleotide
cugagggccuggacucau

SEQ ID NO: 53915 - RNA, 18 nt, Artificial Sequence
  Description of Artificial Sequence: Synthetic oligonucleotide
gggcucugagggccugga

SEQ ID NO: 53916 - RNA, 18 nt, Artificial Sequence
  Description of Artificial Sequence: Synthetic oligonucleotide
ucccucaccccagacuug

SEQ ID NO: 53917 - RNA, 18 nt, Artificial Sequence
  Description of Artificial Sequence: Synthetic oligonucleotide
cugagucccucaccccag

SEQ ID NO: 53918 - RNA, 18 nt, Artificial Sequence
  Description of Artificial Sequence: Synthetic oligonucleotide
ucucccugagucccucac

SEQ ID NO: 53919 - RNA, 18 nt, Artificial Sequence
  Description of Artificial Sequence: Synthetic oligonucleotide
cugccucucccugagucc

SEQ ID NO: 53920 - RNA, 18 nt, Artificial Sequence
  Description of Artificial Sequence: Synthetic oligonucleotide
aggcacugccucucccug

SEQ ID NO: 53921 - RNA, 18 nt, Artificial Sequence
  Description of Artificial Sequence: Synthetic oligonucleotide
aguccaggcacugccucu

SEQ ID NO: 53922 - RNA, 18 nt, Artificial Sequence
  Description of Artificial Sequence: Synthetic oligonucleotide
gccugaguccaggcacug

SEQ ID NO: 53923 - RNA, 18 nt, Artificial Sequence
  Description of Artificial Sequence: Synthetic oligonucleotide
ucucagccugaguccagg

SEQ ID NO: 53924 - RNA, 18 nt, Artificial Sequence
  Description of Artificial Sequence: Synthetic oligonucleotide
acggcucucagccugagu

SEQ ID NO: 53925 - RNA, 18 nt, Artificial Sequence
  Description of Artificial Sequence: Synthetic oligonucleotide
ugugcacggcucucagcc

SEQ ID NO: 53926 - RNA, 18 nt, Artificial Sequence
  Description of Artificial Sequence: Synthetic oligonucleotide
uccucugugcacggcucu

SEQ ID NO: 53927 - RNA, 18 nt, Artificial Sequence
  Description of Artificial Sequence: Synthetic oligonucleotide
ugugcuccucugugcacg

SEQ ID NO: 53928 - RNA, 18 nt, Artificial Sequence
  Description of Artificial Sequence: Synthetic oligonucleotide
cugucugugcuccucugu

SEQ ID NO: 53929 - RNA, 18 nt, Artificial Sequence
  Description of Artificial Sequence: Synthetic oligonucleotide
augagcugucugugcucc

SEQ ID NO: 53930 - RNA, 18 nt, Artificial Sequence
  Description of Artificial Sequence: Synthetic oligonucleotide
ccuccaugagcugucugu

SEQ ID NO: 53931 - RNA, 18 nt, Artificial Sequence
  Description of Artificial Sequence: Synthetic oligonucleotide
gcacuccuccaugagcug

SEQ ID NO: 53932 - RNA, 18 nt, Artificial Sequence
  Description of Artificial Sequence: Synthetic oligonucleotide
gccuugcacuccuccaug

SEQ ID NO: 53933 - RNA, 18 nt, Artificial Sequence
  Description of Artificial Sequence: Synthetic oligonucleotide
ucagggccuugcacuccu

SEQ ID NO: 53934 - RNA, 18 nt, Artificial Sequence
  Description of Artificial Sequence: Synthetic oligonucleotide
agggcucagggccuugca

SEQ ID NO: 53935 - RNA, 18 nt, Artificial Sequence
  Description of Artificial Sequence: Synthetic oligonucleotide
cuggcagggcucagggcc

SEQ ID NO: 53936 - RNA, 18 nt, Artificial Sequence
  Description of Artificial Sequence: Synthetic oligonucleotide
ccucccuggcagggcuca

SEQ ID NO: 53937 - RNA, 18 nt, Artificial Sequence
  Description of Artificial Sequence: Synthetic oligonucleotide
ucccuccucccuggcagg

SEQ ID NO: 53938 - RNA, 18 nt, Artificial Sequence
  Description of Artificial Sequence: Synthetic oligonucleotide
ccuccucccuccucccug

SEQ ID NO: 53939 - RNA, 18 nt, Artificial Sequence
  Description of Artificial Sequence: Synthetic oligonucleotide
ugugcccuccucccuccu

SEQ ID NO: 53940 - RNA, 18 nt, Artificial Sequence
  Description of Artificial Sequence: Synthetic oligonucleotide
ccuucugugcccuccucc

SEQ ID NO: 53941 - RNA, 18 nt, Artificial Sequence
  Description of Artificial Sequence: Synthetic oligonucleotide
uccucccuucugugcccu

SEQ ID NO: 53942 - RNA, 18 nt, Artificial Sequence
  Description of Artificial Sequence: Synthetic oligonucleotide
cucccuccucccuucugu

SEQ ID NO: 53943 - RNA, 18 nt, Artificial Sequence
  Description of Artificial Sequence: Synthetic oligonucleotide
cccuccucccuccucccu

SEQ ID NO: 53944 - RNA, 18 nt, Artificial Sequence
  Description of Artificial Sequence: Synthetic oligonucleotide
cugugcccuccucccucc

SEQ ID NO: 53945 - RNA, 18 nt, Artificial Sequence
  Description of Artificial Sequence: Synthetic oligonucleotide
cccuucugugcccuccuc

SEQ ID NO: 53946 - RNA, 18 nt, Artificial Sequence
  Description of Artificial Sequence: Synthetic oligonucleotide
cuccucccuucugugccc

SEQ ID NO: 53947 - RNA, 18 nt, Artificial Sequence
  Description of Artificial Sequence: Synthetic oligonucleotide
cugcccuccucccuucug

SEQ ID NO: 53948 - RNA, 18 nt, Artificial Sequence
  Description of Artificial Sequence: Synthetic oligonucleotide
uuccucugcccuccuccc

SEQ ID NO: 53949 - RNA, 18 nt, Artificial Sequence
  Description of Artificial Sequence: Synthetic oligonucleotide
gcgucuuccucugcccuc

SEQ ID NO: 53950 - RNA, 18 nt, Artificial Sequence
  Description of Artificial Sequence: Synthetic oligonucleotide
accaagcgucuuccucug

SEQ ID NO: 53951 - RNA, 18 nt, Artificial Sequence
  Description of Artificial Sequence: Synthetic oligonucleotide
gcccaaccaagcgucuuc

SEQ ID NO: 53952 - RNA, 18 nt, Artificial Sequence
  Description of Artificial Sequence: Synthetic oligonucleotide
uuggagcccaaccaagcg

SEQ ID NO: 53953 - RNA, 18 nt, Artificial Sequence
  Description of Artificial Sequence: Synthetic oligonucleotide
cauccuuggagcccaacc

SEQ ID NO: 53954 - RNA, 18 nt, Artificial Sequence
  Description of Artificial Sequence: Synthetic oligonucleotide
ucacucauccuuggagcc

SEQ ID NO: 53955 - RNA, 18 nt, Artificial Sequence
  Description of Artificial Sequence: Synthetic oligonucleotide
gaacuucacucauccuug

SEQ ID NO: 53956 - RNA, 18 nt, Artificial Sequence
  Description of Artificial Sequence: Synthetic oligonucleotide
cauaggaacuucacucau

SEQ ID NO: 53957 - RNA, 18 nt, Artificial Sequence
  Description of Artificial Sequence: Synthetic oligonucleotide
uccuccauaggaacuuca

SEQ ID NO: 53958 - RNA, 18 nt, Artificial Sequence
  Description of Artificial Sequence: Synthetic oligonucleotide
uccccuccuccauaggaa

SEQ ID NO: 53959 - RNA, 18 nt, Artificial Sequence
  Description of Artificial Sequence: Synthetic oligonucleotide
gccccuccccuccuccau

SEQ ID NO: 53960 - RNA, 18 nt, Artificial Sequence
  Description of Artificial Sequence: Synthetic oligonucleotide
cccuggccccuccccucc

SEQ ID NO: 53961 - RNA, 18 nt, Artificial Sequence
  Description of Artificial Sequence: Synthetic oligonucleotide
gcccacccuggccccucc

SEQ ID NO: 53962 - RNA, 18 nt, Artificial Sequence
  Description of Artificial Sequence: Synthetic oligonucleotide
caggagcccacccuggcc

SEQ ID NO: 53963 - RNA, 18 nt, Artificial Sequence
  Description of Artificial Sequence: Synthetic oligonucleotide
cccuccaggagcccaccc

SEQ ID NO: 53964 - RNA, 18 nt, Artificial Sequence
  Description of Artificial Sequence: Synthetic oligonucleotide
cugaccccuccaggagcc

SEQ ID NO: 53965 - RNA, 18 nt, Artificial Sequence
  Description of Artificial Sequence: Synthetic oligonucleotide
gugaccugaccccuccag

SEQ ID NO: 53966 - RNA, 18 nt, Artificial Sequence
  Description of Artificial Sequence: Synthetic oligonucleotide
ccucugugaccugacccc

SEQ ID NO: 53967 - RNA, 18 nt, Artificial Sequence
  Description of Artificial Sequence: Synthetic oligonucleotide
cuuggccucugugaccug

SEQ ID NO: 53968 - RNA, 18 nt, Artificial Sequence
  Description of Artificial Sequence: Synthetic oligonucleotide
ugccccuuggccucugug

SEQ ID NO: 53969 - RNA, 18 nt, Artificial Sequence
  Description of Artificial Sequence: Synthetic oligonucleotide
ucaaaugccccuuggccu

SEQ ID NO: 53970 - RNA, 18 nt, Artificial Sequence
  Description of Artificial Sequence: Synthetic oligonucleotide
cccucucaaaugccccuu

SEQ ID NO: 53971 - RNA, 18 nt, Artificial Sequence
  Description of Artificial Sequence: Synthetic oligonucleotide
agggucccucucaaaugc

SEQ ID NO: 53972 - RNA, 18 nt, Artificial Sequence
  Description of Artificial Sequence: Synthetic oligonucleotide
ugcucagggucccucuca

SEQ ID NO: 53973 - RNA, 18 nt, Artificial Sequence
  Description of Artificial Sequence: Synthetic oligonucleotide
ccgccugcucaggguccc

SEQ ID NO: 53974 - RNA, 18 nt, Artificial Sequence
  Description of Artificial Sequence: Synthetic oligonucleotide
ugcacccgccugcucagg

SEQ ID NO: 53975 - RNA, 18 nt, Artificial Sequence
  Description of Artificial Sequence: Synthetic oligonucleotide
ccagcugcacccgccugc

SEQ ID NO: 53976 - RNA, 18 nt, Artificial Sequence
  Description of Artificial Sequence: Synthetic oligonucleotide
gaagcccagcugcacccg

SEQ ID NO: 53977 - RNA, 18 nt, Artificial Sequence
  Description of Artificial Sequence: Synthetic oligonucleotide
acccugaagcccagcugc

SEQ ID NO: 53978 - RNA, 18 nt, Artificial Sequence
  Description of Artificial Sequence: Synthetic oligonucleotide
cuggcacccugaagccca

SEQ ID NO: 53979 - RNA, 18 nt, Artificial Sequence
  Description of Artificial Sequence: Synthetic oligonucleotide
cccuccuggcacccugaa

SEQ ID NO: 53980 - RNA, 18 nt, Artificial Sequence
  Description of Artificial Sequence: Synthetic oligonucleotide
gggcccccuccuggcacc

SEQ ID NO: 53981 - RNA, 18 nt, Artificial Sequence
  Description of Artificial Sequence: Synthetic oligonucleotide
cacgcgggcccccuccug

SEQ ID NO: 53982 - RNA, 18 nt, Artificial Sequence
  Description of Artificial Sequence: Synthetic oligonucleotide
gcuaagaaagccuagaag

SEQ ID NO: 53983 - RNA, 18 nt, Artificial Sequence
  Description of Artificial Sequence: Synthetic oligonucleotide
caaaagcuaagaaagccu

SEQ ID NO: 53984 - RNA, 18 nt, Artificial Sequence
  Description of Artificial Sequence: Synthetic oligonucleotide
cacaccaaaagcuaagaa

SEQ ID NO: 53985 - RNA, 18 nt, Artificial Sequence
  Description of Artificial Sequence: Synthetic oligonucleotide
cgcuucacaccaaaagcu

SEQ ID NO: 53986 - RNA, 18 nt, Artificial Sequence
  Description of Artificial Sequence: Synthetic oligonucleotide
acucucgcuucacaccaa

SEQ ID NO: 53987 - RNA, 18 nt, Artificial Sequence
  Description of Artificial Sequence: Synthetic oligonucleotide
ccuucacucucgcuucac

SEQ ID NO: 53988 - RNA, 18 nt, Artificial Sequence
  Description of Artificial Sequence: Synthetic oligonucleotide
ggccaccuucacucucgc

SEQ ID NO: 53989 - RNA, 18 nt, Artificial Sequence
  Description of Artificial Sequence: Synthetic oligonucleotide
augugggccaccuucacu

SEQ ID NO: 53990 - RNA, 18 nt, Artificial Sequence
  Description of Artificial Sequence: Synthetic oligonucleotide
gcccaaugugggccaccu

SEQ ID NO: 53991 - RNA, 18 nt, Artificial Sequence
  Description of Artificial Sequence: Synthetic oligonucleotide
cacgggcccaaugugggc

SEQ ID NO: 53992 - RNA, 18 nt, Artificial Sequence
  Description of Artificial Sequence: Synthetic oligonucleotide
cugaacacgggcccaaug

SEQ ID NO: 53993 - RNA, 18 nt, Artificial Sequence
  Description of Artificial Sequence: Synthetic oligonucleotide
uuucccugaacacgggcc

SEQ ID NO: 53994 - RNA, 18 nt, Artificial Sequence
  Description of Artificial Sequence: Synthetic oligonucleotide
uugccuuucccugaacac

SEQ ID NO: 53995 - RNA, 18 nt, Artificial Sequence
  Description of Artificial Sequence: Synthetic oligonucleotide
ucgccuugccuuucccug

SEQ ID NO: 53996 - RNA, 18 nt, Artificial Sequence
  Description of Artificial Sequence: Synthetic oligonucleotide
uccccucgccuugccuuu

SEQ ID NO: 53997 - RNA, 18 nt, Artificial Sequence
  Description of Artificial Sequence: Synthetic oligonucleotide
aucuguccccucgccuug

SEQ ID NO: 53998 - RNA, 18 nt, Artificial Sequence
  Description of Artificial Sequence: Synthetic oligonucleotide
caggaaucuguccccucg

SEQ ID NO: 53999 - RNA, 18 nt, Artificial Sequence
  Description of Artificial Sequence: Synthetic oligonucleotide
gaucucaggaaucugucc

SEQ ID NO: 54000 - RNA, 18 nt, Artificial Sequence
  Description of Artificial Sequence: Synthetic oligonucleotide
cugaggaucucaggaauc

SEQ ID NO: 54001 - RNA, 18 nt, Artificial Sequence
  Description of Artificial Sequence: Synthetic oligonucleotide
gcagccugaggaucucag

SEQ ID NO: 54002 - RNA, 18 nt, Artificial Sequence
  Description of Artificial Sequence: Synthetic oligonucleotide
cggcagcagccugaggau

SEQ ID NO: 54003 - RNA, 18 nt, Artificial Sequence
  Description of Artificial Sequence: Synthetic oligonucleotide
cgacccggcagcagccug

SEQ ID NO: 54004 - RNA, 18 nt, Artificial Sequence
  Description of Artificial Sequence: Synthetic oligonucleotide
ucccacgacccggcagca

SEQ ID NO: 54005 - RNA, 18 nt, Artificial Sequence
  Description of Artificial Sequence: Synthetic oligonucleotide
acucgucccacgacccgg

SEQ ID NO: 54006 - RNA, 18 nt, Artificial Sequence
  Description of Artificial Sequence: Synthetic oligonucleotide
uacugacucgucccacga

SEQ ID NO: 54007 - RNA, 18 nt, Artificial Sequence
  Description of Artificial Sequence: Synthetic oligonucleotide
ccagguacugacucgucc

SEQ ID NO: 54008 - RNA, 18 nt, Artificial Sequence
  Description of Artificial Sequence: Synthetic oligonucleotide
cccagccagguacugacu

SEQ ID NO: 54009 - RNA, 18 nt, Artificial Sequence
  Description of Artificial Sequence: Synthetic oligonucleotide
ccucucccagccagguac

SEQ ID NO: 54010 - RNA, 18 nt, Artificial Sequence
  Description of Artificial Sequence: Synthetic oligonucleotide
uggugccucucccagcca

SEQ ID NO: 54011 - RNA, 18 nt, Artificial Sequence
  Description of Artificial Sequence: Synthetic oligonucleotide
uggccuggugccucuccc

SEQ ID NO: 54012 - RNA, 18 nt, Artificial Sequence
  Description of Artificial Sequence: Synthetic oligonucleotide
ucugguggccuggugccu

SEQ ID NO: 54013 - RNA, 18 nt, Artificial Sequence
  Description of Artificial Sequence: Synthetic oligonucleotide
ggaacucugguggccugg

SEQ ID NO: 54014 - RNA, 18 nt, Artificial Sequence
  Description of Artificial Sequence: Synthetic oligonucleotide
gggucggaacucuggugg

SEQ ID NO: 54015 - RNA, 18 nt, Artificial Sequence
  Description of Artificial Sequence: Synthetic oligonucleotide
cucacuuggagacguggg

SEQ ID NO: 54016 - RNA, 18 nt, Artificial Sequence
  Description of Artificial Sequence: Synthetic oligonucleotide
acucacuuggagacgugg

SEQ ID NO: 54017 - RNA, 18 nt, Artificial Sequence
  Description of Artificial Sequence: Synthetic oligonucleotide
ucagcacucacuuggaga

SEQ ID NO: 54018 - RNA, 18 nt, Artificial Sequence
  Description of Artificial Sequence: Synthetic oligonucleotide
gccucucagcacucacuu

SEQ ID NO: 54019 - RNA, 18 nt, Artificial Sequence
  Description of Artificial Sequence: Synthetic oligonucleotide
ugggcgccucucagcacu

SEQ ID NO: 54020 - RNA, 18 nt, Artificial Sequence
  Description of Artificial Sequence: Synthetic oligonucleotide
agaacugggcgccucuca

SEQ ID NO: 54021 - RNA, 18 nt, Artificial Sequence
  Description of Artificial Sequence: Synthetic oligonucleotide
uuggcagaacugggcgcc

SEQ ID NO: 54022 - RNA, 18 nt, Artificial Sequence
  Description of Artificial Sequence: Synthetic oligonucleotide
ccuacuuggcagaacugg

SEQ ID NO: 54023 - RNA, 18 nt, Artificial Sequence
  Description of Artificial Sequence: Synthetic oligonucleotide
uuguuccuacuuggcaga

SEQ ID NO: 54024 - RNA, 18 nt, Artificial Sequence
  Description of Artificial Sequence: Synthetic oligonucleotide
cugcuuuguuccuacuug

SEQ ID NO: 54025 - RNA, 18 nt, Artificial Sequence
  Description of Artificial Sequence: Synthetic oligonucleotide
ucugucugcuuuguuccu

SEQ ID NO: 54026 - RNA, 18 nt, Artificial Sequence
  Description of Artificial Sequence: Synthetic oligonucleotide
caagcucugucugcuuug

SEQ ID NO: 54027 - RNA, 18 nt, Artificial Sequence
  Description of Artificial Sequence: Synthetic oligonucleotide
acucucaagcucugucug

SEQ ID NO: 54028 - RNA, 18 nt, Artificial Sequence
  Description of Artificial Sequence: Synthetic oligonucleotide
cuuggacucucaagcucu

SEQ ID NO: 54029 - RNA, 18 nt, Artificial Sequence
  Description of Artificial Sequence: Synthetic oligonucleotide
ggcugcuuggacucucaa

SEQ ID NO: 54030 - RNA, 18 nt, Artificial Sequence
  Description of Artificial Sequence: Synthetic oligonucleotide
guucaggcugcuuggacu

SEQ ID NO: 54031 - RNA, 18 nt, Artificial Sequence
  Description of Artificial Sequence: Synthetic oligonucleotide
cuccuguucaggcugcuu

SEQ ID NO: 54032 - RNA, 18 nt, Artificial Sequence
  Description of Artificial Sequence: Synthetic oligonucleotide
agggccuccuguucaggc

SEQ ID NO: 54033 - RNA, 18 nt, Artificial Sequence
  Description of Artificial Sequence: Synthetic oligonucleotide
ucgccagggccuccuguu

SEQ ID NO: 54034 - RNA, 18 nt, Artificial Sequence
  Description of Artificial Sequence: Synthetic oligonucleotide
ucucaucgccagggccuc

SEQ ID NO: 54035 - RNA, 18 nt, Artificial Sequence
  Description of Artificial Sequence: Synthetic oligonucleotide
caccuucucaucgccagg

SEQ ID NO: 54036 - RNA, 18 nt, Artificial Sequence
  Description of Artificial Sequence: Synthetic oligonucleotide
aaccacaccuucucaucg

SEQ ID NO: 54037 - RNA, 18 nt, Artificial Sequence
  Description of Artificial Sequence: Synthetic oligonucleotide
gcaccaaccacaccuucu

SEQ ID NO: 54038 - RNA, 18 nt, Artificial Sequence
  Description of Artificial Sequence: Synthetic oligonucleotide
ccccagcaccaaccacac

SEQ ID NO: 54039 - RNA, 18 nt, Artificial Sequence
  Description of Artificial Sequence: Synthetic oligonucleotide
gacauccccagcaccaac

SEQ ID NO: 54040 - RNA, 18 nt, Artificial Sequence
  Description of Artificial Sequence: Synthetic oligonucleotide
ugcuggacauccccagca

SEQ ID NO: 54041 - RNA, 18 nt, Artificial Sequence
  Description of Artificial Sequence: Synthetic oligonucleotide
gcuggugcuggacauccc

SEQ ID NO: 54042 - RNA, 18 nt, Artificial Sequence
  Description of Artificial Sequence: Synthetic oligonucleotide
ccugggcuggugcuggac

SEQ ID NO: 54043 - RNA, 18 nt, Artificial Sequence
  Description of Artificial Sequence: Synthetic oligonucleotide
ucacaccugggcuggugc

SEQ ID NO: 54044 - RNA, 18 nt, Artificial Sequence
  Description of Artificial Sequence: Synthetic oligonucleotide
aagcaucacaccugggcu

SEQ ID NO: 54045 - RNA, 18 nt, Artificial Sequence
  Description of Artificial Sequence: Synthetic oligonucleotide
acagaaagcaucacaccu

SEQ ID NO: 54046 - RNA, 18 nt, Artificial Sequence
  Description of Artificial Sequence: Synthetic oligonucleotide
ggaccacagaaagcauca

SEQ ID NO: 54047 - RNA, 18 nt, Artificial Sequence
  Description of Artificial Sequence: Synthetic oligonucleotide
cauguggaccacagaaag

SEQ ID NO: 54048 - RNA, 18 nt, Artificial Sequence
  Description of Artificial Sequence: Synthetic oligonucleotide
gggaacauguggaccaca

SEQ ID NO: 54049 - RNA, 18 nt, Artificial Sequence
  Description of Artificial Sequence: Synthetic oligonucleotide
gagccccugcaagguggg

SEQ ID NO: 54050 - RNA, 18 nt, Artificial Sequence
  Description of Artificial Sequence: Synthetic oligonucleotide
ugaaggagccccugcaag

SEQ ID NO: 54051 - RNA, 18 nt, Artificial Sequence
  Description of Artificial Sequence: Synthetic oligonucleotide
ggccuugaaggagccccu

SEQ ID NO: 54052 - RNA, 18 nt, Artificial Sequence
  Description of Artificial Sequence: Synthetic oligonucleotide
acccuggccuugaaggag

SEQ ID NO: 54053 - RNA, 18 nt, Artificial Sequence
  Description of Artificial Sequence: Synthetic oligonucleotide
gcuggacccuggccuuga

SEQ ID NO: 54054 - RNA, 18 nt, Artificial Sequence
  Description of Artificial Sequence: Synthetic oligonucleotide
cggaggcuggacccuggc

SEQ ID NO: 54055 - RNA, 18 nt, Artificial Sequence
  Description of Artificial Sequence: Synthetic oligonucleotide
gggcacggaggcuggacc

SEQ ID NO: 54056 - RNA, 18 nt, Artificial Sequence
  Description of Artificial Sequence: Synthetic oligonucleotide
gggcgggcuuagagaggg

SEQ ID NO: 54057 - RNA, 18 nt, Artificial Sequence
  Description of Artificial Sequence: Synthetic oligonucleotide
agggcgggcuuagagagg

SEQ ID NO: 54058 - RNA, 18 nt, Artificial Sequence
  Description of Artificial Sequence: Synthetic oligonucleotide
cggauagggcgggcuuag

SEQ ID NO: 54059 - RNA, 18 nt, Artificial Sequence
  Description of Artificial Sequence: Synthetic oligonucleotide
ggccccggauagggcggg

SEQ ID NO: 54060 - RNA, 18 nt, Artificial Sequence
  Description of Artificial Sequence: Synthetic oligonucleotide
aggacggccccggauagg

SEQ ID NO: 54061 - RNA, 18 nt, Artificial Sequence
  Description of Artificial Sequence: Synthetic oligonucleotide
gagcaaggacggccccgg

SEQ ID NO: 54062 - RNA, 18 nt, Artificial Sequence
  Description of Artificial Sequence: Synthetic oligonucleotide
gggcugagcaaggacggc

SEQ ID NO: 54063 - RNA, 18 nt, Artificial Sequence
  Description of Artificial Sequence: Synthetic oligonucleotide
cacagaggccacgccggg

SEQ ID NO: 54064 - RNA, 18 nt, Artificial Sequence
  Description of Artificial Sequence: Synthetic oligonucleotide
cccacacagaggccacgc

SEQ ID NO: 54065 - RNA, 18 nt, Artificial Sequence
  Description of Artificial Sequence: Synthetic oligonucleotide
guggacccacacagaggc

SEQ ID NO: 54066 - RNA, 18 nt, Artificial Sequence
  Description of Artificial Sequence: Synthetic oligonucleotide
gagauguggacccacaca

SEQ ID NO: 54067 - RNA, 18 nt, Artificial Sequence
  Description of Artificial Sequence: Synthetic oligonucleotide
gggcagagauguggaccc

SEQ ID NO: 54068 - RNA, 18 nt, Artificial Sequence
  Description of Artificial Sequence: Synthetic oligonucleotide
acacgcgcuggccaccgc

SEQ ID NO: 54069 - RNA, 18 nt, Artificial Sequence
  Description of Artificial Sequence: Synthetic oligonucleotide
ccaggacacgcgcuggcc

SEQ ID NO: 54070 - RNA, 18 nt, Artificial Sequence
  Description of Artificial Sequence: Synthetic oligonucleotide
gcaggccaggacacgcgc

SEQ ID NO: 54071 - RNA, 18 nt, Artificial Sequence
  Description of Artificial Sequence: Synthetic oligonucleotide
cgauggcaggccaggaca

SEQ ID NO: 54072 - RNA, 18 nt, Artificial Sequence
  Description of Artificial Sequence: Synthetic oligonucleotide
gaagccgauggcaggcca

SEQ ID NO: 54073 - RNA, 18 nt, Artificial Sequence
  Description of Artificial Sequence: Synthetic oligonucleotide
accaggaagccgauggca

SEQ ID NO: 54074 - RNA, 18 nt, Artificial Sequence
  Description of Artificial Sequence: Synthetic oligonucleotide
cgagcaccaggaagccga

SEQ ID NO: 54075 - RNA, 18 nt, Artificial Sequence
  Description of Artificial Sequence: Synthetic oligonucleotide
ccacgcgagcaccaggaa

SEQ ID NO: 54076 - RNA, 18 nt, Artificial Sequence
  Description of Artificial Sequence: Synthetic oligonucleotide
aagagccacgcgagcacc

SEQ ID NO: 54077 - RNA, 18 nt, Artificial Sequence
  Description of Artificial Sequence: Synthetic oligonucleotide
augcgaagagccacgcga

SEQ ID NO: 54078 - RNA, 18 nt, Artificial Sequence
  Description of Artificial Sequence: Synthetic oligonucleotide
gacaaaugcgaagagcca

SEQ ID NO: 54079 - RNA, 18 nt, Artificial Sequence
  Description of Artificial Sequence: Synthetic oligonucleotide
auggugacaaaugcgaag

SEQ ID NO: 54080 - RNA, 18 nt, Artificial Sequence
  Description of Artificial Sequence: Synthetic oligonucleotide
cgaucauggugacaaaug

SEQ ID NO: 54081 - RNA, 18 nt, Artificial Sequence
  Description of Artificial Sequence: Synthetic oligonucleotide
agccacgaucauggugac

SEQ ID NO: 54082 - RNA, 18 nt, Artificial Sequence
  Description of Artificial Sequence: Synthetic oligonucleotide
acugcagccacgaucaug

SEQ ID NO: 54083 - RNA, 18 nt, Artificial Sequence
  Description of Artificial Sequence: Synthetic oligonucleotide
cucccacugcagccacga

SEQ ID NO: 54084 - RNA, 18 nt, Artificial Sequence
  Description of Artificial Sequence: Synthetic oligonucleotide
ggucacucccacugcagc

SEQ ID NO: 54085 - RNA, 18 nt, Artificial Sequence
  Description of Artificial Sequence: Synthetic oligonucleotide
cacguggucacucccacu

SEQ ID NO: 54086 - RNA, 18 nt, Artificial Sequence
  Description of Artificial Sequence: Synthetic oligonucleotide
gcagccacguggucacuc

SEQ ID NO: 54087 - RNA, 18 nt, Artificial Sequence
  Description of Artificial Sequence: Synthetic oligonucleotide
aaacugcagccacguggu

SEQ ID NO: 54088 - RNA, 18 nt, Artificial Sequence
  Description of Artificial Sequence: Synthetic oligonucleotide
aagagaaacugcagccac

SEQ ID NO: 54089 - RNA, 18 nt, Artificial Sequence
  Description of Artificial Sequence: Synthetic oligonucleotide
agcagaagagaaacugca

SEQ ID NO: 54090 - RNA, 18 nt, Artificial Sequence
  Description of Artificial Sequence: Synthetic oligonucleotide
ggagaagcagaagagaaa

SEQ ID NO: 54091 - RNA, 18 nt, Artificial Sequence
  Description of Artificial Sequence: Synthetic oligonucleotide
auguaggagaagcagaag

SEQ ID NO: 54092 - RNA, 18 nt, Artificial Sequence
  Description of Artificial Sequence: Synthetic oligonucleotide
gcuugauguaggagaagc

SEQ ID NO: 54093 - RNA, 18 nt, Artificial Sequence
  Description of Artificial Sequence: Synthetic oligonucleotide
ugcgagcuugauguagga

SEQ ID NO: 54094 - RNA, 18 nt, Artificial Sequence
  Description of Artificial Sequence: Synthetic oligonucleotide
gugacugcgagcuugaug

SEQ ID NO: 54095 - RNA, 18 nt, Artificial Sequence
  Description of Artificial Sequence: Synthetic oligonucleotide
ccagcgugacugcgagcu

SEQ ID NO: 54096 - RNA, 18 nt, Artificial Sequence
  Description of Artificial Sequence: Synthetic oligonucleotide
cuugaccagcgugacugc

SEQ ID NO: 54097 - RNA, 18 nt, Artificial Sequence
  Description of Artificial Sequence: Synthetic oligonucleotide
aaauacuugaccagcgug

SEQ ID NO: 54098 - RNA, 18 nt, Artificial Sequence
  Description of Artificial Sequence: Synthetic oligonucleotide
guggaaaauacuugacca

SEQ ID NO: 54099 - RNA, 18 nt, Artificial Sequence
  Description of Artificial Sequence: Synthetic oligonucleotide
cacgcgcuggccaccgcg

SEQ ID NO: 54100 - RNA, 18 nt, Artificial Sequence
  Description of Artificial Sequence: Synthetic oligonucleotide
caggacacgcgcuggcca

SEQ ID NO: 54101 - RNA, 18 nt, Artificial Sequence
  Description of Artificial Sequence: Synthetic oligonucleotide
caggccaggacacgcgcu

SEQ ID NO: 54102 - RNA, 18 nt, Artificial Sequence
  Description of Artificial Sequence: Synthetic oligonucleotide
gauggcaggccaggacac

SEQ ID NO: 54103 - RNA, 18 nt, Artificial Sequence
  Description of Artificial Sequence: Synthetic oligonucleotide
aagccgauggcaggccag

SEQ ID NO: 54104 - RNA, 18 nt, Artificial Sequence
  Description of Artificial Sequence: Synthetic oligonucleotide
ccaggaagccgauggcag

SEQ ID NO: 54105 - RNA, 18 nt, Artificial Sequence
  Description of Artificial Sequence: Synthetic oligonucleotide
gagcaccaggaagccgau

SEQ ID NO: 54106 - RNA, 18 nt, Artificial Sequence
  Description of Artificial Sequence: Synthetic oligonucleotide
cacgcgagcaccaggaag

SEQ ID NO: 54107 - RNA, 18 nt, Artificial Sequence
  Description of Artificial Sequence: Synthetic oligonucleotide
agagccacgcgagcacca

SEQ ID NO: 54108 - RNA, 18 nt, Artificial Sequence
  Description of Artificial Sequence: Synthetic oligonucleotide
ugcgaagagccacgcgag

SEQ ID NO: 54109 - RNA, 18 nt, Artificial Sequence
  Description of Artificial Sequence: Synthetic oligonucleotide
acaaaugcgaagagccac

SEQ ID NO: 54110 - RNA, 18 nt, Artificial Sequence
  Description of Artificial Sequence: Synthetic oligonucleotide
uggugacaaaugcgaaga

SEQ ID NO: 54111 - RNA, 18 nt, Artificial Sequence
  Description of Artificial Sequence: Synthetic oligonucleotide
gaucauggugacaaaugc

SEQ ID NO: 54112 - RNA, 18 nt, Artificial Sequence
  Description of Artificial Sequence: Synthetic oligonucleotide
gccacgaucauggugaca

SEQ ID NO: 54113 - RNA, 18 nt, Artificial Sequence
  Description of Artificial Sequence: Synthetic oligonucleotide
cugcagccacgaucaugg

SEQ ID NO: 54114 - RNA, 18 nt, Artificial Sequence
  Description of Artificial Sequence: Synthetic oligonucleotide
ucccacugcagccacgau

SEQ ID NO: 54115 - RNA, 18 nt, Artificial Sequence
  Description of Artificial Sequence: Synthetic oligonucleotide
gucacucccacugcagcc

SEQ ID NO: 54116 - RNA, 18 nt, Artificial Sequence
  Description of Artificial Sequence: Synthetic oligonucleotide
acguggucacucccacug

SEQ ID NO: 54117 - RNA, 18 nt, Artificial Sequence
  Description of Artificial Sequence: Synthetic oligonucleotide
cagccacguggucacucc

SEQ ID NO: 54118 - RNA, 18 nt, Artificial Sequence
  Description of Artificial Sequence: Synthetic oligonucleotide
aacugcagccacgugguc

SEQ ID NO: 54119 - RNA, 18 nt, Artificial Sequence
  Description of Artificial Sequence: Synthetic oligonucleotide
agagaaacugcagccacg

SEQ ID NO: 54120 - RNA, 18 nt, Artificial Sequence
  Description of Artificial Sequence: Synthetic oligonucleotide
gcagaagagaaacugcag

SEQ ID NO: 54121 - RNA, 18 nt, Artificial Sequence
  Description of Artificial Sequence: Synthetic oligonucleotide
gagaagcagaagagaaac

SEQ ID NO: 54122 - RNA, 18 nt, Artificial Sequence
  Description of Artificial Sequence: Synthetic oligonucleotide
uguaggagaagcagaaga

SEQ ID NO: 54123 - RNA, 18 nt, Artificial Sequence
  Description of Artificial Sequence: Synthetic oligonucleotide
cuugauguaggagaagca

SEQ ID NO: 54124 - RNA, 18 nt, Artificial Sequence
  Description of Artificial Sequence: Synthetic oligonucleotide
gcgagcuugauguaggag

SEQ ID NO: 54125 - RNA, 18 nt, Artificial Sequence
  Description of Artificial Sequence: Synthetic oligonucleotide
ugacugcgagcuugaugu

SEQ ID NO: 54126 - RNA, 18 nt, Artificial Sequence
  Description of Artificial Sequence: Synthetic oligonucleotide
cagcgugacugcgagcuu

SEQ ID NO: 54127 - RNA, 18 nt, Artificial Sequence
  Description of Artificial Sequence: Synthetic oligonucleotide
uugaccagcgugacugcg

SEQ ID NO: 54128 - RNA, 18 nt, Artificial Sequence
  Description of Artificial Sequence: Synthetic oligonucleotide
aauacuugaccagcguga

SEQ ID NO: 54129 - RNA, 18 nt, Artificial Sequence
  Description of Artificial Sequence: Synthetic oligonucleotide
uggaaaauacuugaccag

SEQ ID NO: 54130 - RNA, 18 nt, Artificial Sequence
  Description of Artificial Sequence: Synthetic oligonucleotide
ugugaacagggcccugga

SEQ ID NO: 54131 - RNA, 18 nt, Artificial Sequence
  Description of Artificial Sequence: Synthetic oligonucleotide
ggccaugugaacagggcc

SEQ ID NO: 54132 - RNA, 18 nt, Artificial Sequence
  Description of Artificial Sequence: Synthetic oligonucleotide
ccaccggccaugugaaca

SEQ ID NO: 54133 - RNA, 18 nt, Artificial Sequence
  Description of Artificial Sequence: Synthetic oligonucleotide
uccugccaccggccaugu

SEQ ID NO: 54134 - RNA, 18 nt, Artificial Sequence
  Description of Artificial Sequence: Synthetic oligonucleotide
accucuccugccaccggc

SEQ ID NO: 54135 - RNA, 18 nt, Artificial Sequence
  Description of Artificial Sequence: Synthetic oligonucleotide
cucucaccucuccugcca

SEQ ID NO: 54136 - RNA, 18 nt, Artificial Sequence
  Description of Artificial Sequence: Synthetic oligonucleotide
uguagcucucaccucucc

SEQ ID NO: 54137 - RNA, 18 nt, Artificial Sequence
  Description of Artificial Sequence: Synthetic oligonucleotide
ggccauguagcucucacc

SEQ ID NO: 54138 - RNA, 18 nt, Artificial Sequence
  Description of Artificial Sequence: Synthetic oligonucleotide
gccugggccauguagcuc

SEQ ID NO: 54139 - RNA, 18 nt, Artificial Sequence
  Description of Artificial Sequence: Synthetic oligonucleotide
gcagggccugggccaugu

SEQ ID NO: 54140 - RNA, 18 nt, Artificial Sequence
  Description of Artificial Sequence: Synthetic oligonucleotide
ccggagcagggccugggc

SEQ ID NO: 54141 - RNA, 18 nt, Artificial Sequence
  Description of Artificial Sequence: Synthetic oligonucleotide
ccccaccggagcagggcc

SEQ ID NO: 54142 - RNA, 18 nt, Artificial Sequence
  Description of Artificial Sequence: Synthetic oligonucleotide
agcugccccaccggagca

SEQ ID NO: 54143 - RNA, 18 nt, Artificial Sequence
  Description of Artificial Sequence: Synthetic oligonucleotide
gcaggagcugccccaccg

SEQ ID NO: 54144 - RNA, 18 nt, Artificial Sequence
  Description of Artificial Sequence: Synthetic oligonucleotide
cgccggcaggagcugccc

SEQ ID NO: 54145 - RNA, 18 nt, Artificial Sequence
  Description of Artificial Sequence: Synthetic oligonucleotide
ccucacgccggcaggagc

SEQ ID NO: 54146 - RNA, 18 nt, Artificial Sequence
  Description of Artificial Sequence: Synthetic oligonucleotide
uguuuccucacgccggca

SEQ ID NO: 54147 - RNA, 18 nt, Artificial Sequence
  Description of Artificial Sequence: Synthetic oligonucleotide
cguccuguuuccucacgc

SEQ ID NO: 54148 - RNA, 18 nt, Artificial Sequence
  Description of Artificial Sequence: Synthetic oligonucleotide
cuuuccguccuguuuccu

SEQ ID NO: 54149 - RNA, 18 nt, Artificial Sequence
  Description of Artificial Sequence: Synthetic oligonucleotide
uguggcuuuccguccugu

SEQ ID NO: 54150 - RNA, 18 nt, Artificial Sequence
  Description of Artificial Sequence: Synthetic oligonucleotide
cucccuguggcuuuccgu

SEQ ID NO: 54151 - RNA, 18 nt, Artificial Sequence
  Description of Artificial Sequence: Synthetic oligonucleotide
ccgggcucccuguggcuu

SEQ ID NO: 54152 - RNA, 18 nt, Artificial Sequence
  Description of Artificial Sequence: Synthetic oligonucleotide
ggcucccgggcucccugu

SEQ ID NO: 54153 - RNA, 18 nt, Artificial Sequence
  Description of Artificial Sequence: Synthetic oligonucleotide
cgcugggcucccgggcuc

SEQ ID NO: 54154 - RNA, 18 nt, Artificial Sequence
  Description of Artificial Sequence: Synthetic oligonucleotide
gcucccgcugggcucccg

SEQ ID NO: 54155 - RNA, 18 nt, Artificial Sequence
  Description of Artificial Sequence: Synthetic oligonucleotide
gccccgcucccgcugggc

SEQ ID NO: 54156 - RNA, 18 nt, Artificial Sequence
  Description of Artificial Sequence: Synthetic oligonucleotide
ccaccgccccgcucccgc

SEQ ID NO: 54157 - RNA, 18 nt, Artificial Sequence
  Description of Artificial Sequence: Synthetic oligonucleotide
ccuccccaccgccccgcu

SEQ ID NO: 54158 - RNA, 18 nt, Artificial Sequence
  Description of Artificial Sequence: Synthetic oligonucleotide
gcuggccuccccaccgcc

SEQ ID NO: 54159 - RNA, 18 nt, Artificial Sequence
  Description of Artificial Sequence: Synthetic oligonucleotide
ggcaggcuggccucccca

SEQ ID NO: 54160 - RNA, 18 nt, Artificial Sequence
  Description of Artificial Sequence: Synthetic oligonucleotide
agagcggcaggcuggccu

SEQ ID NO: 54161 - RNA, 18 nt, Artificial Sequence
  Description of Artificial Sequence: Synthetic oligonucleotide
gggaagagcggcaggcug

SEQ ID NO: 54162 - RNA, 18 nt, Artificial Sequence
  Description of Artificial Sequence: Synthetic oligonucleotide
ugugauuccagccccggg

SEQ ID NO: 54163 - RNA, 18 nt, Artificial Sequence
  Description of Artificial Sequence: Synthetic oligonucleotide
ucuccugugauuccagcc

SEQ ID NO: 54164 - RNA, 18 nt, Artificial Sequence
  Description of Artificial Sequence: Synthetic oligonucleotide
agcgaucuccugugauuc

SEQ ID NO: 54165 - RNA, 18 nt, Artificial Sequence
  Description of Artificial Sequence: Synthetic oligonucleotide
ccgcuagcgaucuccugu

SEQ ID NO: 54166 - RNA, 18 nt, Artificial Sequence
  Description of Artificial Sequence: Synthetic oligonucleotide
ggccuccgcuagcgaucu

SEQ ID NO: 54167 - RNA, 18 nt, Artificial Sequence
  Description of Artificial Sequence: Synthetic oligonucleotide
gggccuccgcuagcgauc

SEQ ID NO: 54168 - RNA, 18 nt, Artificial Sequence
  Description of Artificial Sequence: Synthetic oligonucleotide
cacaccugaugcuuaggg

SEQ ID NO: 54169 - RNA, 18 nt, Artificial Sequence
  Description of Artificial Sequence: Synthetic oligonucleotide
acccgcacaccugaugcu

SEQ ID NO: 54170 - RNA, 18 nt, Artificial Sequence
  Description of Artificial Sequence: Synthetic oligonucleotide
gaaccacccgcacaccug

SEQ ID NO: 54171 - RNA, 18 nt, Artificial Sequence
  Description of Artificial Sequence: Synthetic oligonucleotide
gggaaccacccgcacacc

SEQ ID NO: 54172 - RNA, 18 nt, Artificial Sequence
  Description of Artificial Sequence: Synthetic oligonucleotide
gcaucaggaaaggcuggg

SEQ ID NO: 54173 - RNA, 18 nt, Artificial Sequence
  Description of Artificial Sequence: Synthetic oligonucleotide
caaaggcaucaggaaagg

SEQ ID NO: 54174 - RNA, 18 nt, Artificial Sequence
  Description of Artificial Sequence: Synthetic oligonucleotide
agagccaaaggcaucagg

SEQ ID NO: 54175 - RNA, 18 nt, Artificial Sequence
  Description of Artificial Sequence: Synthetic oligonucleotide
agggcagagccaaaggca

SEQ ID NO: 54176 - RNA, 18 nt, Artificial Sequence
  Description of Artificial Sequence: Synthetic oligonucleotide
uggugagggcagagccaa

SEQ ID NO: 54177 - RNA, 18 nt, Artificial Sequence
  Description of Artificial Sequence: Synthetic oligonucleotide
ggcaguggugagggcaga

SEQ ID NO: 54178 - RNA, 18 nt, Artificial Sequence
  Description of Artificial Sequence: Synthetic oligonucleotide
auggaggcaguggugagg

SEQ ID NO: 54179 - RNA, 18 nt, Artificial Sequence
  Description of Artificial Sequence: Synthetic oligonucleotide
uggaaauggaggcagugg

SEQ ID NO: 54180 - RNA, 18 nt, Artificial Sequence
  Description of Artificial Sequence: Synthetic oligonucleotide
ugcuguggaaauggaggc

SEQ ID NO: 54181 - RNA, 18 nt, Artificial Sequence
  Description of Artificial Sequence: Synthetic oligonucleotide
uguccugcuguggaaaug

SEQ ID NO: 54182 - RNA, 18 nt, Artificial Sequence
  Description of Artificial Sequence: Synthetic oligonucleotide
cagaguguccugcugugg

SEQ ID NO: 54183 - RNA, 18 nt, Artificial Sequence
  Description of Artificial Sequence: Synthetic oligonucleotide
cucuccagaguguccugc

SEQ ID NO: 54184 - RNA, 18 nt, Artificial Sequence
  Description of Artificial Sequence: Synthetic oligonucleotide
cucaccucuccagagugu

SEQ ID NO: 54185 - RNA, 18 nt, Artificial Sequence
  Description of Artificial Sequence: Synthetic oligonucleotide
cccaccucaccucuccag

SEQ ID NO: 54186 - RNA, 18 nt, Artificial Sequence
  Description of Artificial Sequence: Synthetic oligonucleotide
cuccucccaccucaccuc

SEQ ID NO: 54187 - RNA, 18 nt, Artificial Sequence
  Description of Artificial Sequence: Synthetic oligonucleotide
gcucccuccucccaccuc

SEQ ID NO: 54188 - RNA, 18 nt, Artificial Sequence
  Description of Artificial Sequence: Synthetic oligonucleotide
gggcucccuccucccacc

SEQ ID NO: 54189 - RNA, 18 nt, Artificial Sequence
  Description of Artificial Sequence: Synthetic oligonucleotide
agcucugcgcgggaaggg

SEQ ID NO: 54190 - RNA, 18 nt, Artificial Sequence
  Description of Artificial Sequence: Synthetic oligonucleotide
ggcugagcucugcgcggg

SEQ ID NO: 54191 - RNA, 18 nt, Artificial Sequence
  Description of Artificial Sequence: Synthetic oligonucleotide
ggacgggcugagcucugc

SEQ ID NO: 54192 - RNA, 18 nt, Artificial Sequence
  Description of Artificial Sequence: Synthetic oligonucleotide
ucauaggacgggcugagc

SEQ ID NO: 54193 - RNA, 18 nt, Artificial Sequence
  Description of Artificial Sequence: Synthetic oligonucleotide
uaugcucauaggacgggc

SEQ ID NO: 54194 - RNA, 18 nt, Artificial Sequence
  Description of Artificial Sequence: Synthetic oligonucleotide
ccggcuaugcucauagga

SEQ ID NO: 54195 - RNA, 18 nt, Artificial Sequence
  Description of Artificial Sequence: Synthetic oligonucleotide
gaggaccggcuaugcuca

SEQ ID NO: 54196 - RNA, 18 nt, Artificial Sequence
  Description of Artificial Sequence: Synthetic oligonucleotide
cugaagaggaccggcuau

SEQ ID NO: 54197 - RNA, 18 nt, Artificial Sequence
  Description of Artificial Sequence: Synthetic oligonucleotide
cggaucugaagaggaccg

SEQ ID NO: 54198 - RNA, 18 nt, Artificial Sequence
  Description of Artificial Sequence: Synthetic oligonucleotide
guccccggaucugaagag

SEQ ID NO: 54199 - RNA, 18 nt, Artificial Sequence
  Description of Artificial Sequence: Synthetic oligonucleotide
ccugaguccccggaucug

SEQ ID NO: 54200 - RNA, 18 nt, Artificial Sequence
  Description of Artificial Sequence: Synthetic oligonucleotide
uggacccugaguccccgg

SEQ ID NO: 54201 - RNA, 18 nt, Artificial Sequence
  Description of Artificial Sequence: Synthetic oligonucleotide
ugugcuggacccugaguc

SEQ ID NO: 54202 - RNA, 18 nt, Artificial Sequence
  Description of Artificial Sequence: Synthetic oligonucleotide
caagaugugcuggacccu

SEQ ID NO: 54203 - RNA, 18 nt, Artificial Sequence
  Description of Artificial Sequence: Synthetic oligonucleotide
gggcaagaugugcuggac

SEQ ID NO: 54204 - RNA, 18 nt, Artificial Sequence
  Description of Artificial Sequence: Synthetic oligonucleotide
ccugucccaggcuguggg

SEQ ID NO: 54205 - RNA, 18 nt, Artificial Sequence
  Description of Artificial Sequence: Synthetic oligonucleotide
cugacccugucccaggcu

SEQ ID NO: 54206 - RNA, 18 nt, Artificial Sequence
  Description of Artificial Sequence: Synthetic oligonucleotide
cagcccugacccuguccc

SEQ ID NO: 54207 - RNA, 18 nt, Artificial Sequence
  Description of Artificial Sequence: Synthetic oligonucleotide
aacuucagcccugacccu

SEQ ID NO: 54208 - RNA, 18 nt, Artificial Sequence
  Description of Artificial Sequence: Synthetic oligonucleotide
gcagcaacuucagcccug

SEQ ID NO: 54209 - RNA, 18 nt, Artificial Sequence
  Description of Artificial Sequence: Synthetic oligonucleotide
cgggugcagcaacuucag

SEQ ID NO: 54210 - RNA, 18 nt, Artificial Sequence
  Description of Artificial Sequence: Synthetic oligonucleotide
guccccgggugcagcaac

SEQ ID NO: 54211 - RNA, 18 nt, Artificial Sequence
  Description of Artificial Sequence: Synthetic oligonucleotide
ccuagguccccgggugca

SEQ ID NO: 54212 - RNA, 18 nt, Artificial Sequence
  Description of Artificial Sequence: Synthetic oligonucleotide
gaggcccuagguccccgg

SEQ ID NO: 54213 - RNA, 18 nt, Artificial Sequence
  Description of Artificial Sequence: Synthetic oligonucleotide
uaaaugaggcccuagguc

SEQ ID NO: 54214 - RNA, 18 nt, Artificial Sequence
  Description of Artificial Sequence: Synthetic oligonucleotide
ugaguuaaaugaggcccu

SEQ ID NO: 54215 - RNA, 18 nt, Artificial Sequence
  Description of Artificial Sequence: Synthetic oligonucleotide
ccccgucuguagagcggg

SEQ ID NO: 54216 - RNA, 18 nt, Artificial Sequence
  Description of Artificial Sequence: Synthetic oligonucleotide
uuccccgucuguagagcg

SEQ ID NO: 54217 - RNA, 18 nt, Artificial Sequence
  Description of Artificial Sequence: Synthetic oligonucleotide
uugguuuccccgucugua

SEQ ID NO: 54218 - RNA, 18 nt, Artificial Sequence
  Description of Artificial Sequence: Synthetic oligonucleotide
uagccuugguuuccccgu

SEQ ID NO: 54219 - RNA, 18 nt, Artificial Sequence
  Description of Artificial Sequence: Synthetic oligonucleotide
ucuccuagccuugguuuc

SEQ ID NO: 54220 - RNA, 18 nt, Artificial Sequence
  Description of Artificial Sequence: Synthetic oligonucleotide
acaguucuccuagccuug

SEQ ID NO: 54221 - RNA, 18 nt, Artificial Sequence
  Description of Artificial Sequence: Synthetic oligonucleotide
aagugacaguucuccuag

SEQ ID NO: 54222 - RNA, 18 nt, Artificial Sequence
  Description of Artificial Sequence: Synthetic oligonucleotide
ugggcaagugacaguucu

SEQ ID NO: 54223 - RNA, 18 nt, Artificial Sequence
  Description of Artificial Sequence: Synthetic oligonucleotide
ugucuugggcaagugaca

SEQ ID NO: 54224 - RNA, 18 nt, Artificial Sequence
  Description of Artificial Sequence: Synthetic oligonucleotide
ccugcugucuugggcaag

SEQ ID NO: 54225 - RNA, 18 nt, Artificial Sequence
  Description of Artificial Sequence: Synthetic oligonucleotide
cggagccugcugucuugg

SEQ ID NO: 54226 - RNA, 18 nt, Artificial Sequence
  Description of Artificial Sequence: Synthetic oligonucleotide
aucaccggagccugcugu

SEQ ID NO: 54227 - RNA, 18 nt, Artificial Sequence
  Description of Artificial Sequence: Synthetic oligonucleotide
gcuccaucaccggagccu

SEQ ID NO: 54228 - RNA, 18 nt, Artificial Sequence
  Description of Artificial Sequence: Synthetic oligonucleotide
uccuggcuccaucaccgg

SEQ ID NO: 54229 - RNA, 18 nt, Artificial Sequence
  Description of Artificial Sequence: Synthetic oligonucleotide
uggaauccuggcuccauc

SEQ ID NO: 54230 - RNA, 18 nt, Artificial Sequence
  Description of Artificial Sequence: Synthetic oligonucleotide
ugguuuggaauccuggcu

SEQ ID NO: 54231 - RNA, 18 nt, Artificial Sequence
  Description of Artificial Sequence: Synthetic oligonucleotide
acuucugguuuggaaucc

SEQ ID NO: 54232 - RNA, 18 nt, Artificial Sequence
  Description of Artificial Sequence: Synthetic oligonucleotide
gugggacuucugguuugg

SEQ ID NO: 54233 - RNA, 18 nt, Artificial Sequence
  Description of Artificial Sequence: Synthetic oligonucleotide
ugggagugggacuucugg

SEQ ID NO: 54234 - RNA, 18 nt, Artificial Sequence
  Description of Artificial Sequence: Synthetic oligonucleotide
acuggugggagugggacu

SEQ ID NO: 54235 - RNA, 18 nt, Artificial Sequence
  Description of Artificial Sequence: Synthetic oligonucleotide
uagggacuggugggagug

SEQ ID NO: 54236 - RNA, 18 nt, Artificial Sequence
  Description of Artificial Sequence: Synthetic oligonucleotide
gugcuuagggacuggugg

SEQ ID NO: 54237 - RNA, 18 nt, Artificial Sequence
  Description of Artificial Sequence: Synthetic oligonucleotide
uucaugugcuuagggacu

SEQ ID NO: 54238 - RNA, 18 nt, Artificial Sequence
  Description of Artificial Sequence: Synthetic oligonucleotide
uggacuucaugugcuuag

SEQ ID NO: 54239 - RNA, 18 nt, Artificial Sequence
  Description of Artificial Sequence: Synthetic oligonucleotide
cagccuggacuucaugug

SEQ ID NO: 54240 - RNA, 18 nt, Artificial Sequence
  Description of Artificial Sequence: Synthetic oligonucleotide
aaacucagccuggacuuc

SEQ ID NO: 54241 - RNA, 18 nt, Artificial Sequence
  Description of Artificial Sequence: Synthetic oligonucleotide
uccccaaacucagccugg

SEQ ID NO: 54242 - RNA, 18 nt, Artificial Sequence
  Description of Artificial Sequence: Synthetic oligonucleotide
ggcuguccccaaacucag

SEQ ID NO: 54243 - RNA, 18 nt, Artificial Sequence
  Description of Artificial Sequence: Synthetic oligonucleotide
ggcaaggcuguccccaaa

SEQ ID NO: 54244 - RNA, 18 nt, Artificial Sequence
  Description of Artificial Sequence: Synthetic oligonucleotide
cuccaggcaaggcugucc

SEQ ID NO: 54245 - RNA, 18 nt, Artificial Sequence
  Description of Artificial Sequence: Synthetic oligonucleotide
cucaccuccaggcaaggc

SEQ ID NO: 54246 - RNA, 18 nt, Artificial Sequence
  Description of Artificial Sequence: Synthetic oligonucleotide
uucuucucaccuccaggc

SEQ ID NO: 54247 - RNA, 18 nt, Artificial Sequence
  Description of Artificial Sequence: Synthetic oligonucleotide
gauucuucuucucaccuc

SEQ ID NO: 54248 - RNA, 18 nt, Artificial Sequence
  Description of Artificial Sequence: Synthetic oligonucleotide
gcuaugauucuucuucuc

SEQ ID NO: 54249 - RNA, 18 nt, Artificial Sequence
  Description of Artificial Sequence: Synthetic oligonucleotide
cuguagcuaugauucuuc

SEQ ID NO: 54250 - RNA, 18 nt, Artificial Sequence
  Description of Artificial Sequence: Synthetic oligonucleotide
uuucccuguagcuaugau

SEQ ID NO: 54251 - RNA, 18 nt, Artificial Sequence
  Description of Artificial Sequence: Synthetic oligonucleotide
gcuaguuucccuguagcu

SEQ ID NO: 54252 - RNA, 18 nt, Artificial Sequence
  Description of Artificial Sequence: Synthetic oligonucleotide
ccugugcuaguuucccug

SEQ ID NO: 54253 - RNA, 18 nt, Artificial Sequence
  Description of Artificial Sequence: Synthetic oligonucleotide
aaggcccugugcuaguuu

SEQ ID NO: 54254 - RNA, 18 nt, Artificial Sequence
  Description of Artificial Sequence: Synthetic oligonucleotide
gggccaaggcccugugcu

SEQ ID NO: 54255 - RNA, 18 nt, Artificial Sequence
  Description of Artificial Sequence: Synthetic oligonucleotide
cuccuccacaucccuggg

SEQ ID NO: 54256 - RNA, 18 nt, Artificial Sequence
  Description of Artificial Sequence: Synthetic oligonucleotide
gucuccuccacaucccug

SEQ ID NO: 54257 - RNA, 18 nt, Artificial Sequence
  Description of Artificial Sequence: Synthetic oligonucleotide
uccccgucuccuccacau

SEQ ID NO: 54258 - RNA, 18 nt, Artificial Sequence
  Description of Artificial Sequence: Synthetic oligonucleotide
ggccuuccccgucuccuc

SEQ ID NO: 54259 - RNA, 18 nt, Artificial Sequence
  Description of Artificial Sequence: Synthetic oligonucleotide
gaugcggccuuccccguc

SEQ ID NO: 54260 - RNA, 18 nt, Artificial Sequence
  Description of Artificial Sequence: Synthetic oligonucleotide
gggccgaugcggccuucc

SEQ ID NO: 54261 - RNA, 18 nt, Artificial Sequence
  Description of Artificial Sequence: Synthetic oligonucleotide
agcuccagcagaggcggg

SEQ ID NO: 54262 - RNA, 18 nt, Artificial Sequence
  Description of Artificial Sequence: Synthetic oligonucleotide
ucacagcuccagcagagg

SEQ ID NO: 54263 - RNA, 18 nt, Artificial Sequence
  Description of Artificial Sequence: Synthetic oligonucleotide
acaccucacagcuccagc

SEQ ID NO: 54264 - RNA, 18 nt, Artificial Sequence
  Description of Artificial Sequence: Synthetic oligonucleotide
cccccacaccucacagcu

SEQ ID NO: 54265 - RNA, 18 nt, Artificial Sequence
  Description of Artificial Sequence: Synthetic oligonucleotide
cgcaccccccacaccuca

SEQ ID NO: 54266 - RNA, 18 nt, Artificial Sequence
  Description of Artificial Sequence: Synthetic oligonucleotide
ggccccgcaccccccaca

SEQ ID NO: 54267 - RNA, 18 nt, Artificial Sequence
  Description of Artificial Sequence: Synthetic oligonucleotide
gcaaaggccccgcacccc

SEQ ID NO: 54268 - RNA, 18 nt, Artificial Sequence
  Description of Artificial Sequence: Synthetic oligonucleotide
agcaagcaaaggccccgc

SEQ ID NO: 54269 - RNA, 18 nt, Artificial Sequence
  Description of Artificial Sequence: Synthetic oligonucleotide
uguacagcaagcaaaggc

SEQ ID NO: 54270 - RNA, 18 nt, Artificial Sequence
  Description of Artificial Sequence: Synthetic oligonucleotide
cugcauguacagcaagca

SEQ ID NO: 54271 - RNA, 18 nt, Artificial Sequence
  Description of Artificial Sequence: Synthetic oligonucleotide
cucaucugcauguacagc

SEQ ID NO: 54272 - RNA, 18 nt, Artificial Sequence
  Description of Artificial Sequence: Synthetic oligonucleotide
ggcgucucaucugcaugu

SEQ ID NO: 54273 - RNA, 18 nt, Artificial Sequence
  Description of Artificial Sequence: Synthetic oligonucleotide
ggguaggcgucucaucug

SEQ ID NO: 54274 - RNA, 18 nt, Artificial Sequence
  Description of Artificial Sequence: Synthetic oligonucleotide
aguuugggugguccuggg

SEQ ID NO: 54275 - RNA, 18 nt, Artificial Sequence
  Description of Artificial Sequence: Synthetic oligonucleotide
gaacaguuuggguggucc

SEQ ID NO: 54276 - RNA, 18 nt, Artificial Sequence
  Description of Artificial Sequence: Synthetic oligonucleotide
ccaaggaacaguuugggu

SEQ ID NO: 54277 - RNA, 18 nt, Artificial Sequence
  Description of Artificial Sequence: Synthetic oligonucleotide
cucagccaaggaacaguu

SEQ ID NO: 54278 - RNA, 18 nt, Artificial Sequence
  Description of Artificial Sequence: Synthetic oligonucleotide
caggccucagccaaggaa

SEQ ID NO: 54279 - RNA, 18 nt, Artificial Sequence
  Description of Artificial Sequence: Synthetic oligonucleotide
uaugacaggccucagcca

SEQ ID NO: 54280 - RNA, 18 nt, Artificial Sequence
  Description of Artificial Sequence: Synthetic oligonucleotide
ugggcuaugacaggccuc

SEQ ID NO: 54281 - RNA, 18 nt, Artificial Sequence
  Description of Artificial Sequence: Synthetic oligonucleotide
accuuugggcuaugacag

SEQ ID NO: 54282 - RNA, 18 nt, Artificial Sequence
  Description of Artificial Sequence: Synthetic oligonucleotide
cggugaccuuugggcuau

SEQ ID NO: 54283 - RNA, 18 nt, Artificial Sequence
  Description of Artificial Sequence: Synthetic oligonucleotide
ggacacggugaccuuugg

SEQ ID NO: 54284 - RNA, 18 nt, Artificial Sequence
  Description of Artificial Sequence: Synthetic oligonucleotide
uccaaggacacggugacc

SEQ ID NO: 54285 - RNA, 18 nt, Artificial Sequence
  Description of Artificial Sequence: Synthetic oligonucleotide
uuggcuccaaggacacgg

SEQ ID NO: 54286 - RNA, 18 nt, Artificial Sequence
  Description of Artificial Sequence: Synthetic oligonucleotide
gggccuuggcuccaagga

SEQ ID NO: 54287 - RNA, 18 nt, Artificial Sequence
  Description of Artificial Sequence: Synthetic oligonucleotide
cucauuccucccacuggg

SEQ ID NO: 54288 - RNA, 18 nt, Artificial Sequence
  Description of Artificial Sequence: Synthetic oligonucleotide
gguucucauuccucccac

SEQ ID NO: 54289 - RNA, 18 nt, Artificial Sequence
  Description of Artificial Sequence: Synthetic oligonucleotide
aaagcgguucucauuccu

SEQ ID NO: 54290 - RNA, 18 nt, Artificial Sequence
  Description of Artificial Sequence: Synthetic oligonucleotide
aaacaaaagcgguucuca

SEQ ID NO: 54291 - RNA, 18 nt, Artificial Sequence
  Description of Artificial Sequence: Synthetic oligonucleotide
ccuccaaacaaaagcggu

SEQ ID NO: 54292 - RNA, 18 nt, Artificial Sequence
  Description of Artificial Sequence: Synthetic oligonucleotide
cugccccuccaaacaaaa

SEQ ID NO: 54293 - RNA, 18 nt, Artificial Sequence
  Description of Artificial Sequence: Synthetic oligonucleotide
cgugacugccccuccaaa

SEQ ID NO: 54294 - RNA, 18 nt, Artificial Sequence
  Description of Artificial Sequence: Synthetic oligonucleotide
cgccucgugacugccccu

SEQ ID NO: 54295 - RNA, 18 nt, Artificial Sequence
  Description of Artificial Sequence: Synthetic oligonucleotide
ucaugcgccucgugacug

SEQ ID NO: 54296 - RNA, 18 nt, Artificial Sequence
  Description of Artificial Sequence: Synthetic oligonucleotide
cugccucaugcgccucgu

SEQ ID NO: 54297 - RNA, 18 nt, Artificial Sequence
  Description of Artificial Sequence: Synthetic oligonucleotide
ggcggcugccucaugcgc

SEQ ID NO: 54298 - RNA, 18 nt, Artificial Sequence
  Description of Artificial Sequence: Synthetic oligonucleotide
ggcugggcggcugccuca

SEQ ID NO: 54299 - RNA, 18 nt, Artificial Sequence
  Description of Artificial Sequence: Synthetic oligonucleotide
gugagggcugggcggcug

SEQ ID NO: 54300 - RNA, 18 nt, Artificial Sequence
  Description of Artificial Sequence: Synthetic oligonucleotide
gggcggugagggcugggc

SEQ ID NO: 54301 - RNA, 18 nt, Artificial Sequence
  Description of Artificial Sequence: Synthetic oligonucleotide
acggagggcggugagggc

SEQ ID NO: 54302 - RNA, 18 nt, Artificial Sequence
  Description of Artificial Sequence: Synthetic oligonucleotide
gacagacggagggcggug

SEQ ID NO: 54303 - RNA, 18 nt, Artificial Sequence
  Description of Artificial Sequence: Synthetic oligonucleotide
ggacagacagacggaggg

SEQ ID NO: 54304 - RNA, 18 nt, Artificial Sequence
  Description of Artificial Sequence: Synthetic oligonucleotide
aguaaaaguucauguagg

SEQ ID NO: 54305 - RNA, 18 nt, Artificial Sequence
  Description of Artificial Sequence: Synthetic oligonucleotide
uuuguaguaaaaguucau

SEQ ID NO: 54306 - RNA, 18 nt, Artificial Sequence
  Description of Artificial Sequence: Synthetic oligonucleotide
gugcuuuuguaguaaaag

SEQ ID NO: 54307 - RNA, 18 nt, Artificial Sequence
  Description of Artificial Sequence: Synthetic oligonucleotide
ccucagugcuuuuguagu

SEQ ID NO: 54308 - RNA, 18 nt, Artificial Sequence
  Description of Artificial Sequence: Synthetic oligonucleotide
ccagcccucagugcuuuu

SEQ ID NO: 54309 - RNA, 18 nt, Artificial Sequence
  Description of Artificial Sequence: Synthetic oligonucleotide
augcuccagcccucagug

SEQ ID NO: 54310 - RNA, 18 nt, Artificial Sequence
  Description of Artificial Sequence: Synthetic oligonucleotide
ugccaaugcuccagcccu

SEQ ID NO: 54311 - RNA, 18 nt, Artificial Sequence
  Description of Artificial Sequence: Synthetic oligonucleotide
cacguugccaaugcucca

SEQ ID NO: 54312 - RNA, 18 nt, Artificial Sequence
  Description of Artificial Sequence: Synthetic oligonucleotide
aggagcacguugccaaug

SEQ ID NO: 54313 - RNA, 18 nt, Artificial Sequence
  Description of Artificial Sequence: Synthetic oligonucleotide
aguccaggagcacguugc

SEQ ID NO: 54314 - RNA, 18 nt, Artificial Sequence
  Description of Artificial Sequence: Synthetic oligonucleotide
ggugaaguccaggagcac

SEQ ID NO: 54315 - RNA, 18 nt, Artificial Sequence
  Description of Artificial Sequence: Synthetic oligonucleotide
cccccggugaaguccagg

SEQ ID NO: 54316 - RNA, 18 nt, Artificial Sequence
  Description of Artificial Sequence: Synthetic oligonucleotide
agcugcccccggugaagu

SEQ ID NO: 54317 - RNA, 18 nt, Artificial Sequence
  Description of Artificial Sequence: Synthetic oligonucleotide
gcugaagcugcccccggu

SEQ ID NO: 54318 - RNA, 18 nt, Artificial Sequence
  Description of Artificial Sequence: Synthetic oligonucleotide
aggaggcugaagcugccc

SEQ ID NO: 54319 - RNA, 18 nt, Artificial Sequence
  Description of Artificial Sequence: Synthetic oligonucleotide
ucugcaggaggcugaagc

SEQ ID NO: 54320 - RNA, 18 nt, Artificial Sequence
  Description of Artificial Sequence: Synthetic oligonucleotide
gaacaucugcaggaggcu

SEQ ID NO: 54321 - RNA, 18 nt, Artificial Sequence
  Description of Artificial Sequence: Synthetic oligonucleotide
uggaggaacaucugcagg

SEQ ID NO: 54322 - RNA, 18 nt, Artificial Sequence
  Description of Artificial Sequence: Synthetic oligonucleotide
aggacuggaggaacaucu

SEQ ID NO: 54323 - RNA, 18 nt, Artificial Sequence
  Description of Artificial Sequence: Synthetic oligonucleotide
guuguaggacuggaggaa

SEQ ID NO: 54324 - RNA, 18 nt, Artificial Sequence
  Description of Artificial Sequence: Synthetic oligonucleotide
gggaggcggguugcauaa

SEQ ID NO: 54325 - RNA, 18 nt, Artificial Sequence
  Description of Artificial Sequence: Synthetic oligonucleotide
cuccaccgggcgggcggg

SEQ ID NO: 54326 - RNA, 18 nt, Artificial Sequence
  Description of Artificial Sequence: Synthetic oligonucleotide
gcuccaccgggcgggcgg

SEQ ID NO: 54327 - RNA, 18 nt, Artificial Sequence
  Description of Artificial Sequence: Synthetic oligonucleotide
uggaagcuccaccgggcg

SEQ ID NO: 54328 - RNA, 18 nt, Artificial Sequence
  Description of Artificial Sequence: Synthetic oligonucleotide
ccgaguggaagcuccacc

SEQ ID NO: 54329 - RNA, 18 nt, Artificial Sequence
  Description of Artificial Sequence: Synthetic oligonucleotide
cgcagccgaguggaagcu

SEQ ID NO: 54330 - RNA, 18 nt, Artificial Sequence
  Description of Artificial Sequence: Synthetic oligonucleotide
cagcccgcagccgagugg

SEQ ID NO: 54331 - RNA, 18 nt, Artificial Sequence
  Description of Artificial Sequence: Synthetic oligonucleotide
cgcuccagcccgcagccg

SEQ ID NO: 54332 - RNA, 18 nt, Artificial Sequence
  Description of Artificial Sequence: Synthetic oligonucleotide
gccgccgcuccagcccgc

SEQ ID NO: 54333 - RNA, 18 nt, Artificial Sequence
  Description of Artificial Sequence: Synthetic oligonucleotide
ugcccgccgccgcuccag

SEQ ID NO: 54334 - RNA, 18 nt, Artificial Sequence
  Description of Artificial Sequence: Synthetic oligonucleotide
acgccugcccgccgccgc

SEQ ID NO: 54335 - RNA, 18 nt, Artificial Sequence
  Description of Artificial Sequence: Synthetic oligonucleotide
uccgcacgccugcccgcc

SEQ ID NO: 54336 - RNA, 18 nt, Artificial Sequence
  Description of Artificial Sequence: Synthetic oligonucleotide
uguccuccgcacgccugc

SEQ ID NO: 54337 - RNA, 18 nt, Artificial Sequence
  Description of Artificial Sequence: Synthetic oligonucleotide
aggaguguccuccgcacg

SEQ ID NO: 54338 - RNA, 18 nt, Artificial Sequence
  Description of Artificial Sequence: Synthetic oligonucleotide
gucgcaggaguguccucc

SEQ ID NO: 54339 - RNA, 18 nt, Artificial Sequence
  Description of Artificial Sequence: Synthetic oligonucleotide
aggauggccgcagagaug

SEQ ID NO: 54340 - RNA, 18 nt, Artificial Sequence
  Description of Artificial Sequence: Synthetic oligonucleotide
gccccaggauggccgcag

SEQ ID NO: 54341 - RNA, 18 nt, Artificial Sequence
  Description of Artificial Sequence: Synthetic oligonucleotide
gaucggccccaggauggc

SEQ ID NO: 54342 - RNA, 18 nt, Artificial Sequence
  Description of Artificial Sequence: Synthetic oligonucleotide
acggagaucggccccagg

SEQ ID NO: 54343 - RNA, 18 nt, Artificial Sequence
  Description of Artificial Sequence: Synthetic oligonucleotide
cagggacggagaucggcc

SEQ ID NO: 54344 - RNA, 18 nt, Artificial Sequence
  Description of Artificial Sequence: Synthetic oligonucleotide
cggcucagggacggagau

SEQ ID NO: 54345 - RNA, 18 nt, Artificial Sequence
  Description of Artificial Sequence: Synthetic oligonucleotide
cgguccggcucagggacg

SEQ ID NO: 54346 - RNA, 18 nt, Artificial Sequence
  Description of Artificial Sequence: Synthetic oligonucleotide
ggcagcgguccggcucag

SEQ ID NO: 54347 - RNA, 18 nt, Artificial Sequence
  Description of Artificial Sequence: Synthetic oligonucleotide
gaaguggcagcgguccgg

SEQ ID NO: 54348 - RNA, 18 nt, Artificial Sequence
  Description of Artificial Sequence: Synthetic oligonucleotide
gauuggaaguggcagcgg

SEQ ID NO: 54349 - RNA, 18 nt, Artificial Sequence
  Description of Artificial Sequence: Synthetic oligonucleotide
caucagauuggaaguggc

SEQ ID NO: 54350 - RNA, 18 nt, Artificial Sequence
  Description of Artificial Sequence: Synthetic oligonucleotide
uagcccaucagauuggaa

SEQ ID NO: 54351 - RNA, 18 nt, Artificial Sequence
  Description of Artificial Sequence: Synthetic oligonucleotide
gaaaguagcccaucagau

SEQ ID NO: 54352 - RNA, 18 nt, Artificial Sequence
  Description of Artificial Sequence: Synthetic oligonucleotide
gggccgaaaguagcccau

SEQ ID NO: 54353 - RNA, 18 nt, Artificial Sequence
  Description of Artificial Sequence: Synthetic oligonucleotide
ugccugggccgaaaguag

SEQ ID NO: 54354 - RNA, 18 nt, Artificial Sequence
  Description of Artificial Sequence: Synthetic oligonucleotide
cccucugccugggccgaa

SEQ ID NO: 54355 - RNA, 18 nt, Artificial Sequence
  Description of Artificial Sequence: Synthetic oligonucleotide
gugugcccucugccuggg

SEQ ID NO: 54356 - RNA, 18 nt, Artificial Sequence
  Description of Artificial Sequence: Synthetic oligonucleotide
cgacagugugcccucugc

SEQ ID NO: 54357 - RNA, 18 nt, Artificial Sequence
  Description of Artificial Sequence: Synthetic oligonucleotide
aaggacgacagugugccc

SEQ ID NO: 54358 - RNA, 18 nt, Artificial Sequence
  Description of Artificial Sequence: Synthetic oligonucleotide
gcgguaaggacgacagug

SEQ ID NO: 54359 - RNA, 18 nt, Artificial Sequence
  Description of Artificial Sequence: Synthetic oligonucleotide
ggguagcgguaaggacga

SEQ ID NO: 54360 - RNA, 18 nt, Artificial Sequence
  Description of Artificial Sequence: Synthetic oligonucleotide
aggguggguagcgguaag

SEQ ID NO: 54361 - RNA, 18 nt, Artificial Sequence
  Description of Artificial Sequence: Synthetic oligonucleotide
gggagaggguggguagcg

SEQ ID NO: 54362 - RNA, 18 nt, Artificial Sequence
  Description of Artificial Sequence: Synthetic oligonucleotide
gggcagggagaggguggg

SEQ ID NO: 54363 - RNA, 18 nt, Artificial Sequence
  Description of Artificial Sequence: Synthetic oligonucleotide
aggaggacuucgguccuu

SEQ ID NO: 54364 - RNA, 18 nt, Artificial Sequence
  Description of Artificial Sequence: Synthetic oligonucleotide
uuucgaggaggacuucgg

SEQ ID NO: 54365 - RNA, 18 nt, Artificial Sequence
  Description of Artificial Sequence: Synthetic oligonucleotide
caagauuucgaggaggac

SEQ ID NO: 54366 - RNA, 18 nt, Artificial Sequence
  Description of Artificial Sequence: Synthetic oligonucleotide
cggugcaagauuucgagg

SEQ ID NO: 54367 - RNA, 18 nt, Artificial Sequence
  Description of Artificial Sequence: Synthetic oligonucleotide
acucccggugcaagauuu

SEQ ID NO: 54368 - RNA, 18 nt, Artificial Sequence
  Description of Artificial Sequence: Synthetic oligonucleotide
ugcagacucccggugcaa

SEQ ID NO: 54369 - RNA, 18 nt, Artificial Sequence
  Description of Artificial Sequence: Synthetic oligonucleotide
aggagugcagacucccgg

SEQ ID NO: 54370 - RNA, 18 nt, Artificial Sequence
  Description of Artificial Sequence: Synthetic oligonucleotide
gggucaggagugcagacu

SEQ ID NO: 54371 - RNA, 18 nt, Artificial Sequence
  Description of Artificial Sequence: Synthetic oligonucleotide
ugagugggucaggagugc

SEQ ID NO: 54372 - RNA, 18 nt, Artificial Sequence
  Description of Artificial Sequence: Synthetic oligonucleotide
uaagaugagugggucagg

SEQ ID NO: 54373 - RNA, 18 nt, Artificial Sequence
  Description of Artificial Sequence: Synthetic oligonucleotide
ggagguaagaugaguggg

SEQ ID NO: 54374 - RNA, 18 nt, Artificial Sequence
  Description of Artificial Sequence: Synthetic oligonucleotide
aagcuggagguaagauga

SEQ ID NO: 54375 - RNA, 18 nt, Artificial Sequence
  Description of Artificial Sequence: Synthetic oligonucleotide
gggacaagcuggagguaa

SEQ ID NO: 54376 - RNA, 18 nt, Artificial Sequence
  Description of Artificial Sequence: Synthetic oligonucleotide
ccgggaaagcugggacgg

SEQ ID NO: 54377 - RNA, 18 nt, Artificial Sequence
  Description of Artificial Sequence: Synthetic oligonucleotide
gggccgggaaagcuggga

SEQ ID NO: 54378 - RNA, 18 nt, Artificial Sequence
  Description of Artificial Sequence: Synthetic oligonucleotide
cugagagucggcuguggg

SEQ ID NO: 54379 - RNA, 18 nt, Artificial Sequence
  Description of Artificial Sequence: Synthetic oligonucleotide
gcccgcugagagucggcu

SEQ ID NO: 54380 - RNA, 18 nt, Artificial Sequence
  Description of Artificial Sequence: Synthetic oligonucleotide
ggcaugcccgcugagagu

SEQ ID NO: 54381 - RNA, 18 nt, Artificial Sequence
  Description of Artificial Sequence: Synthetic oligonucleotide
gggcaugcccgcugagag

SEQ ID NO: 54382 - RNA, 18 nt, Artificial Sequence
  Description of Artificial Sequence: Synthetic oligonucleotide
acgagcaagaagaccggg

SEQ ID NO: 54383 - RNA, 18 nt, Artificial Sequence
  Description of Artificial Sequence: Synthetic oligonucleotide
gaguaacgagcaagaaga

SEQ ID NO: 54384 - RNA, 18 nt, Artificial Sequence
  Description of Artificial Sequence: Synthetic oligonucleotide
cccucgaguaacgagcaa

SEQ ID NO: 54385 - RNA, 18 nt, Artificial Sequence
  Description of Artificial Sequence: Synthetic oligonucleotide
gggccccucgaguaacga

SEQ ID NO: 54386 - RNA, 18 nt, Artificial Sequence
  Description of Artificial Sequence: Synthetic oligonucleotide
uaggguccugguaccggg

SEQ ID NO: 54387 - RNA, 18 nt, Artificial Sequence
  Description of Artificial Sequence: Synthetic oligonucleotide
ccuaauaggguccuggua

SEQ ID NO: 54388 - RNA, 18 nt, Artificial Sequence
  Description of Artificial Sequence: Synthetic oligonucleotide
gaaagccuaauagggucc

SEQ ID NO: 54389 - RNA, 18 nt, Artificial Sequence
  Description of Artificial Sequence: Synthetic oligonucleotide
gcgcugaaagccuaauag

SEQ ID NO: 54390 - RNA, 18 nt, Artificial Sequence
  Description of Artificial Sequence: Synthetic oligonucleotide
gggagcgcugaaagccua

SEQ ID NO: 54391 - RNA, 18 nt, Artificial Sequence
  Description of Artificial Sequence: Synthetic oligonucleotide
ggagaacagagacacggg

SEQ ID NO: 54392 - RNA, 18 nt, Artificial Sequence
  Description of Artificial Sequence: Synthetic oligonucleotide
ggacuggagaacagagac

SEQ ID NO: 54393 - RNA, 18 nt, Artificial Sequence
  Description of Artificial Sequence: Synthetic oligonucleotide
gccagggacuggagaaca

SEQ ID NO: 54394 - RNA, 18 nt, Artificial Sequence
  Description of Artificial Sequence: Synthetic oligonucleotide
gcagggccagggacugga

SEQ ID NO: 54395 - RNA, 18 nt, Artificial Sequence
  Description of Artificial Sequence: Synthetic oligonucleotide
gcggcgcagggccaggga

SEQ ID NO: 54396 - RNA, 18 nt, Artificial Sequence
  Description of Artificial Sequence: Synthetic oligonucleotide
cacaggcggcgcagggcc

SEQ ID NO: 54397 - RNA, 18 nt, Artificial Sequence
  Description of Artificial Sequence: Synthetic oligonucleotide
gacaucacaggcggcgca

SEQ ID NO: 54398 - RNA, 18 nt, Artificial Sequence
  Description of Artificial Sequence: Synthetic oligonucleotide
gggcugacaucacaggcg

SEQ ID NO: 54399 - RNA, 18 nt, Artificial Sequence
  Description of Artificial Sequence: Synthetic oligonucleotide
gaagugggcugacaucac

SEQ ID NO: 54400 - RNA, 18 nt, Artificial Sequence
  Description of Artificial Sequence: Synthetic oligonucleotide
aguccgaagugggcugac

SEQ ID NO: 54401 - RNA, 18 nt, Artificial Sequence
  Description of Artificial Sequence: Synthetic oligonucleotide
guucuaguccgaaguggg

SEQ ID NO: 54402 - RNA, 18 nt, Artificial Sequence
  Description of Artificial Sequence: Synthetic oligonucleotide
gggauguucuaguccgaa

SEQ ID NO: 54403 - RNA, 18 nt, Artificial Sequence
  Description of Artificial Sequence: Synthetic oligonucleotide
ggaacgggauguucuagu

SEQ ID NO: 54404 - RNA, 18 nt, Artificial Sequence
  Description of Artificial Sequence: Synthetic oligonucleotide
cgcugggaacgggauguu

SEQ ID NO: 54405 - RNA, 18 nt, Artificial Sequence
  Description of Artificial Sequence: Synthetic oligonucleotide
accagcgcugggaacggg

SEQ ID NO: 54406 - RNA, 18 nt, Artificial Sequence
  Description of Artificial Sequence: Synthetic oligonucleotide
caggaaccagcgcuggga

SEQ ID NO: 54407 - RNA, 18 nt, Artificial Sequence
  Description of Artificial Sequence: Synthetic oligonucleotide
aacagcaggaaccagcgc

SEQ ID NO: 54408 - RNA, 18 nt, Artificial Sequence
  Description of Artificial Sequence: Synthetic oligonucleotide
uggccaacagcaggaacc

SEQ ID NO: 54409 - RNA, 18 nt, Artificial Sequence
  Description of Artificial Sequence: Synthetic oligonucleotide
gguuguggccaacagcag

SEQ ID NO: 54410 - RNA, 18 nt, Artificial Sequence
  Description of Artificial Sequence: Synthetic oligonucleotide
gggaagguuguggccaac

SEQ ID NO: 54411 - RNA, 18 nt, Artificial Sequence
  Description of Artificial Sequence: Synthetic oligonucleotide
gaaaagggaagguugugg

SEQ ID NO: 54412 - RNA, 18 nt, Artificial Sequence
  Description of Artificial Sequence: Synthetic oligonucleotide
gggaaaagggaagguugu

SEQ ID NO: 54413 - RNA, 18 nt, Artificial Sequence
  Description of Artificial Sequence: Synthetic oligonucleotide
auuuucugagcgccaggg

SEQ ID NO: 54414 - RNA, 18 nt, Artificial Sequence
  Description of Artificial Sequence: Synthetic oligonucleotide
ugagcauuuucugagcgc

SEQ ID NO: 54415 - RNA, 18 nt, Artificial Sequence
  Description of Artificial Sequence: Synthetic oligonucleotide
acuacugagcauuuucug

SEQ ID NO: 54416 - RNA, 18 nt, Artificial Sequence
  Description of Artificial Sequence: Synthetic oligonucleotide
ccccuacuacugagcauu

SEQ ID NO: 54417 - RNA, 18 nt, Artificial Sequence
  Description of Artificial Sequence: Synthetic oligonucleotide
ccacaccccuacuacuga

SEQ ID NO: 54418 - RNA, 18 nt, Artificial Sequence
  Description of Artificial Sequence: Synthetic oligonucleotide
uccaaccacaccccuacu

SEQ ID NO: 54419 - RNA, 18 nt, Artificial Sequence
  Description of Artificial Sequence: Synthetic oligonucleotide
ccccguccaaccacaccc

SEQ ID NO: 54420 - RNA, 18 nt, Artificial Sequence
  Description of Artificial Sequence: Synthetic oligonucleotide
cgguugcuggagggacca

SEQ ID NO: 54421 - RNA, 18 nt, Artificial Sequence
  Description of Artificial Sequence: Synthetic oligonucleotide
cucagcgguugcuggagg

SEQ ID NO: 54422 - RNA, 18 nt, Artificial Sequence
  Description of Artificial Sequence: Synthetic oligonucleotide
cugagcucagcgguugcu

SEQ ID NO: 54423 - RNA, 18 nt, Artificial Sequence
  Description of Artificial Sequence: Synthetic oligonucleotide
agcugcugagcucagcgg

SEQ ID NO: 54424 - RNA, 18 nt, Artificial Sequence
  Description of Artificial Sequence: Synthetic oligonucleotide
acgucagcugcugagcuc

SEQ ID NO: 54425 - RNA, 18 nt, Artificial Sequence
  Description of Artificial Sequence: Synthetic oligonucleotide
aaccgacgucagcugcug

SEQ ID NO: 54426 - RNA, 18 nt, Artificial Sequence
  Description of Artificial Sequence: Synthetic oligonucleotide
agggaaaccgacgucagc

SEQ ID NO: 54427 - RNA, 18 nt, Artificial Sequence
  Description of Artificial Sequence: Synthetic oligonucleotide
ucgccagggaaaccgacg

SEQ ID NO: 54428 - RNA, 18 nt, Artificial Sequence
  Description of Artificial Sequence: Synthetic oligonucleotide
cacggucgccagggaaac

SEQ ID NO: 54429 - RNA, 18 nt, Artificial Sequence
  Description of Artificial Sequence: Synthetic oligonucleotide
gccgccacggucgccagg

SEQ ID NO: 54430 - RNA, 18 nt, Artificial Sequence
  Description of Artificial Sequence: Synthetic oligonucleotide
ccgccgccgccacggucg

SEQ ID NO: 54431 - RNA, 18 nt, Artificial Sequence
  Description of Artificial Sequence: Synthetic oligonucleotide
cgcuuccgccgccgccac

SEQ ID NO: 54432 - RNA, 18 nt, Artificial Sequence
  Description of Artificial Sequence: Synthetic oligonucleotide
ccacgcgcuuccgccgcc

SEQ ID NO: 54433 - RNA, 18 nt, Artificial Sequence
  Description of Artificial Sequence: Synthetic oligonucleotide
ccccaccacgcgcuuccg

SEQ ID NO: 54434 - RNA, 18 nt, Artificial Sequence
  Description of Artificial Sequence: Synthetic oligonucleotide
cgcggccccaccacgcgc

SEQ ID NO: 54435 - RNA, 18 nt, Artificial Sequence
  Description of Artificial Sequence: Synthetic oligonucleotide
acgugcgcggccccacca

SEQ ID NO: 54436 - RNA, 18 nt, Artificial Sequence
  Description of Artificial Sequence: Synthetic oligonucleotide
cgccgacgugcgcggccc

SEQ ID NO: 54437 - RNA, 18 nt, Artificial Sequence
  Description of Artificial Sequence: Synthetic oligonucleotide
augcgcgccgacgugcgc

SEQ ID NO: 54438 - RNA, 18 nt, Artificial Sequence
  Description of Artificial Sequence: Synthetic oligonucleotide
ugcacaugcgcgccgacg

SEQ ID NO: 54439 - RNA, 18 nt, Artificial Sequence
  Description of Artificial Sequence: Synthetic oligonucleotide
cccgcugcacaugcgcgc

SEQ ID NO: 54440 - RNA, 18 nt, Artificial Sequence
  Description of Artificial Sequence: Synthetic oligonucleotide
ccacccccgcugcacaug

SEQ ID NO: 54441 - RNA, 18 nt, Artificial Sequence
  Description of Artificial Sequence: Synthetic oligonucleotide
cggugccacccccgcugc

SEQ ID NO: 54442 - RNA, 18 nt, Artificial Sequence
  Description of Artificial Sequence: Synthetic oligonucleotide
aggcuaauuuuauccggg

SEQ ID NO: 54443 - RNA, 18 nt, Artificial Sequence
  Description of Artificial Sequence: Synthetic oligonucleotide
ccuccaggcuaauuuuau

SEQ ID NO: 54444 - RNA, 18 nt, Artificial Sequence
  Description of Artificial Sequence: Synthetic oligonucleotide
uuaggccuccaggcuaau

SEQ ID NO: 54445 - RNA, 18 nt, Artificial Sequence
  Description of Artificial Sequence: Synthetic oligonucleotide
uauauuuaggccuccagg

SEQ ID NO: 54446 - RNA, 18 nt, Artificial Sequence
  Description of Artificial Sequence: Synthetic oligonucleotide
ccuccuauauuuaggccu

SEQ ID NO: 54447 - RNA, 18 nt, Artificial Sequence
  Description of Artificial Sequence: Synthetic oligonucleotide
ggucgccuccuauauuua

SEQ ID NO: 54448 - RNA, 18 nt, Artificial Sequence
  Description of Artificial Sequence: Synthetic oligonucleotide
gagcuggucgccuccuau

SEQ ID NO: 54449 - RNA, 18 nt, Artificial Sequence
  Description of Artificial Sequence: Synthetic oligonucleotide
gaggugagcuggucgccu

SEQ ID NO: 54450 - RNA, 18 nt, Artificial Sequence
  Description of Artificial Sequence: Synthetic oligonucleotide
agcaggaggugagcuggu

SEQ ID NO: 54451 - RNA, 18 nt, Artificial Sequence
  Description of Artificial Sequence: Synthetic oligonucleotide
cucggagcaggaggugag

SEQ ID NO: 54452 - RNA, 18 nt, Artificial Sequence
  Description of Artificial Sequence: Synthetic oligonucleotide
aaggccucggagcaggag

SEQ ID NO: 54453 - RNA, 18 nt, Artificial Sequence
  Description of Artificial Sequence: Synthetic oligonucleotide
ccuccaaggccucggagc

SEQ ID NO: 54454 - RNA, 18 nt, Artificial Sequence
  Description of Artificial Sequence: Synthetic oligonucleotide
cugggccuccaaggccuc

SEQ ID NO: 54455 - RNA, 18 nt, Artificial Sequence
  Description of Artificial Sequence: Synthetic oligonucleotide
ucugccugggccuccaag

SEQ ID NO: 54456 - RNA, 18 nt, Artificial Sequence
  Description of Artificial Sequence: Synthetic oligonucleotide
uccacucugccugggccu

SEQ ID NO: 54457 - RNA, 18 nt, Artificial Sequence
  Description of Artificial Sequence: Synthetic oligonucleotide
agguguccacucugccug

SEQ ID NO: 54458 - RNA, 18 nt, Artificial Sequence
  Description of Artificial Sequence: Synthetic oligonucleotide
ccauuagguguccacucu

SEQ ID NO: 54459 - RNA, 18 nt, Artificial Sequence
  Description of Artificial Sequence: Synthetic oligonucleotide
aguucccauuaggugucc

SEQ ID NO: 54460 - RNA, 18 nt, Artificial Sequence
  Description of Artificial Sequence: Synthetic oligonucleotide
ucccaaguucccauuagg

SEQ ID NO: 54461 - RNA, 18 nt, Artificial Sequence
  Description of Artificial Sequence: Synthetic oligonucleotide
cccauucccaaguuccca

SEQ ID NO: 54462 - RNA, 18 nt, Artificial Sequence
  Description of Artificial Sequence: Synthetic oligonucleotide
cacuucccauucccaagu

SEQ ID NO: 54463 - RNA, 18 nt, Artificial Sequence
  Description of Artificial Sequence: Synthetic oligonucleotide
cuggacacuucccauucc

SEQ ID NO: 54464 - RNA, 18 nt, Artificial Sequence
  Description of Artificial Sequence: Synthetic oligonucleotide
aaaaccuggacacuuccc

SEQ ID NO: 54465 - RNA, 18 nt, Artificial Sequence
  Description of Artificial Sequence: Synthetic oligonucleotide
agacaaaaaccuggacac

SEQ ID NO: 54466 - RNA, 18 nt, Artificial Sequence
  Description of Artificial Sequence: Synthetic oligonucleotide
gcuguagacaaaaaccug

SEQ ID NO: 54467 - RNA, 18 nt, Artificial Sequence
  Description of Artificial Sequence: Synthetic oligonucleotide
ccacggcuguagacaaaa

SEQ ID NO: 54468 - RNA, 18 nt, Artificial Sequence
  Description of Artificial Sequence: Synthetic oligonucleotide
gagaaccacggcuguaga

SEQ ID NO: 54469 - RNA, 18 nt, Artificial Sequence
  Description of Artificial Sequence: Synthetic oligonucleotide
ucaaugagaaccacggcu

SEQ ID NO: 54470 - RNA, 18 nt, Artificial Sequence
  Description of Artificial Sequence: Synthetic oligonucleotide
agcagucaaugagaacca

SEQ ID NO: 54471 - RNA, 18 nt, Artificial Sequence
  Description of Artificial Sequence: Synthetic oligonucleotide
gccugagcagucaaugag

SEQ ID NO: 54472 - RNA, 18 nt, Artificial Sequence
  Description of Artificial Sequence: Synthetic oligonucleotide
ccauggccugagcaguca

SEQ ID NO: 54473 - RNA, 18 nt, Artificial Sequence
  Description of Artificial Sequence: Synthetic oligonucleotide
ugccaccauggccugagc

SEQ ID NO: 54474 - RNA, 18 nt, Artificial Sequence
  Description of Artificial Sequence: Synthetic oligonucleotide
uccccugccaccauggcc

SEQ ID NO: 54475 - RNA, 18 nt, Artificial Sequence
  Description of Artificial Sequence: Synthetic oligonucleotide
ucacauccccugccacca

SEQ ID NO: 54476 - RNA, 18 nt, Artificial Sequence
  Description of Artificial Sequence: Synthetic oligonucleotide
uuccuucacauccccugc

SEQ ID NO: 54477 - RNA, 18 nt, Artificial Sequence
  Description of Artificial Sequence: Synthetic oligonucleotide
gggccuuccuucacaucc

SEQ ID NO: 54478 - RNA, 18 nt, Artificial Sequence
  Description of Artificial Sequence: Synthetic oligonucleotide
gggagaagguucuccggg

SEQ ID NO: 54479 - RNA, 18 nt, Artificial Sequence
  Description of Artificial Sequence: Synthetic oligonucleotide
gcgggagaagguucuccg

SEQ ID NO: 54480 - RNA, 18 nt, Artificial Sequence
  Description of Artificial Sequence: Synthetic oligonucleotide
ugccagcgggagaagguu

SEQ ID NO: 54481 - RNA, 18 nt, Artificial Sequence
  Description of Artificial Sequence: Synthetic oligonucleotide
gggacugccagcgggaga

SEQ ID NO: 54482 - RNA, 18 nt, Artificial Sequence
  Description of Artificial Sequence: Synthetic oligonucleotide
ucuccuguacccuuaggg

SEQ ID NO: 54483 - RNA, 18 nt, Artificial Sequence
  Description of Artificial Sequence: Synthetic oligonucleotide
augucuccuguacccuua

SEQ ID NO: 54484 - RNA, 18 nt, Artificial Sequence
  Description of Artificial Sequence: Synthetic oligonucleotide
ucaggaugucuccuguac

SEQ ID NO: 54485 - RNA, 18 nt, Artificial Sequence
  Description of Artificial Sequence: Synthetic oligonucleotide
gggagucaggaugucucc

SEQ ID NO: 54486 - RNA, 18 nt, Artificial Sequence
  Description of Artificial Sequence: Synthetic oligonucleotide
guggaacccaggccuggg

SEQ ID NO: 54487 - RNA, 18 nt, Artificial Sequence
  Description of Artificial Sequence: Synthetic oligonucleotide
gaguggaacccaggccug

SEQ ID NO: 54488 - RNA, 18 nt, Artificial Sequence
  Description of Artificial Sequence: Synthetic oligonucleotide
gaugggaguggaacccag

SEQ ID NO: 54489 - RNA, 18 nt, Artificial Sequence
  Description of Artificial Sequence: Synthetic oligonucleotide
ggacugaugggaguggaa

SEQ ID NO: 54490 - RNA, 18 nt, Artificial Sequence
  Description of Artificial Sequence: Synthetic oligonucleotide
cugcaggacugaugggag

SEQ ID NO: 54491 - RNA, 18 nt, Artificial Sequence
  Description of Artificial Sequence: Synthetic oligonucleotide
gccuccugcaggacugau

SEQ ID NO: 54492 - RNA, 18 nt, Artificial Sequence
  Description of Artificial Sequence: Synthetic oligonucleotide
gccuggccuccugcagga

SEQ ID NO: 54493 - RNA, 18 nt, Artificial Sequence
  Description of Artificial Sequence: Synthetic oligonucleotide
ccccugccuggccuccug

SEQ ID NO: 54494 - RNA, 18 nt, Artificial Sequence
  Description of Artificial Sequence: Synthetic oligonucleotide
ccuucccccugccuggcc

SEQ ID NO: 54495 - RNA, 18 nt, Artificial Sequence
  Description of Artificial Sequence: Synthetic oligonucleotide
ucagaccuucccccugcc

SEQ ID NO: 54496 - RNA, 18 nt, Artificial Sequence
  Description of Artificial Sequence: Synthetic oligonucleotide
uucacucagaccuucccc

SEQ ID NO: 54497 - RNA, 18 nt, Artificial Sequence
  Description of Artificial Sequence: Synthetic oligonucleotide
cuggcuucacucagaccu

SEQ ID NO: 54498 - RNA, 18 nt, Artificial Sequence
  Description of Artificial Sequence: Synthetic oligonucleotide
accugcuggcuucacuca

SEQ ID NO: 54499 - RNA, 18 nt, Artificial Sequence
  Description of Artificial Sequence: Synthetic oligonucleotide
agagcaccugcuggcuuc

SEQ ID NO: 54500 - RNA, 18 nt, Artificial Sequence
  Description of Artificial Sequence: Synthetic oligonucleotide
acuccagagcaccugcug

SEQ ID NO: 54501 - RNA, 18 nt, Artificial Sequence
  Description of Artificial Sequence: Synthetic oligonucleotide
guuuaacuccagagcacc

SEQ ID NO: 54502 - RNA, 18 nt, Artificial Sequence
  Description of Artificial Sequence: Synthetic oligonucleotide
agcugguuuaacuccaga

SEQ ID NO: 54503 - RNA, 18 nt, Artificial Sequence
  Description of Artificial Sequence: Synthetic oligonucleotide
cagaaagcugguuuaacu

SEQ ID NO: 54504 - RNA, 18 nt, Artificial Sequence
  Description of Artificial Sequence: Synthetic oligonucleotide
gcuugcagaaagcugguu

SEQ ID NO: 54505 - RNA, 18 nt, Artificial Sequence
  Description of Artificial Sequence: Synthetic oligonucleotide
gcagggcuugcagaaagc

SEQ ID NO: 54506 - RNA, 18 nt, Artificial Sequence
  Description of Artificial Sequence: Synthetic oligonucleotide
aggaagcagggcuugcag

SEQ ID NO: 54507 - RNA, 18 nt, Artificial Sequence
  Description of Artificial Sequence: Synthetic oligonucleotide
guucgaucacagccagua

SEQ ID NO: 54508 - RNA, 18 nt, Artificial Sequence
  Description of Artificial Sequence: Synthetic oligonucleotide
gagaaguucgaucacagc

SEQ ID NO: 54509 - RNA, 18 nt, Artificial Sequence
  Description of Artificial Sequence: Synthetic oligonucleotide
ggguugagaaguucgauc

SEQ ID NO: 54510 - RNA, 18 nt, Artificial Sequence
  Description of Artificial Sequence: Synthetic oligonucleotide
ucugaggguugagaaguu

SEQ ID NO: 54511 - RNA, 18 nt, Artificial Sequence
  Description of Artificial Sequence: Synthetic oligonucleotide
aagucucugaggguugag

SEQ ID NO: 54512 - RNA, 18 nt, Artificial Sequence
  Description of Artificial Sequence: Synthetic oligonucleotide
gaucuaagucucugaggg

SEQ ID NO: 54513 - RNA, 18 nt, Artificial Sequence
  Description of Artificial Sequence: Synthetic oligonucleotide
uggaagaucuaagucucu

SEQ ID NO: 54514 - RNA, 18 nt, Artificial Sequence
  Description of Artificial Sequence: Synthetic oligonucleotide
ugagguggaagaucuaag

SEQ ID NO: 54515 - RNA, 18 nt, Artificial Sequence
  Description of Artificial Sequence: Synthetic oligonucleotide
gggagugagguggaagau

SEQ ID NO: 54516 - RNA, 18 nt, Artificial Sequence
  Description of Artificial Sequence: Synthetic oligonucleotide
gcugagggagugaggugg

SEQ ID NO: 54517 - RNA, 18 nt, Artificial Sequence
  Description of Artificial Sequence: Synthetic oligonucleotide
gcuuggcugagggaguga

SEQ ID NO: 54518 - RNA, 18 nt, Artificial Sequence
  Description of Artificial Sequence: Synthetic oligonucleotide
uggaggcuuggcugaggg

SEQ ID NO: 54519 - RNA, 18 nt, Artificial Sequence
  Description of Artificial Sequence: Synthetic oligonucleotide
gggccuggaggcuuggcu

SEQ ID NO: 54520 - RNA, 18 nt, Artificial Sequence
  Description of Artificial Sequence: Synthetic oligonucleotide
gccaccacggaugcacga

SEQ ID NO: 54521 - RNA, 18 nt, Artificial Sequence
  Description of Artificial Sequence: Synthetic oligonucleotide
gagaggccaccacggaug

SEQ ID NO: 54522 - RNA, 18 nt, Artificial Sequence
  Description of Artificial Sequence: Synthetic oligonucleotide
aggcagagaggccaccac

SEQ ID NO: 54523 - RNA, 18 nt, Artificial Sequence
  Description of Artificial Sequence: Synthetic oligonucleotide
agagaaggcagagaggcc

SEQ ID NO: 54524 - RNA, 18 nt, Artificial Sequence
  Description of Artificial Sequence: Synthetic oligonucleotide
agaacagagaaggcagag

SEQ ID NO: 54525 - RNA, 18 nt, Artificial Sequence
  Description of Artificial Sequence: Synthetic oligonucleotide
agaacagaacagagaagg

SEQ ID NO: 54526 - RNA, 18 nt, Artificial Sequence
  Description of Artificial Sequence: Synthetic oligonucleotide
gggagaacagaacagaga

SEQ ID NO: 54527 - RNA, 18 nt, Artificial Sequence
  Description of Artificial Sequence: Synthetic oligonucleotide
ucaugucugggccauggg

SEQ ID NO: 54528 - RNA, 18 nt, Artificial Sequence
  Description of Artificial Sequence: Synthetic oligonucleotide
gccacucaugucugggcc

SEQ ID NO: 54529 - RNA, 18 nt, Artificial Sequence
  Description of Artificial Sequence: Synthetic oligonucleotide
gggccacucaugucuggg

SEQ ID NO: 54530 - RNA, 18 nt, Artificial Sequence
  Description of Artificial Sequence: Synthetic oligonucleotide
caucagccccuucuaggg

SEQ ID NO: 54531 - RNA, 18 nt, Artificial Sequence
  Description of Artificial Sequence: Synthetic oligonucleotide
ucccccaucagccccuuc

SEQ ID NO: 54532 - RNA, 18 nt, Artificial Sequence
  Description of Artificial Sequence: Synthetic oligonucleotide
uccccucccccaucagcc

SEQ ID NO: 54533 - RNA, 18 nt, Artificial Sequence
  Description of Artificial Sequence: Synthetic oligonucleotide
ggguccccucccccauca

SEQ ID NO: 54534 - RNA, 18 nt, Artificial Sequence
  Description of Artificial Sequence: Synthetic oligonucleotide
ugauuccccaggccuggg

SEQ ID NO: 54535 - RNA, 18 nt, Artificial Sequence
  Description of Artificial Sequence: Synthetic oligonucleotide
caaaaugauuccccaggc

SEQ ID NO: 54536 - RNA, 18 nt, Artificial Sequence
  Description of Artificial Sequence: Synthetic oligonucleotide
caggacaaaaugauuccc

SEQ ID NO: 54537 - RNA, 18 nt, Artificial Sequence
  Description of Artificial Sequence: Synthetic oligonucleotide
gcccccaggacaaaauga

SEQ ID NO: 54538 - RNA, 18 nt, Artificial Sequence
  Description of Artificial Sequence: Synthetic oligonucleotide
gggacgcccccaggacaa

SEQ ID NO: 54539 - RNA, 18 nt, Artificial Sequence
  Description of Artificial Sequence: Synthetic oligonucleotide
gggaugggacgcccccag

SEQ ID NO: 54540 - RNA, 18 nt, Artificial Sequence
  Description of Artificial Sequence: Synthetic oligonucleotide
caaggccggugcuguggg

SEQ ID NO: 54541 - RNA, 18 nt, Artificial Sequence
  Description of Artificial Sequence: Synthetic oligonucleotide
cugggcaaggccggugcu

SEQ ID NO: 54542 - RNA, 18 nt, Artificial Sequence
  Description of Artificial Sequence: Synthetic oligonucleotide
gggccugggcaaggccgg

SEQ ID NO: 54543 - RNA, 18 nt, Artificial Sequence
  Description of Artificial Sequence: Synthetic oligonucleotide
gucaucggccaggcuggg

SEQ ID NO: 54544 - RNA, 18 nt, Artificial Sequence
  Description of Artificial Sequence: Synthetic oligonucleotide
ucggugucaucggccagg

SEQ ID NO: 54545 - RNA, 18 nt, Artificial Sequence
  Description of Artificial Sequence: Synthetic oligonucleotide
uggcaucggugucaucgg

SEQ ID NO: 54546 - RNA, 18 nt, Artificial Sequence
  Description of Artificial Sequence: Synthetic oligonucleotide
gcuguuggcaucgguguc

SEQ ID NO: 54547 - RNA, 18 nt, Artificial Sequence
  Description of Artificial Sequence: Synthetic oligonucleotide
ccauugcuguuggcaucg

SEQ ID NO: 54548 - RNA, 18 nt, Artificial Sequence
  Description of Artificial Sequence: Synthetic oligonucleotide
uugaaccauugcuguugg

SEQ ID NO: 54549 - RNA, 18 nt, Artificial Sequence
  Description of Artificial Sequence: Synthetic oligonucleotide
gccacuugaaccauugcu

SEQ ID NO: 54550 - RNA, 18 nt, Artificial Sequence
  Description of Artificial Sequence: Synthetic oligonucleotide
ucauugccacuugaacca

SEQ ID NO: 54551 - RNA, 18 nt, Artificial Sequence
  Description of Artificial Sequence: Synthetic oligonucleotide
uggacucauugccacuug

SEQ ID NO: 54552 - RNA, 18 nt, Artificial Sequence
  Description of Artificial Sequence: Synthetic oligonucleotide
cccguuggacucauugcc

SEQ ID NO: 54553 - RNA, 18 nt, Artificial Sequence
  Description of Artificial Sequence: Synthetic oligonucleotide
ucaugcccguuggacuca

SEQ ID NO: 54554 - RNA, 18 nt, Artificial Sequence
  Description of Artificial Sequence: Synthetic oligonucleotide
uagacucaugcccguugg

SEQ ID NO: 54555 - RNA, 18 nt, Artificial Sequence
  Description of Artificial Sequence: Synthetic oligonucleotide
gccucuagacucaugccc

SEQ ID NO: 54556 - RNA, 18 nt, Artificial Sequence
  Description of Artificial Sequence: Synthetic oligonucleotide
gaugcgccucuagacuca

SEQ ID NO: 54557 - RNA, 18 nt, Artificial Sequence
  Description of Artificial Sequence: Synthetic oligonucleotide
gcugagaugcgccucuag

SEQ ID NO: 54558 - RNA, 18 nt, Artificial Sequence
  Description of Artificial Sequence: Synthetic oligonucleotide
gcuccgcugagaugcgcc

SEQ ID NO: 54559 - RNA, 18 nt, Artificial Sequence
  Description of Artificial Sequence: Synthetic oligonucleotide
ugugagcuccgcugagau

SEQ ID NO: 54560 - RNA, 18 nt, Artificial Sequence
  Description of Artificial Sequence: Synthetic oligonucleotide
agcugugugagcuccgcu

SEQ ID NO: 54561 - RNA, 18 nt, Artificial Sequence
  Description of Artificial Sequence: Synthetic oligonucleotide
ggaggagcugugugagcu

SEQ ID NO: 54562 - RNA, 18 nt, Artificial Sequence
  Description of Artificial Sequence: Synthetic oligonucleotide
ccugaggaggagcugugu

SEQ ID NO: 54563 - RNA, 18 nt, Artificial Sequence
  Description of Artificial Sequence: Synthetic oligonucleotide
cguugccugaggaggagc

SEQ ID NO: 54564 - RNA, 18 nt, Artificial Sequence
  Description of Artificial Sequence: Synthetic oligonucleotide
cuugccguugccugagga

SEQ ID NO: 54565 - RNA, 18 nt, Artificial Sequence
  Description of Artificial Sequence: Synthetic oligonucleotide
gaguccuugccguugccu

SEQ ID NO: 54566 - RNA, 18 nt, Artificial Sequence
  Description of Artificial Sequence: Synthetic oligonucleotide
gggcugaguccuugccgu

SEQ ID NO: 54567 - RNA, 18 nt, Artificial Sequence
  Description of Artificial Sequence: Synthetic oligonucleotide
cagcagggcugaguccuu

SEQ ID NO: 54568 - RNA, 18 nt, Artificial Sequence
  Description of Artificial Sequence: Synthetic oligonucleotide
gucuccagcagggcugag

SEQ ID NO: 54569 - RNA, 18 nt, Artificial Sequence
  Description of Artificial Sequence: Synthetic oligonucleotide
caguggucuccagcaggg

SEQ ID NO: 54570 - RNA, 18 nt, Artificial Sequence
  Description of Artificial Sequence: Synthetic oligonucleotide
gcucucaguggucuccag

SEQ ID NO: 54571 - RNA, 18 nt, Artificial Sequence
  Description of Artificial Sequence: Synthetic oligonucleotide
uugcugcucucagugguc

SEQ ID NO: 54572 - RNA, 18 nt, Artificial Sequence
  Description of Artificial Sequence: Synthetic oligonucleotide
gaucugcuggaaagucac

SEQ ID NO: 54573 - RNA, 18 nt, Artificial Sequence
  Description of Artificial Sequence: Synthetic oligonucleotide
uuacagaucugcuggaaa

SEQ ID NO: 54574 - RNA, 18 nt, Artificial Sequence
  Description of Artificial Sequence: Synthetic oligonucleotide
cauccuuacagaucugcu

SEQ ID NO: 54575 - RNA, 18 nt, Artificial Sequence
  Description of Artificial Sequence: Synthetic oligonucleotide
augcacauccuuacagau

SEQ ID NO: 54576 - RNA, 18 nt, Artificial Sequence
  Description of Artificial Sequence: Synthetic oligonucleotide
accagaugcacauccuua

SEQ ID NO: 54577 - RNA, 18 nt, Artificial Sequence
  Description of Artificial Sequence: Synthetic oligonucleotide
gcuucaccagaugcacau

SEQ ID NO: 54578 - RNA, 18 nt, Artificial Sequence
  Description of Artificial Sequence: Synthetic oligonucleotide
cuggugcuucaccagaug

SEQ ID NO: 54579 - RNA, 18 nt, Artificial Sequence
  Description of Artificial Sequence: Synthetic oligonucleotide
uggcccuggugcuucacc

SEQ ID NO: 54580 - RNA, 18 nt, Artificial Sequence
  Description of Artificial Sequence: Synthetic oligonucleotide
gcugcuggcccuggugcu

SEQ ID NO: 54581 - RNA, 18 nt, Artificial Sequence
  Description of Artificial Sequence: Synthetic oligonucleotide
aaaaagcugcuggcccug

SEQ ID NO: 54582 - RNA, 18 nt, Artificial Sequence
  Description of Artificial Sequence: Synthetic oligonucleotide
ucaauaaaaagcugcugg

SEQ ID NO: 54583 - RNA, 18 nt, Artificial Sequence
  Description of Artificial Sequence: Synthetic oligonucleotide
gagacucaauaaaaagcu

SEQ ID NO: 54584 - RNA, 18 nt, Artificial Sequence
  Description of Artificial Sequence: Synthetic oligonucleotide
ggcccgagacucaauaaa

SEQ ID NO: 54585 - RNA, 18 nt, Artificial Sequence
  Description of Artificial Sequence: Synthetic oligonucleotide
ggccgggcccgagacuca

SEQ ID NO: 54586 - RNA, 18 nt, Artificial Sequence
  Description of Artificial Sequence: Synthetic oligonucleotide
acugaggccgggcccgag

SEQ ID NO: 54587 - RNA, 18 nt, Artificial Sequence
  Description of Artificial Sequence: Synthetic oligonucleotide
ccgggacugaggccgggc

SEQ ID NO: 54588 - RNA, 18 nt, Artificial Sequence
  Description of Artificial Sequence: Synthetic oligonucleotide
cccacacaucaucaucaa

SEQ ID NO: 54589 - RNA, 18 nt, Artificial Sequence
  Description of Artificial Sequence: Synthetic oligonucleotide
cuucacccacacaucauc

SEQ ID NO: 54590 - RNA, 18 nt, Artificial Sequence
  Description of Artificial Sequence: Synthetic oligonucleotide
ugucucuucacccacaca

SEQ ID NO: 54591 - RNA, 18 nt, Artificial Sequence
  Description of Artificial Sequence: Synthetic oligonucleotide
aggucugucucuucaccc

SEQ ID NO: 54592 - RNA, 18 nt, Artificial Sequence
  Description of Artificial Sequence: Synthetic oligonucleotide
cccccaggucugucucuu

SEQ ID NO: 54593 - RNA, 18 nt, Artificial Sequence
  Description of Artificial Sequence: Synthetic oligonucleotide
gggaccccccaggucugu

SEQ ID NO: 54594 - RNA, 18 nt, Artificial Sequence
  Description of Artificial Sequence: Synthetic oligonucleotide
aacagcaaauggguuggg

SEQ ID NO: 54595 - RNA, 18 nt, Artificial Sequence
  Description of Artificial Sequence: Synthetic oligonucleotide
aaaaaaacagcaaauggg

SEQ ID NO: 54596 - RNA, 18 nt, Artificial Sequence
  Description of Artificial Sequence: Synthetic oligonucleotide
cauggaaaaaaacagcaa

SEQ ID NO: 54597 - RNA, 18 nt, Artificial Sequence
  Description of Artificial Sequence: Synthetic oligonucleotide
gcucacauggaaaaaaac

SEQ ID NO: 54598 - RNA, 18 nt, Artificial Sequence
  Description of Artificial Sequence: Synthetic oligonucleotide
aacagcaaauggguuggg

SEQ ID NO: 54599 - RNA, 18 nt, Artificial Sequence
  Description of Artificial Sequence: Synthetic oligonucleotide
aaaaacagcaaauggguu

SEQ ID NO: 54600 - RNA, 18 nt, Artificial Sequence
  Description of Artificial Sequence: Synthetic oligonucleotide
uggaaaaaaacagcaaau

SEQ ID NO: 54601 - RNA, 18 nt, Artificial Sequence
  Description of Artificial Sequence: Synthetic oligonucleotide
ucacauggaaaaaaacag

SEQ ID NO: 54602 - RNA, 18 nt, Artificial Sequence
  Description of Artificial Sequence: Synthetic oligonucleotide
caagcucacauggaaaaa

SEQ ID NO: 54603 - RNA, 18 nt, Artificial Sequence
  Description of Artificial Sequence: Synthetic oligonucleotide
cuucucaagcucacaugg

SEQ ID NO: 54604 - RNA, 18 nt, Artificial Sequence
  Description of Artificial Sequence: Synthetic oligonucleotide
auagccuucucaagcuca

SEQ ID NO: 54605 - RNA, 18 nt, Artificial Sequence
  Description of Artificial Sequence: Synthetic oligonucleotide
ggaaaauagccuucucaa

SEQ ID NO: 54606 - RNA, 18 nt, Artificial Sequence
  Description of Artificial Sequence: Synthetic oligonucleotide
aaagaggaaaauagccuu

SEQ ID NO: 54607 - RNA, 18 nt, Artificial Sequence
  Description of Artificial Sequence: Synthetic oligonucleotide
gccuugaacgugccugua

SEQ ID NO: 54608 - RNA, 18 nt, Artificial Sequence
  Description of Artificial Sequence: Synthetic oligonucleotide
ccuuggccuugaacgugc

SEQ ID NO: 54609 - RNA, 18 nt, Artificial Sequence
  Description of Artificial Sequence: Synthetic oligonucleotide
aagggccuuggccuugaa

SEQ ID NO: 54610 - RNA, 18 nt, Artificial Sequence
  Description of Artificial Sequence: Synthetic oligonucleotide
cagggaagggccuuggcc

SEQ ID NO: 54611 - RNA, 18 nt, Artificial Sequence
  Description of Artificial Sequence: Synthetic oligonucleotide
auuggcagggaagggccu

SEQ ID NO: 54612 - RNA, 18 nt, Artificial Sequence
  Description of Artificial Sequence: Synthetic oligonucleotide
gggauuggcagggaaggg

SEQ ID NO: 54613 - RNA, 18 nt, Artificial Sequence
  Description of Artificial Sequence: Synthetic oligonucleotide
uccagcucugggucuggg

SEQ ID NO: 54614 - RNA, 18 nt, Artificial Sequence
  Description of Artificial Sequence: Synthetic oligonucleotide
ccgccuccagcucugggu

SEQ ID NO: 54615 - RNA, 18 nt, Artificial Sequence
  Description of Artificial Sequence: Synthetic oligonucleotide
agaacccgccuccagcuc

SEQ ID NO: 54616 - RNA, 18 nt, Artificial Sequence
  Description of Artificial Sequence: Synthetic oligonucleotide
ggagcagaacccgccucc

SEQ ID NO: 54617 - RNA, 18 nt, Artificial Sequence
  Description of Artificial Sequence: Synthetic oligonucleotide
ggacgggagcagaacccg

SEQ ID NO: 54618 - RNA, 18 nt, Artificial Sequence
  Description of Artificial Sequence: Synthetic oligonucleotide
ggccuggacgggagcaga

SEQ ID NO: 54619 - RNA, 18 nt, Artificial Sequence
  Description of Artificial Sequence: Synthetic oligonucleotide
gggccuggacgggagcag

SEQ ID NO: 54620 - RNA, 18 nt, Artificial Sequence
  Description of Artificial Sequence: Synthetic oligonucleotide
gggaccaaggcuaguggg

SEQ ID NO: 54621 - RNA, 18 nt, Artificial Sequence
  Description of Artificial Sequence: Synthetic oligonucleotide
ccucagggaccaaggcua

SEQ ID NO: 54622 - RNA, 18 nt, Artificial Sequence
  Description of Artificial Sequence: Synthetic oligonucleotide
ggccuccucagggaccaa

SEQ ID NO: 54623 - RNA, 18 nt, Artificial Sequence
  Description of Artificial Sequence: Synthetic oligonucleotide
cucucggccuccucaggg

SEQ ID NO: 54624 - RNA, 18 nt, Artificial Sequence
  Description of Artificial Sequence: Synthetic oligonucleotide
cuuuccucucggccuccu

SEQ ID NO: 54625 - RNA, 18 nt, Artificial Sequence
  Description of Artificial Sequence: Synthetic oligonucleotide
ggcuucuuuccucucggc

SEQ ID NO: 54626 - RNA, 18 nt, Artificial Sequence
  Description of Artificial Sequence: Synthetic oligonucleotide
cuggaggcuucuuuccuc

SEQ ID NO: 54627 - RNA, 18 nt, Artificial Sequence
  Description of Artificial Sequence: Synthetic oligonucleotide
agcagcuggaggcuucuu

SEQ ID NO: 54628 - RNA, 18 nt, Artificial Sequence
  Description of Artificial Sequence: Synthetic oligonucleotide
guaggagcagcuggaggc

SEQ ID NO: 54629 - RNA, 18 nt, Artificial Sequence
  Description of Artificial Sequence: Synthetic oligonucleotide
ugcugguaggagcagcug

SEQ ID NO: 54630 - RNA, 18 nt, Artificial Sequence
  Description of Artificial Sequence: Synthetic oligonucleotide
ugaucugcugguaggagc

SEQ ID NO: 54631 - RNA, 18 nt, Artificial Sequence
  Description of Artificial Sequence: Synthetic oligonucleotide
gcaguugaucugcuggua

SEQ ID NO: 54632 - RNA, 18 nt, Artificial Sequence
  Description of Artificial Sequence: Synthetic oligonucleotide
uccaggcaguugaucugc

SEQ ID NO: 54633 - RNA, 18 nt, Artificial Sequence
  Description of Artificial Sequence: Synthetic oligonucleotide
ugcuguccaggcaguuga

SEQ ID NO: 54634 - RNA, 18 nt, Artificial Sequence
  Description of Artificial Sequence: Synthetic oligonucleotide
gaggaugcuguccaggca

SEQ ID NO: 54635 - RNA, 18 nt, Artificial Sequence
  Description of Artificial Sequence: Synthetic oligonucleotide
cgucacgaacccccugcc

SEQ ID NO: 54636 - RNA, 18 nt, Artificial Sequence
  Description of Artificial Sequence: Synthetic oligonucleotide
gccggcgucacgaacccc

SEQ ID NO: 54637 - RNA, 18 nt, Artificial Sequence
  Description of Artificial Sequence: Synthetic oligonucleotide
acccagccggcgucacga

SEQ ID NO: 54638 - RNA, 18 nt, Artificial Sequence
  Description of Artificial Sequence: Synthetic oligonucleotide
cccagacccagccggcgu

SEQ ID NO: 54639 - RNA, 18 nt, Artificial Sequence
  Description of Artificial Sequence: Synthetic oligonucleotide
cagcccccagacccagcc

SEQ ID NO: 54640 - RNA, 18 nt, Artificial Sequence
  Description of Artificial Sequence: Synthetic oligonucleotide
gcccacagcccccagacc

SEQ ID NO: 54641 - RNA, 18 nt, Artificial Sequence
  Description of Artificial Sequence: Synthetic oligonucleotide
ggcuggcccacagccccc

SEQ ID NO: 54642 - RNA, 18 nt, Artificial Sequence
  Description of Artificial Sequence: Synthetic oligonucleotide
ggcucggcuggcccacag

SEQ ID NO: 54643 - RNA, 18 nt, Artificial Sequence
  Description of Artificial Sequence: Synthetic oligonucleotide
gggucggcucggcuggcc

SEQ ID NO: 54644 - RNA, 18 nt, Artificial Sequence
  Description of Artificial Sequence: Synthetic oligonucleotide
agcccgggucggcucggc

SEQ ID NO: 54645 - RNA, 18 nt, Artificial Sequence
  Description of Artificial Sequence: Synthetic oligonucleotide
ccagaagcccgggucggc

SEQ ID NO: 54646 - RNA, 18 nt, Artificial Sequence
  Description of Artificial Sequence: Synthetic oligonucleotide
gucccccagaagcccggg

SEQ ID NO: 54647 - RNA, 18 nt, Artificial Sequence
  Description of Artificial Sequence: Synthetic oligonucleotide
ccgcggucccccagaagc

SEQ ID NO: 54648 - RNA, 18 nt, Artificial Sequence
  Description of Artificial Sequence: Synthetic oligonucleotide
ggcccccgcgguccccca

SEQ ID NO: 54649 - RNA, 18 nt, Artificial Sequence
  Description of Artificial Sequence: Synthetic oligonucleotide
cucacggcccccgcgguc

SEQ ID NO: 54650 - RNA, 18 nt, Artificial Sequence
  Description of Artificial Sequence: Synthetic oligonucleotide
gagugcucacggcccccg

SEQ ID NO: 54651 - RNA, 18 nt, Artificial Sequence
  Description of Artificial Sequence: Synthetic oligonucleotide
ccucugagugcucacggc

SEQ ID NO: 54652 - RNA, 18 nt, Artificial Sequence
  Description of Artificial Sequence: Synthetic oligonucleotide
ugcgcccucugagugcuc

SEQ ID NO: 54653 - RNA, 18 nt, Artificial Sequence
  Description of Artificial Sequence: Synthetic oligonucleotide
ugggaugcgcccucugag

SEQ ID NO: 54654 - RNA, 18 nt, Artificial Sequence
  Description of Artificial Sequence: Synthetic oligonucleotide
gggccugggaugcgcccu

SEQ ID NO: 54655 - RNA, 18 nt, Artificial Sequence
  Description of Artificial Sequence: Synthetic oligonucleotide
ggccggguccccggaggg

SEQ ID NO: 54656 - RNA, 18 nt, Artificial Sequence
  Description of Artificial Sequence: Synthetic oligonucleotide
gcuggccggguccccgga

SEQ ID NO: 54657 - RNA, 18 nt, Artificial Sequence
  Description of Artificial Sequence: Synthetic oligonucleotide
uucaggcuggccgggucc

SEQ ID NO: 54658 - RNA, 18 nt, Artificial Sequence
  Description of Artificial Sequence: Synthetic oligonucleotide
gcaucuucaggcuggccg

SEQ ID NO: 54659 - RNA, 18 nt, Artificial Sequence
  Description of Artificial Sequence: Synthetic oligonucleotide
cgucggcaucuucaggcu

SEQ ID NO: 54660 - RNA, 18 nt, Artificial Sequence
  Description of Artificial Sequence: Synthetic oligonucleotide
ccguucgucggcaucuuc

SEQ ID NO: 54661 - RNA, 18 nt, Artificial Sequence
  Description of Artificial Sequence: Synthetic oligonucleotide
gcaggccguucgucggca

SEQ ID NO: 54662 - RNA, 18 nt, Artificial Sequence
  Description of Artificial Sequence: Synthetic oligonucleotide
cuggugcaggccguucgu

SEQ ID NO: 54663 - RNA, 18 nt, Artificial Sequence
  Description of Artificial Sequence: Synthetic oligonucleotide
agcaccuggugcaggccg

SEQ ID NO: 54664 - RNA, 18 nt, Artificial Sequence
  Description of Artificial Sequence: Synthetic oligonucleotide
ucuucagcaccuggugca

SEQ ID NO: 54665 - RNA, 18 nt, Artificial Sequence
  Description of Artificial Sequence: Synthetic oligonucleotide
cuggaucuucagcaccug

SEQ ID NO: 54666 - RNA, 18 nt, Artificial Sequence
  Description of Artificial Sequence: Synthetic oligonucleotide
ccaaacuggaucuucagc

SEQ ID NO: 54667 - RNA, 18 nt, Artificial Sequence
  Description of Artificial Sequence: Synthetic oligonucleotide
cgaggccaaacuggaucu

SEQ ID NO: 54668 - RNA, 18 nt, Artificial Sequence
  Description of Artificial Sequence: Synthetic oligonucleotide
guugacgaggccaaacug

SEQ ID NO: 54669 - RNA, 18 nt, Artificial Sequence
  Description of Artificial Sequence: Synthetic oligonucleotide
gugucguugacgaggcca

SEQ ID NO: 54670 - RNA, 18 nt, Artificial Sequence
  Description of Artificial Sequence: Synthetic oligonucleotide
ggucagugucguugacga

SEQ ID NO: 54671 - RNA, 18 nt, Artificial Sequence
  Description of Artificial Sequence: Synthetic oligonucleotide
guagcggucagugucguu

SEQ ID NO: 54672 - RNA, 18 nt, Artificial Sequence
  Description of Artificial Sequence: Synthetic oligonucleotide
gucagguagcggucagug

SEQ ID NO: 54673 - RNA, 18 nt, Artificial Sequence
  Description of Artificial Sequence: Synthetic oligonucleotide
cagcugucagguagcggu

SEQ ID NO: 54674 - RNA, 18 nt, Artificial Sequence
  Description of Artificial Sequence: Synthetic oligonucleotide
gcucucagcugucaggua

SEQ ID NO: 54675 - RNA, 18 nt, Artificial Sequence
  Description of Artificial Sequence: Synthetic oligonucleotide
ccgaagcucucagcuguc

SEQ ID NO: 54676 - RNA, 18 nt, Artificial Sequence
  Description of Artificial Sequence: Synthetic oligonucleotide
ugaagccgaagcucucag

SEQ ID NO: 54677 - RNA, 18 nt, Artificial Sequence
  Description of Artificial Sequence: Synthetic oligonucleotide
gaccuugaagccgaagcu

SEQ ID NO: 54678 - RNA, 18 nt, Artificial Sequence
  Description of Artificial Sequence: Synthetic oligonucleotide
gcauugaccuugaagccg

SEQ ID NO: 54679 - RNA, 18 nt, Artificial Sequence
  Description of Artificial Sequence: Synthetic oligonucleotide
ccgaggcauugaccuuga

SEQ ID NO: 54680 - RNA, 18 nt, Artificial Sequence
  Description of Artificial Sequence: Synthetic oligonucleotide
gggugccgaggcauugac

SEQ ID NO: 54681 - RNA, 18 nt, Artificial Sequence
  Description of Artificial Sequence: Synthetic oligonucleotide
aggcugggugccgaggca

SEQ ID NO: 54682 - RNA, 18 nt, Artificial Sequence
  Description of Artificial Sequence: Synthetic oligonucleotide
ucuugaggcugggugccg

SEQ ID NO: 54683 - RNA, 18 nt, Artificial Sequence
  Description of Artificial Sequence: Synthetic oligonucleotide
cuuccucuugaggcuggg

SEQ ID NO: 54684 - RNA, 18 nt, Artificial Sequence
  Description of Artificial Sequence: Synthetic oligonucleotide
gucugcuuccucuugagg

SEQ ID NO: 54685 - RNA, 18 nt, Artificial Sequence
  Description of Artificial Sequence: Synthetic oligonucleotide
cccaggucugcuuccucu

SEQ ID NO: 54686 - RNA, 18 nt, Artificial Sequence
  Description of Artificial Sequence: Synthetic oligonucleotide
cagcacccaggucugcuu

SEQ ID NO: 54687 - RNA, 18 nt, Artificial Sequence
  Description of Artificial Sequence: Synthetic oligonucleotide
gguuccagcacccagguc

SEQ ID NO: 54688 - RNA, 18 nt, Artificial Sequence
  Description of Artificial Sequence: Synthetic oligonucleotide
ggucggguuccagcaccc

SEQ ID NO: 54689 - RNA, 18 nt, Artificial Sequence
  Description of Artificial Sequence: Synthetic oligonucleotide
uccugggucggguuccag

SEQ ID NO: 54690 - RNA, 18 nt, Artificial Sequence
  Description of Artificial Sequence: Synthetic oligonucleotide
ccuuguccugggucgggu

SEQ ID NO: 54691 - RNA, 18 nt, Artificial Sequence
  Description of Artificial Sequence: Synthetic oligonucleotide
ccgugccuuguccugggu

SEQ ID NO: 54692 - RNA, 18 nt, Artificial Sequence
  Description of Artificial Sequence: Synthetic oligonucleotide
cacagccgugccuugucc

SEQ ID NO: 54693 - RNA, 18 nt, Artificial Sequence
  Description of Artificial Sequence: Synthetic oligonucleotide
agcagcacagccgugccu

SEQ ID NO: 54694 - RNA, 18 nt, Artificial Sequence
  Description of Artificial Sequence: Synthetic oligonucleotide
ugcggagcagcacagccg

SEQ ID NO: 54695 - RNA, 18 nt, Artificial Sequence
  Description of Artificial Sequence: Synthetic oligonucleotide
gcugcugcggagcagcac

SEQ ID NO: 54696 - RNA, 18 nt, Artificial Sequence
  Description of Artificial Sequence: Synthetic oligonucleotide
agguggcugcugcggagc

SEQ ID NO: 54697 - RNA, 18 nt, Artificial Sequence
  Description of Artificial Sequence: Synthetic oligonucleotide
ggcccagguggcugcugc

SEQ ID NO: 54698 - RNA, 18 nt, Artificial Sequence
  Description of Artificial Sequence: Synthetic oligonucleotide
guagcggcccagguggcu

SEQ ID NO: 54699 - RNA, 18 nt, Artificial Sequence
  Description of Artificial Sequence: Synthetic oligonucleotide
gacagguagcggcccagg

SEQ ID NO: 54700 - RNA, 18 nt, Artificial Sequence
  Description of Artificial Sequence: Synthetic oligonucleotide
cugccgacagguagcggc

SEQ ID NO: 54701 - RNA, 18 nt, Artificial Sequence
  Description of Artificial Sequence: Synthetic oligonucleotide
cucuucugccgacaggua

SEQ ID NO: 54702 - RNA, 18 nt, Artificial Sequence
  Description of Artificial Sequence: Synthetic oligonucleotide
ccguccucuucugccgac

SEQ ID NO: 54703 - RNA, 18 nt, Artificial Sequence
  Description of Artificial Sequence: Synthetic oligonucleotide
cgcgcccguccucuucug

SEQ ID NO: 54704 - RNA, 18 nt, Artificial Sequence
  Description of Artificial Sequence: Synthetic oligonucleotide
ggccacgcgcccguccuc

SEQ ID NO: 54705 - RNA, 18 nt, Artificial Sequence
  Description of Artificial Sequence: Synthetic oligonucleotide
ucacaggccacgcgcccg

SEQ ID NO: 54706 - RNA, 18 nt, Artificial Sequence
  Description of Artificial Sequence: Synthetic oligonucleotide
cugccucacaggccacgc

SEQ ID NO: 54707 - RNA, 18 nt, Artificial Sequence
  Description of Artificial Sequence: Synthetic oligonucleotide
cugcucugccucacaggc

SEQ ID NO: 54708 - RNA, 18 nt, Artificial Sequence
  Description of Artificial Sequence: Synthetic oligonucleotide
cccggcugcucugccuca

SEQ ID NO: 54709 - RNA, 18 nt, Artificial Sequence
  Description of Artificial Sequence: Synthetic oligonucleotide
cacggcccggcugcucug

SEQ ID NO: 54710 - RNA, 18 nt, Artificial Sequence
  Description of Artificial Sequence: Synthetic oligonucleotide
gcagucacggcccggcug

SEQ ID NO: 54711 - RNA, 18 nt, Artificial Sequence
  Description of Artificial Sequence: Synthetic oligonucleotide
aagcggcagucacggccc

SEQ ID NO: 54712 - RNA, 18 nt, Artificial Sequence
  Description of Artificial Sequence: Synthetic oligonucleotide
ccaggaagcggcagucac

SEQ ID NO: 54713 - RNA, 18 nt, Artificial Sequence
  Description of Artificial Sequence: Synthetic oligonucleotide
caggaccaggaagcggca

SEQ ID NO: 54714 - RNA, 18 nt, Artificial Sequence
  Description of Artificial Sequence: Synthetic oligonucleotide
ugcggcaggaccaggaag

SEQ ID NO: 54715 - RNA, 18 nt, Artificial Sequence
  Description of Artificial Sequence: Synthetic oligonucleotide
cuggcugcggcaggacca

SEQ ID NO: 54716 - RNA, 18 nt, Artificial Sequence
  Description of Artificial Sequence: Synthetic oligonucleotide
cccaucuggcugcggcag

SEQ ID NO: 54717 - RNA, 18 nt, Artificial Sequence
  Description of Artificial Sequence: Synthetic oligonucleotide
cagcgcccaucuggcugc

SEQ ID NO: 54718 - RNA, 18 nt, Artificial Sequence
  Description of Artificial Sequence: Synthetic oligonucleotide
gcacccagcgcccaucug

SEQ ID NO: 54719 - RNA, 18 nt, Artificial Sequence
  Description of Artificial Sequence: Synthetic oligonucleotide
ccgcagcacccagcgccc

SEQ ID NO: 54720 - RNA, 18 nt, Artificial Sequence
  Description of Artificial Sequence: Synthetic oligonucleotide
ucggaccgcagcacccag

SEQ ID NO: 54721 - RNA, 18 nt, Artificial Sequence
  Description of Artificial Sequence: Synthetic oligonucleotide
gcggcucggaccgcagca

SEQ ID NO: 54722 - RNA, 18 nt, Artificial Sequence
  Description of Artificial Sequence: Synthetic oligonucleotide
gccgugcggcucggaccg

SEQ ID NO: 54723 - RNA, 18 nt, Artificial Sequence
  Description of Artificial Sequence: Synthetic oligonucleotide
aagcggccgugcggcucg

SEQ ID NO: 54724 - RNA, 18 nt, Artificial Sequence
  Description of Artificial Sequence: Synthetic oligonucleotide
cgaagaagcggccgugcg

SEQ ID NO: 54725 - RNA, 18 nt, Artificial Sequence
  Description of Artificial Sequence: Synthetic oligonucleotide
gccuccgaagaagcggcc

SEQ ID NO: 54726 - RNA, 18 nt, Artificial Sequence
  Description of Artificial Sequence: Synthetic oligonucleotide
ucggugccuccgaagaag

SEQ ID NO: 54727 - RNA, 18 nt, Artificial Sequence
  Description of Artificial Sequence: Synthetic oligonucleotide
gguccucggugccuccga

SEQ ID NO: 54728 - RNA, 18 nt, Artificial Sequence
  Description of Artificial Sequence: Synthetic oligonucleotide
cagcugguccucggugcc

SEQ ID NO: 54729 - RNA, 18 nt, Artificial Sequence
  Description of Artificial Sequence: Synthetic oligonucleotide
caggacagcugguccucg

SEQ ID NO: 54730 - RNA, 18 nt, Artificial Sequence
  Description of Artificial Sequence: Synthetic oligonucleotide
cgaagcaggacagcuggu

SEQ ID NO: 54731 - RNA, 18 nt, Artificial Sequence
  Description of Artificial Sequence: Synthetic oligonucleotide
uguggcgaagcaggacag

SEQ ID NO: 54732 - RNA, 18 nt, Artificial Sequence
  Description of Artificial Sequence: Synthetic oligonucleotide
acggcuguggcgaagcag

SEQ ID NO: 54733 - RNA, 18 nt, Artificial Sequence
  Description of Artificial Sequence: Synthetic oligonucleotide
gggaaacggcuguggcga

SEQ ID NO: 54734 - RNA, 18 nt, Artificial Sequence
  Description of Artificial Sequence: Synthetic oligonucleotide
guccacagcucggccggg

SEQ ID NO: 54735 - RNA, 18 nt, Artificial Sequence
  Description of Artificial Sequence: Synthetic oligonucleotide
acgguccacagcucggcc

SEQ ID NO: 54736 - RNA, 18 nt, Artificial Sequence
  Description of Artificial Sequence: Synthetic oligonucleotide
ggugcacgguccacagcu

SEQ ID NO: 54737 - RNA, 18 nt, Artificial Sequence
  Description of Artificial Sequence: Synthetic oligonucleotide
ggccaggugcacggucca

SEQ ID NO: 54738 - RNA, 18 nt, Artificial Sequence
  Description of Artificial Sequence: Synthetic oligonucleotide
uggauggccaggugcacg

SEQ ID NO: 54739 - RNA, 18 nt, Artificial Sequence
  Description of Artificial Sequence: Synthetic oligonucleotide
gcggguggauggccaggu

SEQ ID NO: 54740 - RNA, 18 nt, Artificial Sequence
  Description of Artificial Sequence: Synthetic oligonucleotide
ggccugcggguggauggc

SEQ ID NO: 54741 - RNA, 18 nt, Artificial Sequence
  Description of Artificial Sequence: Synthetic oligonucleotide
aggugggccugcgggugg

SEQ ID NO: 54742 - RNA, 18 nt, Artificial Sequence
  Description of Artificial Sequence: Synthetic oligonucleotide
ucagcaggugggccugcg

SEQ ID NO: 54743 - RNA, 18 nt, Artificial Sequence
  Description of Artificial Sequence: Synthetic oligonucleotide
cacgcucagcaggugggc

SEQ ID NO: 54744 - RNA, 18 nt, Artificial Sequence
  Description of Artificial Sequence: Synthetic oligonucleotide
cggcucacgcucagcagg

SEQ ID NO: 54745 - RNA, 18 nt, Artificial Sequence
  Description of Artificial Sequence: Synthetic oligonucleotide
gccgccggcucacgcuca

SEQ ID NO: 54746 - RNA, 18 nt, Artificial Sequence
  Description of Artificial Sequence: Synthetic oligonucleotide
guagcgccgccggcucac

SEQ ID NO: 54747 - RNA, 18 nt, Artificial Sequence
  Description of Artificial Sequence: Synthetic oligonucleotide
ugcacguagcgccgccgg

SEQ ID NO: 54748 - RNA, 18 nt, Artificial Sequence
  Description of Artificial Sequence: Synthetic oligonucleotide
acaggugcacguagcgcc

SEQ ID NO: 54749 - RNA, 18 nt, Artificial Sequence
  Description of Artificial Sequence: Synthetic oligonucleotide
cgggcacaggugcacgua

SEQ ID NO: 54750 - RNA, 18 nt, Artificial Sequence
  Description of Artificial Sequence: Synthetic oligonucleotide
ucccgcgggcacaggugc

SEQ ID NO: 54751 - RNA, 18 nt, Artificial Sequence
  Description of Artificial Sequence: Synthetic oligonucleotide
cguccucccgcgggcaca

SEQ ID NO: 54752 - RNA, 18 nt, Artificial Sequence
  Description of Artificial Sequence: Synthetic oligonucleotide
caucucguccucccgcgg

SEQ ID NO: 54753 - RNA, 18 nt, Artificial Sequence
  Description of Artificial Sequence: Synthetic oligonucleotide
gcggccaucucguccucc

SEQ ID NO: 54754 - RNA, 18 nt, Artificial Sequence
  Description of Artificial Sequence: Synthetic oligonucleotide
cgucugcggccaucucgu

SEQ ID NO: 54755 - RNA, 18 nt, Artificial Sequence
  Description of Artificial Sequence: Synthetic oligonucleotide
gucuccgucugcggccau

SEQ ID NO: 54756 - RNA, 18 nt, Artificial Sequence
  Description of Artificial Sequence: Synthetic oligonucleotide
ggcuugucuccgucugcg

SEQ ID NO: 54757 - RNA, 18 nt, Artificial Sequence
  Description of Artificial Sequence: Synthetic oligonucleotide
cccagggcuugucuccgu

SEQ ID NO: 54758 - RNA, 18 nt, Artificial Sequence
  Description of Artificial Sequence: Synthetic oligonucleotide
cacgccccagggcuuguc

SEQ ID NO: 54759 - RNA, 18 nt, Artificial Sequence
  Description of Artificial Sequence: Synthetic oligonucleotide
gcguccacgccccagggc

SEQ ID NO: 54760 - RNA, 18 nt, Artificial Sequence
  Description of Artificial Sequence: Synthetic oligonucleotide
ggagggcguccacgcccc

SEQ ID NO: 54761 - RNA, 18 nt, Artificial Sequence
  Description of Artificial Sequence: Synthetic oligonucleotide
ggugaggagggcguccac

SEQ ID NO: 54762 - RNA, 18 nt, Artificial Sequence
  Description of Artificial Sequence: Synthetic oligonucleotide
augagggugaggagggcg

SEQ ID NO: 54763 - RNA, 18 nt, Artificial Sequence
  Description of Artificial Sequence: Synthetic oligonucleotide
ggaagaugagggugagga

SEQ ID NO: 54764 - RNA, 18 nt, Artificial Sequence
  Description of Artificial Sequence: Synthetic oligonucleotide
gcuccggaagaugagggu

SEQ ID NO: 54765 - RNA, 18 nt, Artificial Sequence
  Description of Artificial Sequence: Synthetic oligonucleotide
cgucggcuccggaagaug

SEQ ID NO: 54766 - RNA, 18 nt, Artificial Sequence
  Description of Artificial Sequence: Synthetic oligonucleotide
aguaccgucggcuccgga

SEQ ID NO: 54767 - RNA, 18 nt, Artificial Sequence
  Description of Artificial Sequence: Synthetic oligonucleotide
gaggcaguaccgucggcu

SEQ ID NO: 54768 - RNA, 18 nt, Artificial Sequence
  Description of Artificial Sequence: Synthetic oligonucleotide
gacuugaggcaguaccgu

SEQ ID NO: 54769 - RNA, 18 nt, Artificial Sequence
  Description of Artificial Sequence: Synthetic oligonucleotide
cacaggacuugaggcagu

SEQ ID NO: 54770 - RNA, 18 nt, Artificial Sequence
  Description of Artificial Sequence: Synthetic oligonucleotide
gcugucacaggacuugag

SEQ ID NO: 54771 - RNA, 18 nt, Artificial Sequence
  Description of Artificial Sequence: Synthetic oligonucleotide
uagcggcugucacaggac

SEQ ID NO: 54772 - RNA, 18 nt, Artificial Sequence
  Description of Artificial Sequence: Synthetic oligonucleotide
gcagguagcggcugucac

SEQ ID NO: 54773 - RNA, 18 nt, Artificial Sequence
  Description of Artificial Sequence: Synthetic oligonucleotide
gcugcgcagguagcggcu

SEQ ID NO: 54774 - RNA, 18 nt, Artificial Sequence
  Description of Artificial Sequence: Synthetic oligonucleotide
ccgucgcugcgcagguag

SEQ ID NO: 54775 - RNA, 18 nt, Artificial Sequence
  Description of Artificial Sequence: Synthetic oligonucleotide
gacggccgucgcugcgca

SEQ ID NO: 54776 - RNA, 18 nt, Artificial Sequence
  Description of Artificial Sequence: Synthetic oligonucleotide
gaccagacggccgucgcu

SEQ ID NO: 54777 - RNA, 18 nt, Artificial Sequence
  Description of Artificial Sequence: Synthetic oligonucleotide
ucccagaccagacggccg

SEQ ID NO: 54778 - RNA, 18 nt, Artificial Sequence
  Description of Artificial Sequence: Synthetic oligonucleotide
caggcucccagaccagac

SEQ ID NO: 54779 - RNA, 18 nt, Artificial Sequence
  Description of Artificial Sequence: Synthetic oligonucleotide
gggcucaggcucccagac

SEQ ID NO: 54780 - RNA, 18 nt, Artificial Sequence
  Description of Artificial Sequence: Synthetic oligonucleotide
gcguguagcaggcacggg

SEQ ID NO: 54781 - RNA, 18 nt, Artificial Sequence
  Description of Artificial Sequence: Synthetic oligonucleotide
uccagcguguagcaggca

SEQ ID NO: 54782 - RNA, 18 nt, Artificial Sequence
  Description of Artificial Sequence: Synthetic oligonucleotide
ugaacuccagcguguagc

SEQ ID NO: 54783 - RNA, 18 nt, Artificial Sequence
  Description of Artificial Sequence: Synthetic oligonucleotide
cgccuugaacuccagcgu

SEQ ID NO: 54784 - RNA, 18 nt, Artificial Sequence
  Description of Artificial Sequence: Synthetic oligonucleotide
uugcccgccuugaacucc

SEQ ID NO: 54785 - RNA, 18 nt, Artificial Sequence
  Description of Artificial Sequence: Synthetic oligonucleotide
ccagcuugcccgccuuga

SEQ ID NO: 54786 - RNA, 18 nt, Artificial Sequence
  Description of Artificial Sequence: Synthetic oligonucleotide
gaaggccagcuugcccgc

SEQ ID NO: 54787 - RNA, 18 nt, Artificial Sequence
  Description of Artificial Sequence: Synthetic oligonucleotide
uccuugaaggccagcuug

SEQ ID NO: 54788 - RNA, 18 nt, Artificial Sequence
  Description of Artificial Sequence: Synthetic oligonucleotide
cgcaguccuugaaggcca

SEQ ID NO: 54789 - RNA, 18 nt, Artificial Sequence
  Description of Artificial Sequence: Synthetic oligonucleotide
gccgucgcaguccuugaa

SEQ ID NO: 54790 - RNA, 18 nt, Artificial Sequence
  Description of Artificial Sequence: Synthetic oligonucleotide
uaguggccgucgcagucc

SEQ ID NO: 54791 - RNA, 18 nt, Artificial Sequence
  Description of Artificial Sequence: Synthetic oligonucleotide
ccagguaguggccgucgc

SEQ ID NO: 54792 - RNA, 18 nt, Artificial Sequence
  Description of Artificial Sequence: Synthetic oligonucleotide
gggugccagguaguggcc

SEQ ID NO: 54793 - RNA, 18 nt, Artificial Sequence
  Description of Artificial Sequence: Synthetic oligonucleotide
cccacgggugccagguag

SEQ ID NO: 54794 - RNA, 18 nt, Artificial Sequence
  Description of Artificial Sequence: Synthetic oligonucleotide
cgggccccacgggugcca

SEQ ID NO: 54795 - RNA, 18 nt, Artificial Sequence
  Description of Artificial Sequence: Synthetic oligonucleotide
gccugcgggccccacggg

SEQ ID NO: 54796 - RNA, 18 nt, Artificial Sequence
  Description of Artificial Sequence: Synthetic oligonucleotide
agggugccugcgggcccc

SEQ ID NO: 54797 - RNA, 18 nt, Artificial Sequence
  Description of Artificial Sequence: Synthetic oligonucleotide
ccuugagggugccugcgg

SEQ ID NO: 54798 - RNA, 18 nt, Artificial Sequence
  Description of Artificial Sequence: Synthetic oligonucleotide
gccggccuugagggugcc

SEQ ID NO: 54799 - RNA, 18 nt, Artificial Sequence
  Description of Artificial Sequence: Synthetic oligonucleotide
uuucggccggccuugagg

SEQ ID NO: 54800 - RNA, 18 nt, Artificial Sequence
  Description of Artificial Sequence: Synthetic oligonucleotide
gcguguuucggccggccu

SEQ ID NO: 54801 - RNA, 18 nt, Artificial Sequence
  Description of Artificial Sequence: Synthetic oligonucleotide
aggucgcguguuucggcc

SEQ ID NO: 54802 - RNA, 18 nt, Artificial Sequence
  Description of Artificial Sequence: Synthetic oligonucleotide
uugccaggucgcguguuu

SEQ ID NO: 54803 - RNA, 18 nt, Artificial Sequence
  Description of Artificial Sequence: Synthetic oligonucleotide
cauccuugccaggucgcg

SEQ ID NO: 54804 - RNA, 18 nt, Artificial Sequence
  Description of Artificial Sequence: Synthetic oligonucleotide
gagcucauccuugccagg

SEQ ID NO: 54805 - RNA, 18 nt, Artificial Sequence
  Description of Artificial Sequence: Synthetic oligonucleotide
ucaaagagcucauccuug

SEQ ID NO: 54806 - RNA, 18 nt, Artificial Sequence
  Description of Artificial Sequence: Synthetic oligonucleotide
ccagaucaaagagcucau

SEQ ID NO: 54807 - RNA, 18 nt, Artificial Sequence
  Description of Artificial Sequence: Synthetic oligonucleotide
cuccuccagaucaaagag

SEQ ID NO: 54808 - RNA, 18 nt, Artificial Sequence
  Description of Artificial Sequence: Synthetic oligonucleotide
ugacucuccuccagauca

SEQ ID NO: 54809 - RNA, 18 nt, Artificial Sequence
  Description of Artificial Sequence: Synthetic oligonucleotide
gugggugacucuccucca

SEQ ID NO: 54810 - RNA, 18 nt, Artificial Sequence
  Description of Artificial Sequence: Synthetic oligonucleotide
caccugugggugacucuc

SEQ ID NO: 54811 - RNA, 18 nt, Artificial Sequence
  Description of Artificial Sequence: Synthetic oligonucleotide
agcaccaccuguggguga

SEQ ID NO: 54812 - RNA, 18 nt, Artificial Sequence
  Description of Artificial Sequence: Synthetic oligonucleotide
ccaccagcaccaccugug

SEQ ID NO: 54813 - RNA, 18 nt, Artificial Sequence
  Description of Artificial Sequence: Synthetic oligonucleotide
ggcagccaccagcaccac

SEQ ID NO: 54814 - RNA, 18 nt, Artificial Sequence
  Description of Artificial Sequence: Synthetic oligonucleotide
ugguuggcagccaccagc

SEQ ID NO: 54815 - RNA, 18 nt, Artificial Sequence
  Description of Artificial Sequence: Synthetic oligonucleotide
agcggugguuggcagcca

SEQ ID NO: 54816 - RNA, 18 nt, Artificial Sequence
  Description of Artificial Sequence: Synthetic oligonucleotide
gacguagcggugguuggc

SEQ ID NO: 54817 - RNA, 18 nt, Artificial Sequence
  Description of Artificial Sequence: Synthetic oligonucleotide
acagagacguagcggugg

SEQ ID NO: 54818 - RNA, 18 nt, Artificial Sequence
  Description of Artificial Sequence: Synthetic oligonucleotide
gccgcacagagacguagc

SEQ ID NO: 54819 - RNA, 18 nt, Artificial Sequence
  Description of Artificial Sequence: Synthetic oligonucleotide
gucgccaccugugcccuc

SEQ ID NO: 54820 - RNA, 18 nt, Artificial Sequence
  Description of Artificial Sequence: Synthetic oligonucleotide
aggaggucgccaccugug

SEQ ID NO: 54821 - RNA, 18 nt, Artificial Sequence
  Description of Artificial Sequence: Synthetic oligonucleotide
cccucaggaggucgccac

SEQ ID NO: 54822 - RNA, 18 nt, Artificial Sequence
  Description of Artificial Sequence: Synthetic oligonucleotide
agcaccccucaggagguc

SEQ ID NO: 54823 - RNA, 18 nt, Artificial Sequence
  Description of Artificial Sequence: Synthetic oligonucleotide
gucccagcaccccucagg

SEQ ID NO: 54824 - RNA, 18 nt, Artificial Sequence
  Description of Artificial Sequence: Synthetic oligonucleotide
gggucccagcaccccuca

SEQ ID NO: 54825 - RNA, 18 nt, Artificial Sequence
  Description of Artificial Sequence: Synthetic oligonucleotide
cuccucccugaagcaggg

SEQ ID NO: 54826 - RNA, 18 nt, Artificial Sequence
  Description of Artificial Sequence: Synthetic oligonucleotide
acggccuccucccugaag

SEQ ID NO: 54827 - RNA, 18 nt, Artificial Sequence
  Description of Artificial Sequence: Synthetic oligonucleotide
cccccacggccuccuccc

SEQ ID NO: 54828 - RNA, 18 nt, Artificial Sequence
  Description of Artificial Sequence: Synthetic oligonucleotide
ugagacccccacggccuc

SEQ ID NO: 54829 - RNA, 18 nt, Artificial Sequence
  Description of Artificial Sequence: Synthetic oligonucleotide
ccccgugagacccccacg

SEQ ID NO: 54830 - RNA, 18 nt, Artificial Sequence
  Description of Artificial Sequence: Synthetic oligonucleotide
ccacuccccgugagaccc

SEQ ID NO: 54831 - RNA, 18 nt, Artificial Sequence
  Description of Artificial Sequence: Synthetic oligonucleotide
cgauaccacuccccguga

SEQ ID NO: 54832 - RNA, 18 nt, Artificial Sequence
  Description of Artificial Sequence: Synthetic oligonucleotide
agacacgauaccacuccc

SEQ ID NO: 54833 - RNA, 18 nt, Artificial Sequence
  Description of Artificial Sequence: Synthetic oligonucleotide
cgcacagacacgauacca

SEQ ID NO: 54834 - RNA, 18 nt, Artificial Sequence
  Description of Artificial Sequence: Synthetic oligonucleotide
gugaacgcacagacacga

SEQ ID NO: 54835 - RNA, 18 nt, Artificial Sequence
  Description of Artificial Sequence: Synthetic oligonucleotide
gacaugugaacgcacaga

SEQ ID NO: 54836 - RNA, 18 nt, Artificial Sequence
  Description of Artificial Sequence: Synthetic oligonucleotide
gaacagacaugugaacgc

SEQ ID NO: 54837 - RNA, 18 nt, Artificial Sequence
  Description of Artificial Sequence: Synthetic oligonucleotide
gcccagaacagacaugug

SEQ ID NO: 54838 - RNA, 18 nt, Artificial Sequence
  Description of Artificial Sequence: Synthetic oligonucleotide
ccccagcccagaacagac

SEQ ID NO: 54839 - RNA, 18 nt, Artificial Sequence
  Description of Artificial Sequence: Synthetic oligonucleotide
uggacccccagcccagaa

SEQ ID NO: 54840 - RNA, 18 nt, Artificial Sequence
  Description of Artificial Sequence: Synthetic oligonucleotide
ccacauggacccccagcc

SEQ ID NO: 54841 - RNA, 18 nt, Artificial Sequence
  Description of Artificial Sequence: Synthetic oligonucleotide
augucccacauggacccc

SEQ ID NO: 54842 - RNA, 18 nt, Artificial Sequence
  Description of Artificial Sequence: Synthetic oligonucleotide
cacacaugucccacaugg

SEQ ID NO: 54843 - RNA, 18 nt, Artificial Sequence
  Description of Artificial Sequence: Synthetic oligonucleotide
guggccacacauguccca

SEQ ID NO: 54844 - RNA, 18 nt, Artificial Sequence
  Description of Artificial Sequence: Synthetic oligonucleotide
ccugaguggccacacaug

SEQ ID NO: 54845 - RNA, 18 nt, Artificial Sequence
  Description of Artificial Sequence: Synthetic oligonucleotide
uacacccugaguggccac

SEQ ID NO: 54846 - RNA, 18 nt, Artificial Sequence
  Description of Artificial Sequence: Synthetic oligonucleotide
ccaccuacacccugagug

SEQ ID NO: 54847 - RNA, 18 nt, Artificial Sequence
  Description of Artificial Sequence: Synthetic oligonucleotide
cccacccaccuacacccu

SEQ ID NO: 54848 - RNA, 18 nt, Artificial Sequence
  Description of Artificial Sequence: Synthetic oligonucleotide
cgaggcccacccaccuac

SEQ ID NO: 54849 - RNA, 18 nt, Artificial Sequence
  Description of Artificial Sequence: Synthetic oligonucleotide
uggcccgaggcccaccca

SEQ ID NO: 54850 - RNA, 18 nt, Artificial Sequence
  Description of Artificial Sequence: Synthetic oligonucleotide
gggcauggcccgaggccc

SEQ ID NO: 54851 - RNA, 18 nt, Artificial Sequence
  Description of Artificial Sequence: Synthetic oligonucleotide
cgccugggcauggcccga

SEQ ID NO: 54852 - RNA, 18 nt, Artificial Sequence
  Description of Artificial Sequence: Synthetic oligonucleotide
gggucgccugggcauggc

SEQ ID NO: 54853 - RNA, 18 nt, Artificial Sequence
  Description of Artificial Sequence: Synthetic oligonucleotide
ccaccaccccucaguggg

SEQ ID NO: 54854 - RNA, 18 nt, Artificial Sequence
  Description of Artificial Sequence: Synthetic oligonucleotide
ugaagccaccaccccuca

SEQ ID NO: 54855 - RNA, 18 nt, Artificial Sequence
  Description of Artificial Sequence: Synthetic oligonucleotide
gacccugaagccaccacc

SEQ ID NO: 54856 - RNA, 18 nt, Artificial Sequence
  Description of Artificial Sequence: Synthetic oligonucleotide
ccucugacccugaagcca

SEQ ID NO: 54857 - RNA, 18 nt, Artificial Sequence
  Description of Artificial Sequence: Synthetic oligonucleotide
ccuugccucugacccuga

SEQ ID NO: 54858 - RNA, 18 nt, Artificial Sequence
  Description of Artificial Sequence: Synthetic oligonucleotide
ggaacccuugccucugac

SEQ ID NO: 54859 - RNA, 18 nt, Artificial Sequence
  Description of Artificial Sequence: Synthetic oligonucleotide
ggccaggaacccuugccu

SEQ ID NO: 54860 - RNA, 18 nt, Artificial Sequence
  Description of Artificial Sequence: Synthetic oligonucleotide
agaaaggccaggaacccu

SEQ ID NO: 54861 - RNA, 18 nt, Artificial Sequence
  Description of Artificial Sequence: Synthetic oligonucleotide
ugcugagaaaggccagga

SEQ ID NO: 54862 - RNA, 18 nt, Artificial Sequence
  Description of Artificial Sequence: Synthetic oligonucleotide
agcuaugcugagaaaggc

SEQ ID NO: 54863 - RNA, 18 nt, Artificial Sequence
  Description of Artificial Sequence: Synthetic oligonucleotide
ucuccagcuaugcugaga

SEQ ID NO: 54864 - RNA, 18 nt, Artificial Sequence
  Description of Artificial Sequence: Synthetic oligonucleotide
gacauucuccagcuaugc

SEQ ID NO: 54865 - RNA, 18 nt, Artificial Sequence
  Description of Artificial Sequence: Synthetic oligonucleotide
gcugagacauucuccagc

SEQ ID NO: 54866 - RNA, 18 nt, Artificial Sequence
  Description of Artificial Sequence: Synthetic oligonucleotide
gcuuggcugagacauucu

SEQ ID NO: 54867 - RNA, 18 nt, Artificial Sequence
  Description of Artificial Sequence: Synthetic oligonucleotide
ccagggcuuggcugagac

SEQ ID NO: 54868 - RNA, 18 nt, Artificial Sequence
  Description of Artificial Sequence: Synthetic oligonucleotide
gcugcccagggcuuggcu

SEQ ID NO: 54869 - RNA, 18 nt, Artificial Sequence
  Description of Artificial Sequence: Synthetic oligonucleotide
ccgcagcugcccagggcu

SEQ ID NO: 54870 - RNA, 18 nt, Artificial Sequence
  Description of Artificial Sequence: Synthetic oligonucleotide
agacuccgcagcugccca

SEQ ID NO: 54871 - RNA, 18 nt, Artificial Sequence
  Description of Artificial Sequence: Synthetic oligonucleotide
gucucagacuccgcagcu

SEQ ID NO: 54872 - RNA, 18 nt, Artificial Sequence
  Description of Artificial Sequence: Synthetic oligonucleotide
cuccagucucagacuccg

SEQ ID NO: 54873 - RNA, 18 nt, Artificial Sequence
  Description of Artificial Sequence: Synthetic oligonucleotide
caccucuccagucucaga

SEQ ID NO: 54874 - RNA, 18 nt, Artificial Sequence
  Description of Artificial Sequence: Synthetic oligonucleotide
gcccacaccucuccaguc

SEQ ID NO: 54875 - RNA, 18 nt, Artificial Sequence
  Description of Artificial Sequence: Synthetic oligonucleotide
gccuggcccacaccucuc

SEQ ID NO: 54876 - RNA, 18 nt, Artificial Sequence
  Description of Artificial Sequence: Synthetic oligonucleotide
ccaucgccuggcccacac

SEQ ID NO: 54877 - RNA, 18 nt, Artificial Sequence
  Description of Artificial Sequence: Synthetic oligonucleotide
acugcccaucgccuggcc

SEQ ID NO: 54878 - RNA, 18 nt, Artificial Sequence
  Description of Artificial Sequence: Synthetic oligonucleotide
ugggcacugcccaucgcc

SEQ ID NO: 54879 - RNA, 18 nt, Artificial Sequence
  Description of Artificial Sequence: Synthetic oligonucleotide
ccugcugggcacugccca

SEQ ID NO: 54880 - RNA, 18 nt, Artificial Sequence
  Description of Artificial Sequence: Synthetic oligonucleotide
cugccccugcugggcacu

SEQ ID NO: 54881 - RNA, 18 nt, Artificial Sequence
  Description of Artificial Sequence: Synthetic oligonucleotide
gccuccugccccugcugg

SEQ ID NO: 54882 - RNA, 18 nt, Artificial Sequence
  Description of Artificial Sequence: Synthetic oligonucleotide
ugugggccuccugccccu

SEQ ID NO: 54883 - RNA, 18 nt, Artificial Sequence
  Description of Artificial Sequence: Synthetic oligonucleotide
caggcugugggccuccug

SEQ ID NO: 54884 - RNA, 18 nt, Artificial Sequence
  Description of Artificial Sequence: Synthetic oligonucleotide
caggccaggcugugggcc

SEQ ID NO: 54885 - RNA, 18 nt, Artificial Sequence
  Description of Artificial Sequence: Synthetic oligonucleotide
ggcaccaggccaggcugu

SEQ ID NO: 54886 - RNA, 18 nt, Artificial Sequence
  Description of Artificial Sequence: Synthetic oligonucleotide
cucauggcaccaggccag

SEQ ID NO: 54887 - RNA, 18 nt, Artificial Sequence
  Description of Artificial Sequence: Synthetic oligonucleotide
ugccccucauggcaccag

SEQ ID NO: 54888 - RNA, 18 nt, Artificial Sequence
  Description of Artificial Sequence: Synthetic oligonucleotide
ccacaugccccucauggc

SEQ ID NO: 54889 - RNA, 18 nt, Artificial Sequence
  Description of Artificial Sequence: Synthetic oligonucleotide
ccugcccacaugccccuc

SEQ ID NO: 54890 - RNA, 18 nt, Artificial Sequence
  Description of Artificial Sequence: Synthetic oligonucleotide
agccuccugcccacaugc

SEQ ID NO: 54891 - RNA, 18 nt, Artificial Sequence
  Description of Artificial Sequence: Synthetic oligonucleotide
cccacagccuccugccca

SEQ ID NO: 54892 - RNA, 18 nt, Artificial Sequence
  Description of Artificial Sequence: Synthetic oligonucleotide
gaccccccacagccuccu

SEQ ID NO: 54893 - RNA, 18 nt, Artificial Sequence
  Description of Artificial Sequence: Synthetic oligonucleotide
auauggaccccccacagc

SEQ ID NO: 54894 - RNA, 18 nt, Artificial Sequence
  Description of Artificial Sequence: Synthetic oligonucleotide
gggagauauggacccccc

SEQ ID NO: 54895 - RNA, 18 nt, Artificial Sequence
  Description of Artificial Sequence: Synthetic oligonucleotide
ggguggagaaaaagaagg

SEQ ID NO: 54896 - RNA, 18 nt, Artificial Sequence
  Description of Artificial Sequence: Synthetic oligonucleotide
ugaaguccagaaaauggg

SEQ ID NO: 54897 - RNA, 18 nt, Artificial Sequence
  Description of Artificial Sequence: Synthetic oligonucleotide
auaaaugaaguccagaaa

SEQ ID NO: 54898 - RNA, 18 nt, Artificial Sequence
  Description of Artificial Sequence: Synthetic oligonucleotide
aauaaauaaaugaagucc

SEQ ID NO: 54899 - RNA, 18 nt, Artificial Sequence
  Description of Artificial Sequence: Synthetic oligonucleotide
aaauaaauaaauaaauga

SEQ ID NO: 54900 - RNA, 18 nt, Artificial Sequence
  Description of Artificial Sequence: Synthetic oligonucleotide
ucaaaaaauaaauaaaua

SEQ ID NO: 54901 - RNA, 18 nt, Artificial Sequence
  Description of Artificial Sequence: Synthetic oligonucleotide
cugucucaaaaaauaaau

SEQ ID NO: 54902 - RNA, 18 nt, Artificial Sequence
  Description of Artificial Sequence: Synthetic oligonucleotide
agacucugucucaaaaaa

SEQ ID NO: 54903 - RNA, 18 nt, Artificial Sequence
  Description of Artificial Sequence: Synthetic oligonucleotide
gagcgagacucugucuca

SEQ ID NO: 54904 - RNA, 18 nt, Artificial Sequence
  Description of Artificial Sequence: Synthetic oligonucleotide
ugacagagcgagacucug

SEQ ID NO: 54905 - RNA, 18 nt, Artificial Sequence
  Description of Artificial Sequence: Synthetic oligonucleotide
cugggugacagagcgaga

SEQ ID NO: 54906 - RNA, 18 nt, Artificial Sequence
  Description of Artificial Sequence: Synthetic oligonucleotide
ccagccugggugacagag

SEQ ID NO: 54907 - RNA, 18 nt, Artificial Sequence
  Description of Artificial Sequence: Synthetic oligonucleotide
gcgcuccagccuggguga

SEQ ID NO: 54908 - RNA, 18 nt, Artificial Sequence
  Description of Artificial Sequence: Synthetic oligonucleotide
ccacugcgcuccagccug

SEQ ID NO: 54909 - RNA, 18 nt, Artificial Sequence
  Description of Artificial Sequence: Synthetic oligonucleotide
ucacgccacugcgcucca

SEQ ID NO: 54910 - RNA, 18 nt, Artificial Sequence
  Description of Artificial Sequence: Synthetic oligonucleotide
ucucccaggaccccuggg

SEQ ID NO: 54911 - RNA, 18 nt, Artificial Sequence
  Description of Artificial Sequence: Synthetic oligonucleotide
uuggucucccaggacccc

SEQ ID NO: 54912 - RNA, 18 nt, Artificial Sequence
  Description of Artificial Sequence: Synthetic oligonucleotide
ugugcuuggucucccagg

SEQ ID NO: 54913 - RNA, 18 nt, Artificial Sequence
  Description of Artificial Sequence: Synthetic oligonucleotide
ccaucugugcuuggucuc

SEQ ID NO: 54914 - RNA, 18 nt, Artificial Sequence
  Description of Artificial Sequence: Synthetic oligonucleotide
cccaaccaucugugcuug

SEQ ID NO: 54915 - RNA, 18 nt, Artificial Sequence
  Description of Artificial Sequence: Synthetic oligonucleotide
cuuuccccaaccaucugu

SEQ ID NO: 54916 - RNA, 18 nt, Artificial Sequence
  Description of Artificial Sequence: Synthetic oligonucleotide
ugcagcuuuccccaacca

SEQ ID NO: 54917 - RNA, 18 nt, Artificial Sequence
  Description of Artificial Sequence: Synthetic oligonucleotide
accucugcagcuuucccc

SEQ ID NO: 54918 - RNA, 18 nt, Artificial Sequence
  Description of Artificial Sequence: Synthetic oligonucleotide
cugucaccucugcagcuu

SEQ ID NO: 54919 - RNA, 18 nt, Artificial Sequence
  Description of Artificial Sequence: Synthetic oligonucleotide
ggucccugucaccucugc

SEQ ID NO: 54920 - RNA, 18 nt, Artificial Sequence
  Description of Artificial Sequence: Synthetic oligonucleotide
gggcuggucccugucacc

SEQ ID NO: 54921 - RNA, 18 nt, Artificial Sequence
  Description of Artificial Sequence: Synthetic oligonucleotide
ccugggcuccagccaggg

SEQ ID NO: 54922 - RNA, 18 nt, Artificial Sequence
  Description of Artificial Sequence: Synthetic oligonucleotide
ccccugggcuccagccag

SEQ ID NO: 54923 - RNA, 18 nt, Artificial Sequence
  Description of Artificial Sequence: Synthetic oligonucleotide
gggcaccccugggcucca

SEQ ID NO: 54924 - RNA, 18 nt, Artificial Sequence
  Description of Artificial Sequence: Synthetic oligonucleotide
ggugcggauggugauggg

SEQ ID NO: 54925 - RNA, 18 nt, Artificial Sequence
  Description of Artificial Sequence: Synthetic oligonucleotide
uggugcggauggugaugg

SEQ ID NO: 54926 - RNA, 18 nt, Artificial Sequence
  Description of Artificial Sequence: Synthetic oligonucleotide
gcaggaccuaaugaaggg

SEQ ID NO: 54927 - RNA, 18 nt, Artificial Sequence
  Description of Artificial Sequence: Synthetic oligonucleotide
cacaggcaggaccuaaug

SEQ ID NO: 54928 - RNA, 18 nt, Artificial Sequence
  Description of Artificial Sequence: Synthetic oligonucleotide
augggcacaggcaggacc

SEQ ID NO: 54929 - RNA, 18 nt, Artificial Sequence
  Description of Artificial Sequence: Synthetic oligonucleotide
gcuggaugggcacaggca

SEQ ID NO: 54930 - RNA, 18 nt, Artificial Sequence
  Description of Artificial Sequence: Synthetic oligonucleotide
aagcugcuggaugggcac

SEQ ID NO: 54931 - RNA, 18 nt, Artificial Sequence
  Description of Artificial Sequence: Synthetic oligonucleotide
acccuaagcugcuggaug

SEQ ID NO: 54932 - RNA, 18 nt, Artificial Sequence
  Description of Artificial Sequence: Synthetic oligonucleotide
aacucacccuaagcugcu

SEQ ID NO: 54933 - RNA, 18 nt, Artificial Sequence
  Description of Artificial Sequence: Synthetic oligonucleotide
uuuauaacucacccuaag

SEQ ID NO: 54934 - RNA, 18 nt, Artificial Sequence
  Description of Artificial Sequence: Synthetic oligonucleotide
cucuauuuauaacucacc

SEQ ID NO: 54935 - RNA, 18 nt, Artificial Sequence
  Description of Artificial Sequence: Synthetic oligonucleotide
ccagccucuauuuauaac

SEQ ID NO: 54936 - RNA, 18 nt, Artificial Sequence
  Description of Artificial Sequence: Synthetic oligonucleotide
uuaccccagccucuauuu

SEQ ID NO: 54937 - RNA, 18 nt, Artificial Sequence
  Description of Artificial Sequence: Synthetic oligonucleotide
agggcuuaccccagccuc

SEQ ID NO: 54938 - RNA, 18 nt, Artificial Sequence
  Description of Artificial Sequence: Synthetic oligonucleotide
gacccagggcuuacccca

SEQ ID NO: 54939 - RNA, 18 nt, Artificial Sequence
  Description of Artificial Sequence: Synthetic oligonucleotide
cucuugacccagggcuua

SEQ ID NO: 54940 - RNA, 18 nt, Artificial Sequence
  Description of Artificial Sequence: Synthetic oligonucleotide
cugcucucuugacccagg

SEQ ID NO: 54941 - RNA, 18 nt, Artificial Sequence
  Description of Artificial Sequence: Synthetic oligonucleotide
uugcccugcucucuugac

SEQ ID NO: 54942 - RNA, 18 nt, Artificial Sequence
  Description of Artificial Sequence: Synthetic oligonucleotide
ucuccuugcccugcucuc

SEQ ID NO: 54943 - RNA, 18 nt, Artificial Sequence
  Description of Artificial Sequence: Synthetic oligonucleotide
gguaaucuccuugcccug

SEQ ID NO: 54944 - RNA, 18 nt, Artificial Sequence
  Description of Artificial Sequence: Synthetic oligonucleotide
cagcugguaaucuccuug

SEQ ID NO: 54945 - RNA, 18 nt, Artificial Sequence
  Description of Artificial Sequence: Synthetic oligonucleotide
guaaucagcugguaaucu

SEQ ID NO: 54946 - RNA, 18 nt, Artificial Sequence
  Description of Artificial Sequence: Synthetic oligonucleotide
aaucaguaaucagcuggu

SEQ ID NO: 54947 - RNA, 18 nt, Artificial Sequence
  Description of Artificial Sequence: Synthetic oligonucleotide
cugcuaaucaguaaucag

SEQ ID NO: 54948 - RNA, 18 nt, Artificial Sequence
  Description of Artificial Sequence: Synthetic oligonucleotide
acucucugcuaaucagua

SEQ ID NO: 54949 - RNA, 18 nt, Artificial Sequence
  Description of Artificial Sequence: Synthetic oligonucleotide
cccccacucucugcuaau

SEQ ID NO: 54950 - RNA, 18 nt, Artificial Sequence
  Description of Artificial Sequence: Synthetic oligonucleotide
cacagcccccacucucug

SEQ ID NO: 54951 - RNA, 18 nt, Artificial Sequence
  Description of Artificial Sequence: Synthetic oligonucleotide
cuuggcacagcccccacu

SEQ ID NO: 54952 - RNA, 18 nt, Artificial Sequence
  Description of Artificial Sequence: Synthetic oligonucleotide
uucugcuuggcacagccc

SEQ ID NO: 54953 - RNA, 18 nt, Artificial Sequence
  Description of Artificial Sequence: Synthetic oligonucleotide
ggcccuucugcuuggcac

SEQ ID NO: 54954 - RNA, 18 nt, Artificial Sequence
  Description of Artificial Sequence: Synthetic oligonucleotide
agccaggcccuucugcuu

SEQ ID NO: 54955 - RNA, 18 nt, Artificial Sequence
  Description of Artificial Sequence: Synthetic oligonucleotide
ccaggagccaggcccuuc

SEQ ID NO: 54956 - RNA, 18 nt, Artificial Sequence
  Description of Artificial Sequence: Synthetic oligonucleotide
cacccccaggagccaggc

SEQ ID NO: 54957 - RNA, 18 nt, Artificial Sequence
  Description of Artificial Sequence: Synthetic oligonucleotide
cuccacacccccaggagc

SEQ ID NO: 54958 - RNA, 18 nt, Artificial Sequence
  Description of Artificial Sequence: Synthetic oligonucleotide
ccucccuccacaccccca

SEQ ID NO: 54959 - RNA, 18 nt, Artificial Sequence
  Description of Artificial Sequence: Synthetic oligonucleotide
ccugaccucccuccacac

SEQ ID NO: 54960 - RNA, 18 nt, Artificial Sequence
  Description of Artificial Sequence: Synthetic oligonucleotide
ggagcccugaccucccuc

SEQ ID NO: 54961 - RNA, 18 nt, Artificial Sequence
  Description of Artificial Sequence: Synthetic oligonucleotide
ccaagggagcccugaccu

SEQ ID NO: 54962 - RNA, 18 nt, Artificial Sequence
  Description of Artificial Sequence: Synthetic oligonucleotide
uguccccaagggagcccu

SEQ ID NO: 54963 - RNA, 18 nt, Artificial Sequence
  Description of Artificial Sequence: Synthetic oligonucleotide
cacacuguccccaaggga

SEQ ID NO: 54964 - RNA, 18 nt, Artificial Sequence
  Description of Artificial Sequence: Synthetic oligonucleotide
cccugcacacugucccca

SEQ ID NO: 54965 - RNA, 18 nt, Artificial Sequence
  Description of Artificial Sequence: Synthetic oligonucleotide
guggacccugcacacugu

SEQ ID NO: 54966 - RNA, 18 nt, Artificial Sequence
  Description of Artificial Sequence: Synthetic oligonucleotide
cgucuguggacccugcac

SEQ ID NO: 54967 - RNA, 18 nt, Artificial Sequence
  Description of Artificial Sequence: Synthetic oligonucleotide
ugugccgucuguggaccc

SEQ ID NO: 54968 - RNA, 18 nt, Artificial Sequence
  Description of Artificial Sequence: Synthetic oligonucleotide
ccauaugugccgucugug

SEQ ID NO: 54969 - RNA, 18 nt, Artificial Sequence
  Description of Artificial Sequence: Synthetic oligonucleotide
cagggccauaugugccgu

SEQ ID NO: 54970 - RNA, 18 nt, Artificial Sequence
  Description of Artificial Sequence: Synthetic oligonucleotide
ugccccagggccauaugu

SEQ ID NO: 54971 - RNA, 18 nt, Artificial Sequence
  Description of Artificial Sequence: Synthetic oligonucleotide
aacccugccccagggcca

SEQ ID NO: 54972 - RNA, 18 nt, Artificial Sequence
  Description of Artificial Sequence: Synthetic oligonucleotide
cugggaacccugccccag

SEQ ID NO: 54973 - RNA, 18 nt, Artificial Sequence
  Description of Artificial Sequence: Synthetic oligonucleotide
agacccugggaacccugc

SEQ ID NO: 54974 - RNA, 18 nt, Artificial Sequence
  Description of Artificial Sequence: Synthetic oligonucleotide
cucagagacccugggaac

SEQ ID NO: 54975 - RNA, 18 nt, Artificial Sequence
  Description of Artificial Sequence: Synthetic oligonucleotide
caccucucagagacccug

SEQ ID NO: 54976 - RNA, 18 nt, Artificial Sequence
  Description of Artificial Sequence: Synthetic oligonucleotide
gaaggcaccucucagaga

SEQ ID NO: 54977 - RNA, 18 nt, Artificial Sequence
  Description of Artificial Sequence: Synthetic oligonucleotide
auuuggaaggcaccucuc

SEQ ID NO: 54978 - RNA, 18 nt, Artificial Sequence
  Description of Artificial Sequence: Synthetic oligonucleotide
agaagauuuggaaggcac

SEQ ID NO: 54979 - RNA, 18 nt, Artificial Sequence
  Description of Artificial Sequence: Synthetic oligonucleotide
acuugagaagauuuggaa

SEQ ID NO: 54980 - RNA, 18 nt, Artificial Sequence
  Description of Artificial Sequence: Synthetic oligonucleotide
ucuugacuugagaagauu

SEQ ID NO: 54981 - RNA, 18 nt, Artificial Sequence
  Description of Artificial Sequence: Synthetic oligonucleotide
aacccucuugacuugaga

SEQ ID NO: 54982 - RNA, 18 nt, Artificial Sequence
  Description of Artificial Sequence: Synthetic oligonucleotide
ucuagaacccucuugacu

SEQ ID NO: 54983 - RNA, 18 nt, Artificial Sequence
  Description of Artificial Sequence: Synthetic oligonucleotide
ucucaucuagaacccucu

SEQ ID NO: 54984 - RNA, 18 nt, Artificial Sequence
  Description of Artificial Sequence: Synthetic oligonucleotide
gugggucucaucuagaac

SEQ ID NO: 54985 - RNA, 18 nt, Artificial Sequence
  Description of Artificial Sequence: Synthetic oligonucleotide
cagaggugggucucaucu

SEQ ID NO: 54986 - RNA, 18 nt, Artificial Sequence
  Description of Artificial Sequence: Synthetic oligonucleotide
gaagccagaggugggucu

SEQ ID NO: 54987 - RNA, 18 nt, Artificial Sequence
  Description of Artificial Sequence: Synthetic oligonucleotide
ccccugaagccagaggug

SEQ ID NO: 54988 - RNA, 18 nt, Artificial Sequence
  Description of Artificial Sequence: Synthetic oligonucleotide
gggcaccccugaagccag

SEQ ID NO: 54989 - RNA, 18 nt, Artificial Sequence
  Description of Artificial Sequence: Synthetic oligonucleotide
ccuggguagggagcaggg

SEQ ID NO: 54990 - RNA, 18 nt, Artificial Sequence
  Description of Artificial Sequence: Synthetic oligonucleotide
uccuggguagggagcagg

SEQ ID NO: 54991 - RNA, 18 nt, Artificial Sequence
  Description of Artificial Sequence: Synthetic oligonucleotide
gccucuccuggguaggga

SEQ ID NO: 54992 - RNA, 18 nt, Artificial Sequence
  Description of Artificial Sequence: Synthetic oligonucleotide
cucacgccucuccugggu

SEQ ID NO: 54993 - RNA, 18 nt, Artificial Sequence
  Description of Artificial Sequence: Synthetic oligonucleotide
agccccucacgccucucc

SEQ ID NO: 54994 - RNA, 18 nt, Artificial Sequence
  Description of Artificial Sequence: Synthetic oligonucleotide
uuggcugagacguugacc

SEQ ID NO: 54995 - RNA, 18 nt, Artificial Sequence
  Description of Artificial Sequence: Synthetic oligonucleotide
ccugauuggcugagacgu

SEQ ID NO: 54996 - RNA, 18 nt, Artificial Sequence
  Description of Artificial Sequence: Synthetic oligonucleotide
aucauccugauuggcuga

SEQ ID NO: 54997 - RNA, 18 nt, Artificial Sequence
  Description of Artificial Sequence: Synthetic oligonucleotide
aguucaucauccugauug

SEQ ID NO: 54998 - RNA, 18 nt, Artificial Sequence
  Description of Artificial Sequence: Synthetic oligonucleotide
ggucuaguucaucauccu

SEQ ID NO: 54999 - RNA, 18 nt, Artificial Sequence
  Description of Artificial Sequence: Synthetic oligonucleotide
cucguggucuaguucauc

SEQ ID NO: 55000 - RNA, 18 nt, Artificial Sequence
  Description of Artificial Sequence: Synthetic oligonucleotide
aaggucucguggucuagu

SEQ ID NO: 55001 - RNA, 18 nt, Artificial Sequence
  Description of Artificial Sequence: Synthetic oligonucleotide
ucaggaaggucucguggu

SEQ ID NO: 55002 - RNA, 18 nt, Artificial Sequence
  Description of Artificial Sequence: Synthetic oligonucleotide
uugcaucaggaaggucuc

SEQ ID NO: 55003 - RNA, 18 nt, Artificial Sequence
  Description of Artificial Sequence: Synthetic oligonucleotide
ucaauuugcaucaggaag

SEQ ID NO: 55004 - RNA, 18 nt, Artificial Sequence
  Description of Artificial Sequence: Synthetic oligonucleotide
ccuggucaauuugcauca

SEQ ID NO: 55005 - RNA, 18 nt, Artificial Sequence
  Description of Artificial Sequence: Synthetic oligonucleotide
ugucuccuggucaauuug

SEQ ID NO: 55006 - RNA, 18 nt, Artificial Sequence
  Description of Artificial Sequence: Synthetic oligonucleotide
uucuuugucuccugguca

SEQ ID NO: 55007 - RNA, 18 nt, Artificial Sequence
  Description of Artificial Sequence: Synthetic oligonucleotide
ugcacuucuuugucuccu

SEQ ID NO: 55008 - RNA, 18 nt, Artificial Sequence
  Description of Artificial Sequence: Synthetic oligonucleotide
gaaggugcacuucuuugu

SEQ ID NO: 55009 - RNA, 18 nt, Artificial Sequence
  Description of Artificial Sequence: Synthetic oligonucleotide
gaauagaaggugcacuuc

SEQ ID NO: 55010 - RNA, 18 nt, Artificial Sequence
  Description of Artificial Sequence: Synthetic oligonucleotide
ugcuggaauagaaggugc

SEQ ID NO: 55011 - RNA, 18 nt, Artificial Sequence
  Description of Artificial Sequence: Synthetic oligonucleotide
cccagugcuggaauagaa

SEQ ID NO: 55012 - RNA, 18 nt, Artificial Sequence
  Description of Artificial Sequence: Synthetic oligonucleotide
uagcccccagugcuggaa

SEQ ID NO: 55013 - RNA, 18 nt, Artificial Sequence
  Description of Artificial Sequence: Synthetic oligonucleotide
uccaguagcccccagugc

SEQ ID NO: 55014 - RNA, 18 nt, Artificial Sequence
  Description of Artificial Sequence: Synthetic oligonucleotide
caggguccaguagccccc

SEQ ID NO: 55015 - RNA, 18 nt, Artificial Sequence
  Description of Artificial Sequence: Synthetic oligonucleotide
gugaccaggguccaguag

SEQ ID NO: 55016 - RNA, 18 nt, Artificial Sequence
  Description of Artificial Sequence: Synthetic oligonucleotide
caugggugaccagggucc

SEQ ID NO: 55017 - RNA, 18 nt, Artificial Sequence
  Description of Artificial Sequence: Synthetic oligonucleotide
gcccccaugggugaccag

SEQ ID NO: 55018 - RNA, 18 nt, Artificial Sequence
  Description of Artificial Sequence: Synthetic oligonucleotide
ugaaugcccccaugggug

SEQ ID NO: 55019 - RNA, 18 nt, Artificial Sequence
  Description of Artificial Sequence: Synthetic oligonucleotide
uggcgugaaugcccccau

SEQ ID NO: 55020 - RNA, 18 nt, Artificial Sequence
  Description of Artificial Sequence: Synthetic oligonucleotide
ggcuguggcgugaaugcc

SEQ ID NO: 55021 - RNA, 18 nt, Artificial Sequence
  Description of Artificial Sequence: Synthetic oligonucleotide
uguguggcuguggcguga

SEQ ID NO: 55022 - RNA, 18 nt, Artificial Sequence
  Description of Artificial Sequence: Synthetic oligonucleotide
aaacaugguguuggcaga

SEQ ID NO: 55023 - RNA, 18 nt, Artificial Sequence
  Description of Artificial Sequence: Synthetic oligonucleotide
aucucaaacaugguguug

SEQ ID NO: 55024 - RNA, 18 nt, Artificial Sequence
  Description of Artificial Sequence: Synthetic oligonucleotide
acuccaucucaaacaugg

SEQ ID NO: 55025 - RNA, 18 nt, Artificial Sequence
  Description of Artificial Sequence: Synthetic oligonucleotide
acgccacuccaucucaaa

SEQ ID NO: 55026 - RNA, 18 nt, Artificial Sequence
  Description of Artificial Sequence: Synthetic oligonucleotide
cggccacgccacuccauc

SEQ ID NO: 55027 - RNA, 18 nt, Artificial Sequence
  Description of Artificial Sequence: Synthetic oligonucleotide
cccgccggccacgccacu

SEQ ID NO: 55028 - RNA, 18 nt, Artificial Sequence
  Description of Artificial Sequence: Synthetic oligonucleotide
ugcuacccgccggccacg

SEQ ID NO: 55029 - RNA, 18 nt, Artificial Sequence
  Description of Artificial Sequence: Synthetic oligonucleotide
uugagugcuacccgccgg

SEQ ID NO: 55030 - RNA, 18 nt, Artificial Sequence
  Description of Artificial Sequence: Synthetic oligonucleotide
uggcuuugagugcuaccc

SEQ ID NO: 55031 - RNA, 18 nt, Artificial Sequence
  Description of Artificial Sequence: Synthetic oligonucleotide
guugcuggcuuugagugc

SEQ ID NO: 55032 - RNA, 18 nt, Artificial Sequence
  Description of Artificial Sequence: Synthetic oligonucleotide
cgcccguugcuggcuuug

SEQ ID NO: 55033 - RNA, 18 nt, Artificial Sequence
  Description of Artificial Sequence: Synthetic oligonucleotide
cguagcgcccguugcugg

SEQ ID NO: 55034 - RNA, 18 nt, Artificial Sequence
  Description of Artificial Sequence: Synthetic oligonucleotide
gcacacguagcgcccguu

SEQ ID NO: 55035 - RNA, 18 nt, Artificial Sequence
  Description of Artificial Sequence: Synthetic oligonucleotide
uucaugcacacguagcgc

SEQ ID NO: 55036 - RNA, 18 nt, Artificial Sequence
  Description of Artificial Sequence: Synthetic oligonucleotide
ucuucuucaugcacacgu

SEQ ID NO: 55037 - RNA, 18 nt, Artificial Sequence
  Description of Artificial Sequence: Synthetic oligonucleotide
cccauucuucuucaugca

SEQ ID NO: 55038 - RNA, 18 nt, Artificial Sequence
  Description of Artificial Sequence: Synthetic oligonucleotide
agcugcccauucuucuuc

SEQ ID NO: 55039 - RNA, 18 nt, Artificial Sequence
  Description of Artificial Sequence: Synthetic oligonucleotide
ccgccagcugcccauucu

SEQ ID NO: 55040 - RNA, 18 nt, Artificial Sequence
  Description of Artificial Sequence: Synthetic oligonucleotide
gauagccgccagcugccc

SEQ ID NO: 55041 - RNA, 18 nt, Artificial Sequence
  Description of Artificial Sequence: Synthetic oligonucleotide
ucgcugauagccgccagc

SEQ ID NO: 55042 - RNA, 18 nt, Artificial Sequence
  Description of Artificial Sequence: Synthetic oligonucleotide
caaaaucgcugauagccg

SEQ ID NO: 55043 - RNA, 18 nt, Artificial Sequence
  Description of Artificial Sequence: Synthetic oligonucleotide
uaccuggcaggcagagug

SEQ ID NO: 55044 - RNA, 18 nt, Artificial Sequence
  Description of Artificial Sequence: Synthetic oligonucleotide
cccaguaccuggcaggca

SEQ ID NO: 55045 - RNA, 18 nt, Artificial Sequence
  Description of Artificial Sequence: Synthetic oligonucleotide
ccugccccaguaccuggc

SEQ ID NO: 55046 - RNA, 18 nt, Artificial Sequence
  Description of Artificial Sequence: Synthetic oligonucleotide
cagccccugccccaguac

SEQ ID NO: 55047 - RNA, 18 nt, Artificial Sequence
  Description of Artificial Sequence: Synthetic oligonucleotide
ggagacagccccugcccc

SEQ ID NO: 55048 - RNA, 18 nt, Artificial Sequence
  Description of Artificial Sequence: Synthetic oligonucleotide
uggguggagacagccccu

SEQ ID NO: 55049 - RNA, 18 nt, Artificial Sequence
  Description of Artificial Sequence: Synthetic oligonucleotide
uucccuggguggagacag

SEQ ID NO: 55050 - RNA, 18 nt, Artificial Sequence
  Description of Artificial Sequence: Synthetic oligonucleotide
guccuuucccugggugga

SEQ ID NO: 55051 - RNA, 18 nt, Artificial Sequence
  Description of Artificial Sequence: Synthetic oligonucleotide
ggcagguccuuucccugg

SEQ ID NO: 55052 - RNA, 18 nt, Artificial Sequence
  Description of Artificial Sequence: Synthetic oligonucleotide
gucugggcagguccuuuc

SEQ ID NO: 55053 - RNA, 18 nt, Artificial Sequence
  Description of Artificial Sequence: Synthetic oligonucleotide
gggugucugggcaggucc

SEQ ID NO: 55054 - RNA, 18 nt, Artificial Sequence
  Description of Artificial Sequence: Synthetic oligonucleotide
gcucuugguggagauggg

SEQ ID NO: 55055 - RNA, 18 nt, Artificial Sequence
  Description of Artificial Sequence: Synthetic oligonucleotide
guccagcucuugguggag

SEQ ID NO: 55056 - RNA, 18 nt, Artificial Sequence
  Description of Artificial Sequence: Synthetic oligonucleotide
ggaggguccagcucuugg

SEQ ID NO: 55057 - RNA, 18 nt, Artificial Sequence
  Description of Artificial Sequence: Synthetic oligonucleotide
gggaggguccagcucuug

SEQ ID NO: 55058 - RNA, 18 nt, Artificial Sequence
  Description of Artificial Sequence: Synthetic oligonucleotide
cccguuccgugggcuggg

SEQ ID NO: 55059 - RNA, 18 nt, Artificial Sequence
  Description of Artificial Sequence: Synthetic oligonucleotide
cagcacccguuccguggg

SEQ ID NO: 55060 - RNA, 18 nt, Artificial Sequence
  Description of Artificial Sequence: Synthetic oligonucleotide
caugacagcacccguucc

SEQ ID NO: 55061 - RNA, 18 nt, Artificial Sequence
  Description of Artificial Sequence: Synthetic oligonucleotide
gacuccaugacagcaccc

SEQ ID NO: 55062 - RNA, 18 nt, Artificial Sequence
  Description of Artificial Sequence: Synthetic oligonucleotide
aguaugacuccaugacag

SEQ ID NO: 55063 - RNA, 18 nt, Artificial Sequence
  Description of Artificial Sequence: Synthetic oligonucleotide
uagcaaguaugacuccau

SEQ ID NO: 55064 - RNA, 18 nt, Artificial Sequence
  Description of Artificial Sequence: Synthetic oligonucleotide
uugacuagcaaguaugac

SEQ ID NO: 55065 - RNA, 18 nt, Artificial Sequence
  Description of Artificial Sequence: Synthetic oligonucleotide
uuaucuugacuagcaagu

SEQ ID NO: 55066 - RNA, 18 nt, Artificial Sequence
  Description of Artificial Sequence: Synthetic oligonucleotide
acgaguuaucuugacuag

SEQ ID NO: 55067 - RNA, 18 nt, Artificial Sequence
  Description of Artificial Sequence: Synthetic oligonucleotide
ccaagacgaguuaucuug

SEQ ID NO: 55068 - RNA, 18 nt, Artificial Sequence
  Description of Artificial Sequence: Synthetic oligonucleotide
ccuugccaagacgaguua

SEQ ID NO: 55069 - RNA, 18 nt, Artificial Sequence
  Description of Artificial Sequence: Synthetic oligonucleotide
guuucccuugccaagacg

SEQ ID NO: 55070 - RNA, 18 nt, Artificial Sequence
  Description of Artificial Sequence: Synthetic oligonucleotide
gaccuguuucccuugcca

SEQ ID NO: 55071 - RNA, 18 nt, Artificial Sequence
  Description of Artificial Sequence: Synthetic oligonucleotide
auucagaccuguuucccu

SEQ ID NO: 55072 - RNA, 18 nt, Artificial Sequence
  Description of Artificial Sequence: Synthetic oligonucleotide
aggacauucagaccuguu

SEQ ID NO: 55073 - RNA, 18 nt, Artificial Sequence
  Description of Artificial Sequence: Synthetic oligonucleotide
agauaaggacauucagac

SEQ ID NO: 55074 - RNA, 18 nt, Artificial Sequence
  Description of Artificial Sequence: Synthetic oligonucleotide
agcggagauaaggacauu

SEQ ID NO: 55075 - RNA, 18 nt, Artificial Sequence
  Description of Artificial Sequence: Synthetic oligonucleotide
ccagcagcggagauaagg

SEQ ID NO: 55076 - RNA, 18 nt, Artificial Sequence
  Description of Artificial Sequence: Synthetic oligonucleotide
gguucccagcagcggaga

SEQ ID NO: 55077 - RNA, 18 nt, Artificial Sequence
  Description of Artificial Sequence: Synthetic oligonucleotide
cccuugccaagacgaguu

SEQ ID NO: 55078 - RNA, 18 nt, Artificial Sequence
  Description of Artificial Sequence: Synthetic oligonucleotide
uguuucccuugccaagac

SEQ ID NO: 55079 - RNA, 18 nt, Artificial Sequence
  Description of Artificial Sequence: Synthetic oligonucleotide
agaccuguuucccuugcc

SEQ ID NO: 55080 - RNA, 18 nt, Artificial Sequence
  Description of Artificial Sequence: Synthetic oligonucleotide
cauucagaccuguuuccc

SEQ ID NO: 55081 - RNA, 18 nt, Artificial Sequence
  Description of Artificial Sequence: Synthetic oligonucleotide
aaggacauucagaccugu

SEQ ID NO: 55082 - RNA, 18 nt, Artificial Sequence
  Description of Artificial Sequence: Synthetic oligonucleotide
gagauaaggacauucaga

SEQ ID NO: 55083 - RNA, 18 nt, Artificial Sequence
  Description of Artificial Sequence: Synthetic oligonucleotide
cagcggagauaaggacau

SEQ ID NO: 55084 - RNA, 18 nt, Artificial Sequence
  Description of Artificial Sequence: Synthetic oligonucleotide
cccagcagcggagauaag

SEQ ID NO: 55085 - RNA, 18 nt, Artificial Sequence
  Description of Artificial Sequence: Synthetic oligonucleotide
ggguucccagcagcggag

SEQ ID NO: 55086 - RNA, 18 nt, Artificial Sequence
  Description of Artificial Sequence: Synthetic oligonucleotide
uuggcaaggcgccuaggg

SEQ ID NO: 55087 - RNA, 18 nt, Artificial Sequence
  Description of Artificial Sequence: Synthetic oligonucleotide
cuuggcaaggcgccuagg

SEQ ID NO: 55088 - RNA, 18 nt, Artificial Sequence
  Description of Artificial Sequence: Synthetic oligonucleotide
gcggccuuggcaaggcgc

SEQ ID NO: 55089 - RNA, 18 nt, Artificial Sequence
  Description of Artificial Sequence: Synthetic oligonucleotide
caugugcggccuuggcaa

SEQ ID NO: 55090 - RNA, 18 nt, Artificial Sequence
  Description of Artificial Sequence: Synthetic oligonucleotide
ugccucaugugcggccuu

SEQ ID NO: 55091 - RNA, 18 nt, Artificial Sequence
  Description of Artificial Sequence: Synthetic oligonucleotide
gccauugccucaugugcg

SEQ ID NO: 55092 - RNA, 18 nt, Artificial Sequence
  Description of Artificial Sequence: Synthetic oligonucleotide
ggccugccauugccucau

SEQ ID NO: 55093 - RNA, 18 nt, Artificial Sequence
  Description of Artificial Sequence: Synthetic oligonucleotide
acccaggccugccauugc

SEQ ID NO: 55094 - RNA, 18 nt, Artificial Sequence
  Description of Artificial Sequence: Synthetic oligonucleotide
uagggacccaggccugcc

SEQ ID NO: 55095 - RNA, 18 nt, Artificial Sequence
  Description of Artificial Sequence: Synthetic oligonucleotide
ggacuuagggacccaggc

SEQ ID NO: 55096 - RNA, 18 nt, Artificial Sequence
  Description of Artificial Sequence: Synthetic oligonucleotide
caccuggacuuagggacc

SEQ ID NO: 55097 - RNA, 18 nt, Artificial Sequence
  Description of Artificial Sequence: Synthetic oligonucleotide
cgccacaccuggacuuag

SEQ ID NO: 55098 - RNA, 18 nt, Artificial Sequence
  Description of Artificial Sequence: Synthetic oligonucleotide
ggaaacgccacaccugga

SEQ ID NO: 55099 - RNA, 18 nt, Artificial Sequence
  Description of Artificial Sequence: Synthetic oligonucleotide
cccugggaaacgccacac

SEQ ID NO: 55100 - RNA, 18 nt, Artificial Sequence
  Description of Artificial Sequence: Synthetic oligonucleotide
cuguccaggccgggcggg

SEQ ID NO: 55101 - RNA, 18 nt, Artificial Sequence
  Description of Artificial Sequence: Synthetic oligonucleotide
cuucccuguccaggccgg

SEQ ID NO: 55102 - RNA, 18 nt, Artificial Sequence
  Description of Artificial Sequence: Synthetic oligonucleotide
gccaccuucccuguccag

SEQ ID NO: 55103 - RNA, 18 nt, Artificial Sequence
  Description of Artificial Sequence: Synthetic oligonucleotide
cucccgccaccuucccug

SEQ ID NO: 55104 - RNA, 18 nt, Artificial Sequence
  Description of Artificial Sequence: Synthetic oligonucleotide
ugccccucccgccaccuu

SEQ ID NO: 55105 - RNA, 18 nt, Artificial Sequence
  Description of Artificial Sequence: Synthetic oligonucleotide
ugcgcugccccucccgcc

SEQ ID NO: 55106 - RNA, 18 nt, Artificial Sequence
  Description of Artificial Sequence: Synthetic oligonucleotide
ucugcugcgcugccccuc

SEQ ID NO: 55107 - RNA, 18 nt, Artificial Sequence
  Description of Artificial Sequence: Synthetic oligonucleotide
gugaacucuucguccuug

SEQ ID NO: 55108 - RNA, 18 nt, Artificial Sequence
  Description of Artificial Sequence: Synthetic oligonucleotide
ugagggugaacucuucgu

SEQ ID NO: 55109 - RNA, 18 nt, Artificial Sequence
  Description of Artificial Sequence: Synthetic oligonucleotide
gagcuugagggugaacuc

SEQ ID NO: 55110 - RNA, 18 nt, Artificial Sequence
  Description of Artificial Sequence: Synthetic oligonucleotide
uugaugagcuugagggug

SEQ ID NO: 55111 - RNA, 18 nt, Artificial Sequence
  Description of Artificial Sequence: Synthetic oligonucleotide
gccgguugaugagcuuga

SEQ ID NO: 55112 - RNA, 18 nt, Artificial Sequence
  Description of Artificial Sequence: Synthetic oligonucleotide
gaugggccgguugaugag

SEQ ID NO: 55113 - RNA, 18 nt, Artificial Sequence
  Description of Artificial Sequence: Synthetic oligonucleotide
accaggaugggccgguug

SEQ ID NO: 55114 - RNA, 18 nt, Artificial Sequence
  Description of Artificial Sequence: Synthetic oligonucleotide
gcagcaccaggaugggcc

SEQ ID NO: 55115 - RNA, 18 nt, Artificial Sequence
  Description of Artificial Sequence: Synthetic oligonucleotide
gccgcgcagcaccaggau

SEQ ID NO: 55116 - RNA, 18 nt, Artificial Sequence
  Description of Artificial Sequence: Synthetic oligonucleotide
uccaggccgcgcagcacc

SEQ ID NO: 55117 - RNA, 18 nt, Artificial Sequence
  Description of Artificial Sequence: Synthetic oligonucleotide
agccguccaggccgcgca

SEQ ID NO: 55118 - RNA, 18 nt, Artificial Sequence
  Description of Artificial Sequence: Synthetic oligonucleotide
gacgaagccguccaggcc

SEQ ID NO: 55119 - RNA, 18 nt, Artificial Sequence
  Description of Artificial Sequence: Synthetic oligonucleotide
uggcagacgaagccgucc

SEQ ID NO: 55120 - RNA, 18 nt, Artificial Sequence
  Description of Artificial Sequence: Synthetic oligonucleotide
ggugguggcagacgaagc

SEQ ID NO: 55121 - RNA, 18 nt, Artificial Sequence
  Description of Artificial Sequence: Synthetic oligonucleotide
gccgcggugguggcagac

SEQ ID NO: 55122 - RNA, 18 nt, Artificial Sequence
  Description of Artificial Sequence: Synthetic oligonucleotide
uuggagccgcgguggugg

SEQ ID NO: 55123 - RNA, 18 nt, Artificial Sequence
  Description of Artificial Sequence: Synthetic oligonucleotide
gcugguuggagccgcggu

SEQ ID NO: 55124 - RNA, 18 nt, Artificial Sequence
  Description of Artificial Sequence: Synthetic oligonucleotide
guccagcugguuggagcc

SEQ ID NO: 55125 - RNA, 18 nt, Artificial Sequence
  Description of Artificial Sequence: Synthetic oligonucleotide
uugguguccagcugguug

SEQ ID NO: 55126 - RNA, 18 nt, Artificial Sequence
  Description of Artificial Sequence: Synthetic oligonucleotide
agcgguugguguccagcu

SEQ ID NO: 55127 - RNA, 18 nt, Artificial Sequence
  Description of Artificial Sequence: Synthetic oligonucleotide
gacggagcgguugguguc

SEQ ID NO: 55128 - RNA, 18 nt, Artificial Sequence
  Description of Artificial Sequence: Synthetic oligonucleotide
ucguagacggagcgguug

SEQ ID NO: 55129 - RNA, 18 nt, Artificial Sequence
  Description of Artificial Sequence: Synthetic oligonucleotide
agacgucguagacggagc

SEQ ID NO: 55130 - RNA, 18 nt, Artificial Sequence
  Description of Artificial Sequence: Synthetic oligonucleotide
guggaagacgucguagac

SEQ ID NO: 55131 - RNA, 18 nt, Artificial Sequence
  Description of Artificial Sequence: Synthetic oligonucleotide
cucagguggaagacgucg

SEQ ID NO: 55132 - RNA, 18 nt, Artificial Sequence
  Description of Artificial Sequence: Synthetic oligonucleotide
ugaagcucagguggaaga

SEQ ID NO: 55133 - RNA, 18 nt, Artificial Sequence
  Description of Artificial Sequence: Synthetic oligonucleotide
gucgcugaagcucaggug

SEQ ID NO: 55134 - RNA, 18 nt, Artificial Sequence
  Description of Artificial Sequence: Synthetic oligonucleotide
gcgccgucgcugaagcuc

SEQ ID NO: 55135 - RNA, 18 nt, Artificial Sequence
  Description of Artificial Sequence: Synthetic oligonucleotide
gguaggcgccgucgcuga

SEQ ID NO: 55136 - RNA, 18 nt, Artificial Sequence
  Description of Artificial Sequence: Synthetic oligonucleotide
gauccgguaggcgccguc

SEQ ID NO: 55137 - RNA, 18 nt, Artificial Sequence
  Description of Artificial Sequence: Synthetic oligonucleotide
cgucacgaacccccugcc

SEQ ID NO: 55138 - RNA, 18 nt, Artificial Sequence
  Description of Artificial Sequence: Synthetic oligonucleotide
gccggcgucacgaacccc

SEQ ID NO: 55139 - RNA, 18 nt, Artificial Sequence
  Description of Artificial Sequence: Synthetic oligonucleotide
acccagccggcgucacga

SEQ ID NO: 55140 - RNA, 18 nt, Artificial Sequence
  Description of Artificial Sequence: Synthetic oligonucleotide
cccagacccagccggcgu

SEQ ID NO: 55141 - RNA, 18 nt, Artificial Sequence
  Description of Artificial Sequence: Synthetic oligonucleotide
cagcccccagacccagcc

SEQ ID NO: 55142 - RNA, 18 nt, Artificial Sequence
  Description of Artificial Sequence: Synthetic oligonucleotide
gcccacagcccccagacc

SEQ ID NO: 55143 - RNA, 18 nt, Artificial Sequence
  Description of Artificial Sequence: Synthetic oligonucleotide
ggcuggcccacagccccc

SEQ ID NO: 55144 - RNA, 18 nt, Artificial Sequence
  Description of Artificial Sequence: Synthetic oligonucleotide
ggcucggcuggcccacag

SEQ ID NO: 55145 - RNA, 18 nt, Artificial Sequence
  Description of Artificial Sequence: Synthetic oligonucleotide
gggucggcucggcuggcc

SEQ ID NO: 55146 - RNA, 18 nt, Artificial Sequence
  Description of Artificial Sequence: Synthetic oligonucleotide
agcccgggucggcucggc

SEQ ID NO: 55147 - RNA, 18 nt, Artificial Sequence
  Description of Artificial Sequence: Synthetic oligonucleotide
ccagaagcccgggucggc

SEQ ID NO: 55148 - RNA, 18 nt, Artificial Sequence
  Description of Artificial Sequence: Synthetic oligonucleotide
gucccccagaagcccggg

SEQ ID NO: 55149 - RNA, 18 nt, Artificial Sequence
  Description of Artificial Sequence: Synthetic oligonucleotide
ccgcggucccccagaagc

SEQ ID NO: 55150 - RNA, 18 nt, Artificial Sequence
  Description of Artificial Sequence: Synthetic oligonucleotide
ggcccccgcgguccccca

SEQ ID NO: 55151 - RNA, 18 nt, Artificial Sequence
  Description of Artificial Sequence: Synthetic oligonucleotide
cucacggcccccgcgguc

SEQ ID NO: 55152 - RNA, 18 nt, Artificial Sequence
  Description of Artificial Sequence: Synthetic oligonucleotide
gagugcucacggcccccg

SEQ ID NO: 55153 - RNA, 18 nt, Artificial Sequence
  Description of Artificial Sequence: Synthetic oligonucleotide
ccucugagugcucacggc

SEQ ID NO: 55154 - RNA, 18 nt, Artificial Sequence
  Description of Artificial Sequence: Synthetic oligonucleotide
ugcgcccucugagugcuc

SEQ ID NO: 55155 - RNA, 18 nt, Artificial Sequence
  Description of Artificial Sequence: Synthetic oligonucleotide
ugggaugcgcccucugag

SEQ ID NO: 55156 - RNA, 18 nt, Artificial Sequence
  Description of Artificial Sequence: Synthetic oligonucleotide
gggccugggaugcgcccu

SEQ ID NO: 55157 - RNA, 18 nt, Artificial Sequence
  Description of Artificial Sequence: Synthetic oligonucleotide
ggccggguccccggaggg

SEQ ID NO: 55158 - RNA, 18 nt, Artificial Sequence
  Description of Artificial Sequence: Synthetic oligonucleotide
gcuggccggguccccgga

SEQ ID NO: 55159 - RNA, 18 nt, Artificial Sequence
  Description of Artificial Sequence: Synthetic oligonucleotide
uucaggcuggccgggucc

SEQ ID NO: 55160 - RNA, 18 nt, Artificial Sequence
  Description of Artificial Sequence: Synthetic oligonucleotide
gcaucuucaggcuggccg

SEQ ID NO: 55161 - RNA, 18 nt, Artificial Sequence
  Description of Artificial Sequence: Synthetic oligonucleotide
cgucggcaucuucaggcu

SEQ ID NO: 55162 - RNA, 18 nt, Artificial Sequence
  Description of Artificial Sequence: Synthetic oligonucleotide
ccguucgucggcaucuuc

SEQ ID NO: 55163 - RNA, 18 nt, Artificial Sequence
  Description of Artificial Sequence: Synthetic oligonucleotide
gcaggccguucgucggca

SEQ ID NO: 55164 - RNA, 18 nt, Artificial Sequence
  Description of Artificial Sequence: Synthetic oligonucleotide
cuggugcaggccguucgu

SEQ ID NO: 55165 - RNA, 18 nt, Artificial Sequence
  Description of Artificial Sequence: Synthetic oligonucleotide
agcaccuggugcaggccg

SEQ ID NO: 55166 - RNA, 18 nt, Artificial Sequence
  Description of Artificial Sequence: Synthetic oligonucleotide
ucuucagcaccuggugca

SEQ ID NO: 55167 - RNA, 18 nt, Artificial Sequence
  Description of Artificial Sequence: Synthetic oligonucleotide
cuggaucuucagcaccug

SEQ ID NO: 55168 - RNA, 18 nt, Artificial Sequence
  Description of Artificial Sequence: Synthetic oligonucleotide
ccaaacuggaucuucagc

SEQ ID NO: 55169 - RNA, 18 nt, Artificial Sequence
  Description of Artificial Sequence: Synthetic oligonucleotide
cgaggccaaacuggaucu

SEQ ID NO: 55170 - RNA, 18 nt, Artificial Sequence
  Description of Artificial Sequence: Synthetic oligonucleotide
guugacgaggccaaacug

SEQ ID NO: 55171 - RNA, 18 nt, Artificial Sequence
  Description of Artificial Sequence: Synthetic oligonucleotide
gugucguugacgaggcca

SEQ ID NO: 55172 - RNA, 18 nt, Artificial Sequence
  Description of Artificial Sequence: Synthetic oligonucleotide
ggucagugucguugacga

SEQ ID NO: 55173 - RNA, 18 nt, Artificial Sequence
  Description of Artificial Sequence: Synthetic oligonucleotide
guagcggucagugucguu

SEQ ID NO: 55174 - RNA, 18 nt, Artificial Sequence
  Description of Artificial Sequence: Synthetic oligonucleotide
gucagguagcggucagug

SEQ ID NO: 55175 - RNA, 18 nt, Artificial Sequence
  Description of Artificial Sequence: Synthetic oligonucleotide
cagcugucagguagcggu

SEQ ID NO: 55176 - RNA, 18 nt, Artificial Sequence
  Description of Artificial Sequence: Synthetic oligonucleotide
gcucucagcugucaggua

SEQ ID NO: 55177 - RNA, 18 nt, Artificial Sequence
  Description of Artificial Sequence: Synthetic oligonucleotide
ccgaagcucucagcuguc

SEQ ID NO: 55178 - RNA, 18 nt, Artificial Sequence
  Description of Artificial Sequence: Synthetic oligonucleotide
ugaagccgaagcucucag

SEQ ID NO: 55179 - RNA, 18 nt, Artificial Sequence
  Description of Artificial Sequence: Synthetic oligonucleotide
gaccuugaagccgaagcu

SEQ ID NO: 55180 - RNA, 18 nt, Artificial Sequence
  Description of Artificial Sequence: Synthetic oligonucleotide
gcauugaccuugaagccg

SEQ ID NO: 55181 - RNA, 18 nt, Artificial Sequence
  Description of Artificial Sequence: Synthetic oligonucleotide
ccgaggcauugaccuuga

SEQ ID NO: 55182 - RNA, 18 nt, Artificial Sequence
  Description of Artificial Sequence: Synthetic oligonucleotide
gggugccgaggcauugac

SEQ ID NO: 55183 - RNA, 18 nt, Artificial Sequence
  Description of Artificial Sequence: Synthetic oligonucleotide
aggcugggugccgaggca

SEQ ID NO: 55184 - RNA, 18 nt, Artificial Sequence
  Description of Artificial Sequence: Synthetic oligonucleotide
ucuugaggcugggugccg

SEQ ID NO: 55185 - RNA, 18 nt, Artificial Sequence
  Description of Artificial Sequence: Synthetic oligonucleotide
cuuccucuugaggcuggg

SEQ ID NO: 55186 - RNA, 18 nt, Artificial Sequence
  Description of Artificial Sequence: Synthetic oligonucleotide
gucugcuuccucuugagg

SEQ ID NO: 55187 - RNA, 18 nt, Artificial Sequence
  Description of Artificial Sequence: Synthetic oligonucleotide
cccaggucugcuuccucu

SEQ ID NO: 55188 - RNA, 18 nt, Artificial Sequence
  Description of Artificial Sequence: Synthetic oligonucleotide
cagcacccaggucugcuu

SEQ ID NO: 55189 - RNA, 18 nt, Artificial Sequence
  Description of Artificial Sequence: Synthetic oligonucleotide
gguuccagcacccagguc

SEQ ID NO: 55190 - RNA, 18 nt, Artificial Sequence
  Description of Artificial Sequence: Synthetic oligonucleotide
ggucggguuccagcaccc

SEQ ID NO: 55191 - RNA, 18 nt, Artificial Sequence
  Description of Artificial Sequence: Synthetic oligonucleotide
uccugggucggguuccag

SEQ ID NO: 55192 - RNA, 18 nt, Artificial Sequence
  Description of Artificial Sequence: Synthetic oligonucleotide
ccuuguccugggucgggu

SEQ ID NO: 55193 - RNA, 18 nt, Artificial Sequence
  Description of Artificial Sequence: Synthetic oligonucleotide
ccgugccuuguccugggu

SEQ ID NO: 55194 - RNA, 18 nt, Artificial Sequence
  Description of Artificial Sequence: Synthetic oligonucleotide
cacagccgugccuugucc

SEQ ID NO: 55195 - RNA, 18 nt, Artificial Sequence
  Description of Artificial Sequence: Synthetic oligonucleotide
agcagcacagccgugccu

SEQ ID NO: 55196 - RNA, 18 nt, Artificial Sequence
  Description of Artificial Sequence: Synthetic oligonucleotide
ugcggagcagcacagccg

SEQ ID NO: 55197 - RNA, 18 nt, Artificial Sequence
  Description of Artificial Sequence: Synthetic oligonucleotide
gcugcugcggagcagcac

SEQ ID NO: 55198 - RNA, 18 nt, Artificial Sequence
  Description of Artificial Sequence: Synthetic oligonucleotide
agguggcugcugcggagc

SEQ ID NO: 55199 - RNA, 18 nt, Artificial Sequence
  Description of Artificial Sequence: Synthetic oligonucleotide
ggcccagguggcugcugc

SEQ ID NO: 55200 - RNA, 18 nt, Artificial Sequence
  Description of Artificial Sequence: Synthetic oligonucleotide
guagcggcccagguggcu

SEQ ID NO: 55201 - RNA, 18 nt, Artificial Sequence
  Description of Artificial Sequence: Synthetic oligonucleotide
gacagguagcggcccagg

SEQ ID NO: 55202 - RNA, 18 nt, Artificial Sequence
  Description of Artificial Sequence: Synthetic oligonucleotide
cugccgacagguagcggc

SEQ ID NO: 55203 - RNA, 18 nt, Artificial Sequence
  Description of Artificial Sequence: Synthetic oligonucleotide
cucuucugccgacaggua

SEQ ID NO: 55204 - RNA, 18 nt, Artificial Sequence
  Description of Artificial Sequence: Synthetic oligonucleotide
ccguccucuucugccgac

SEQ ID NO: 55205 - RNA, 18 nt, Artificial Sequence
  Description of Artificial Sequence: Synthetic oligonucleotide
cgcgcccguccucuucug

SEQ ID NO: 55206 - RNA, 18 nt, Artificial Sequence
  Description of Artificial Sequence: Synthetic oligonucleotide
ggccacgcgcccguccuc

SEQ ID NO: 55207 - RNA, 18 nt, Artificial Sequence
  Description of Artificial Sequence: Synthetic oligonucleotide
ucacaggccacgcgcccg

SEQ ID NO: 55208 - RNA, 18 nt, Artificial Sequence
  Description of Artificial Sequence: Synthetic oligonucleotide
cugccucacaggccacgc

SEQ ID NO: 55209 - RNA, 18 nt, Artificial Sequence
  Description of Artificial Sequence: Synthetic oligonucleotide
cugcucugccucacaggc

SEQ ID NO: 55210 - RNA, 18 nt, Artificial Sequence
  Description of Artificial Sequence: Synthetic oligonucleotide
cccggcugcucugccuca

SEQ ID NO: 55211 - RNA, 18 nt, Artificial Sequence
  Description of Artificial Sequence: Synthetic oligonucleotide
cacggcccggcugcucug

SEQ ID NO: 55212 - RNA, 18 nt, Artificial Sequence
  Description of Artificial Sequence: Synthetic oligonucleotide
gcagucacggcccggcug

SEQ ID NO: 55213 - RNA, 18 nt, Artificial Sequence
  Description of Artificial Sequence: Synthetic oligonucleotide
aagcggcagucacggccc

SEQ ID NO: 55214 - RNA, 18 nt, Artificial Sequence
  Description of Artificial Sequence: Synthetic oligonucleotide
ccaggaagcggcagucac

SEQ ID NO: 55215 - RNA, 18 nt, Artificial Sequence
  Description of Artificial Sequence: Synthetic oligonucleotide
caggaccaggaagcggca

SEQ ID NO: 55216 - RNA, 18 nt, Artificial Sequence
  Description of Artificial Sequence: Synthetic oligonucleotide
ugcggcaggaccaggaag

SEQ ID NO: 55217 - RNA, 18 nt, Artificial Sequence
  Description of Artificial Sequence: Synthetic oligonucleotide
cuggcugcggcaggacca

SEQ ID NO: 55218 - RNA, 18 nt, Artificial Sequence
  Description of Artificial Sequence: Synthetic oligonucleotide
cccaucuggcugcggcag

SEQ ID NO: 55219 - RNA, 18 nt, Artificial Sequence
  Description of Artificial Sequence: Synthetic oligonucleotide
cagcgcccaucuggcugc

SEQ ID NO: 55220 - RNA, 18 nt, Artificial Sequence
  Description of Artificial Sequence: Synthetic oligonucleotide
gcacccagcgcccaucug

SEQ ID NO: 55221 - RNA, 18 nt, Artificial Sequence
  Description of Artificial Sequence: Synthetic oligonucleotide
ccgcagcacccagcgccc

SEQ ID NO: 55222 - RNA, 18 nt, Artificial Sequence
  Description of Artificial Sequence: Synthetic oligonucleotide
ucggaccgcagcacccag

SEQ ID NO: 55223 - RNA, 18 nt, Artificial Sequence
  Description of Artificial Sequence: Synthetic oligonucleotide
gcggcucggaccgcagca

SEQ ID NO: 55224 - RNA, 18 nt, Artificial Sequence
  Description of Artificial Sequence: Synthetic oligonucleotide
gccgugcggcucggaccg

SEQ ID NO: 55225 - RNA, 18 nt, Artificial Sequence
  Description of Artificial Sequence: Synthetic oligonucleotide
aagcggccgugcggcucg

SEQ ID NO: 55226 - RNA, 18 nt, Artificial Sequence
  Description of Artificial Sequence: Synthetic oligonucleotide
cgaagaagcggccgugcg

SEQ ID NO: 55227 - RNA, 18 nt, Artificial Sequence
  Description of Artificial Sequence: Synthetic oligonucleotide
gccuccgaagaagcggcc

SEQ ID NO: 55228 - RNA, 18 nt, Artificial Sequence
  Description of Artificial Sequence: Synthetic oligonucleotide
ucggugccuccgaagaag

SEQ ID NO: 55229 - RNA, 18 nt, Artificial Sequence
  Description of Artificial Sequence: Synthetic oligonucleotide
gguccucggugccuccga

SEQ ID NO: 55230 - RNA, 18 nt, Artificial Sequence
  Description of Artificial Sequence: Synthetic oligonucleotide
cagcugguccucggugcc

SEQ ID NO: 55231 - RNA, 18 nt, Artificial Sequence
  Description of Artificial Sequence: Synthetic oligonucleotide
caggacagcugguccucg

SEQ ID NO: 55232 - RNA, 18 nt, Artificial Sequence
  Description of Artificial Sequence: Synthetic oligonucleotide
cgaagcaggacagcuggu

SEQ ID NO: 55233 - RNA, 18 nt, Artificial Sequence
  Description of Artificial Sequence: Synthetic oligonucleotide
uguggcgaagcaggacag

SEQ ID NO: 55234 - RNA, 18 nt, Artificial Sequence
  Description of Artificial Sequence: Synthetic oligonucleotide
acggcuguggcgaagcag

SEQ ID NO: 55235 - RNA, 18 nt, Artificial Sequence
  Description of Artificial Sequence: Synthetic oligonucleotide
gggaaacggcuguggcga

SEQ ID NO: 55236 - RNA, 18 nt, Artificial Sequence
  Description of Artificial Sequence: Synthetic oligonucleotide
guccacagcucggccggg

SEQ ID NO: 55237 - RNA, 18 nt, Artificial Sequence
  Description of Artificial Sequence: Synthetic oligonucleotide
acgguccacagcucggcc

SEQ ID NO: 55238 - RNA, 18 nt, Artificial Sequence
  Description of Artificial Sequence: Synthetic oligonucleotide
ggugcacgguccacagcu

SEQ ID NO: 55239 - RNA, 18 nt, Artificial Sequence
  Description of Artificial Sequence: Synthetic oligonucleotide
ggccaggugcacggucca

SEQ ID NO: 55240 - RNA, 18 nt, Artificial Sequence
  Description of Artificial Sequence: Synthetic oligonucleotide
uggauggccaggugcacg

SEQ ID NO: 55241 - RNA, 18 nt, Artificial Sequence
  Description of Artificial Sequence: Synthetic oligonucleotide
gcggguggauggccaggu

SEQ ID NO: 55242 - RNA, 18 nt, Artificial Sequence
  Description of Artificial Sequence: Synthetic oligonucleotide
ggccugcggguggauggc

SEQ ID NO: 55243 - RNA, 18 nt, Artificial Sequence
  Description of Artificial Sequence: Synthetic oligonucleotide
aggugggccugcgggugg

SEQ ID NO: 55244 - RNA, 18 nt, Artificial Sequence
  Description of Artificial Sequence: Synthetic oligonucleotide
ucagcaggugggccugcg

SEQ ID NO: 55245 - RNA, 18 nt, Artificial Sequence
  Description of Artificial Sequence: Synthetic oligonucleotide
cacgcucagcaggugggc

SEQ ID NO: 55246 - RNA, 18 nt, Artificial Sequence
  Description of Artificial Sequence: Synthetic oligonucleotide
cggcucacgcucagcagg

SEQ ID NO: 55247 - RNA, 18 nt, Artificial Sequence
  Description of Artificial Sequence: Synthetic oligonucleotide
gccgccggcucacgcuca

SEQ ID NO: 55248 - RNA, 18 nt, Artificial Sequence
  Description of Artificial Sequence: Synthetic oligonucleotide
guagcgccgccggcucac

SEQ ID NO: 55249 - RNA, 18 nt, Artificial Sequence
  Description of Artificial Sequence: Synthetic oligonucleotide
ugcacguagcgccgccgg

SEQ ID NO: 55250 - RNA, 18 nt, Artificial Sequence
  Description of Artificial Sequence: Synthetic oligonucleotide
acaggugcacguagcgcc

SEQ ID NO: 55251 - RNA, 18 nt, Artificial Sequence
  Description of Artificial Sequence: Synthetic oligonucleotide
cgggcacaggugcacgua

SEQ ID NO: 55252 - RNA, 18 nt, Artificial Sequence
  Description of Artificial Sequence: Synthetic oligonucleotide
ucccgcgggcacaggugc

SEQ ID NO: 55253 - RNA, 18 nt, Artificial Sequence
  Description of Artificial Sequence: Synthetic oligonucleotide
cguccucccgcgggcaca

SEQ ID NO: 55254 - RNA, 18 nt, Artificial Sequence
  Description of Artificial Sequence: Synthetic oligonucleotide
caucucguccucccgcgg

SEQ ID NO: 55255 - RNA, 18 nt, Artificial Sequence
  Description of Artificial Sequence: Synthetic oligonucleotide
gcggccaucucguccucc

SEQ ID NO: 55256 - RNA, 18 nt, Artificial Sequence
  Description of Artificial Sequence: Synthetic oligonucleotide
cgucugcggccaucucgu

SEQ ID NO: 55257 - RNA, 18 nt, Artificial Sequence
  Description of Artificial Sequence: Synthetic oligonucleotide
gucuccgucugcggccau

SEQ ID NO: 55258 - RNA, 18 nt, Artificial Sequence
  Description of Artificial Sequence: Synthetic oligonucleotide
ggcuugucuccgucugcg

SEQ ID NO: 55259 - RNA, 18 nt, Artificial Sequence
  Description of Artificial Sequence: Synthetic oligonucleotide
cccagggcuugucuccgu

SEQ ID NO: 55260 - RNA, 18 nt, Artificial Sequence
  Description of Artificial Sequence: Synthetic oligonucleotide
cacgccccagggcuuguc

SEQ ID NO: 55261 - RNA, 18 nt, Artificial Sequence
  Description of Artificial Sequence: Synthetic oligonucleotide
gcguccacgccccagggc

SEQ ID NO: 55262 - RNA, 18 nt, Artificial Sequence
  Description of Artificial Sequence: Synthetic oligonucleotide
ggagggcguccacgcccc

SEQ ID NO: 55263 - RNA, 18 nt, Artificial Sequence
  Description of Artificial Sequence: Synthetic oligonucleotide
ggugaggagggcguccac

SEQ ID NO: 55264 - RNA, 18 nt, Artificial Sequence
  Description of Artificial Sequence: Synthetic oligonucleotide
augagggugaggagggcg

SEQ ID NO: 55265 - RNA, 18 nt, Artificial Sequence
  Description of Artificial Sequence: Synthetic oligonucleotide
ggaagaugagggugagga

SEQ ID NO: 55266 - RNA, 18 nt, Artificial Sequence
  Description of Artificial Sequence: Synthetic oligonucleotide
gcuccggaagaugagggu

SEQ ID NO: 55267 - RNA, 18 nt, Artificial Sequence
  Description of Artificial Sequence: Synthetic oligonucleotide
cgucggcuccggaagaug

SEQ ID NO: 55268 - RNA, 18 nt, Artificial Sequence
  Description of Artificial Sequence: Synthetic oligonucleotide
aguaccgucggcuccgga

SEQ ID NO: 55269 - RNA, 18 nt, Artificial Sequence
  Description of Artificial Sequence: Synthetic oligonucleotide
gaggcaguaccgucggcu

SEQ ID NO: 55270 - RNA, 18 nt, Artificial Sequence
  Description of Artificial Sequence: Synthetic oligonucleotide
gacuugaggcaguaccgu

SEQ ID NO: 55271 - RNA, 18 nt, Artificial Sequence
  Description of Artificial Sequence: Synthetic oligonucleotide
cacaggacuugaggcagu

SEQ ID NO: 55272 - RNA, 18 nt, Artificial Sequence
  Description of Artificial Sequence: Synthetic oligonucleotide
gcugucacaggacuugag

SEQ ID NO: 55273 - RNA, 18 nt, Artificial Sequence
  Description of Artificial Sequence: Synthetic oligonucleotide
uagcggcugucacaggac

SEQ ID NO: 55274 - RNA, 18 nt, Artificial Sequence
  Description of Artificial Sequence: Synthetic oligonucleotide
gcagguagcggcugucac

SEQ ID NO: 55275 - RNA, 18 nt, Artificial Sequence
  Description of Artificial Sequence: Synthetic oligonucleotide
gcugcgcagguagcggcu

SEQ ID NO: 55276 - RNA, 18 nt, Artificial Sequence
  Description of Artificial Sequence: Synthetic oligonucleotide
ccgucgcugcgcagguag

SEQ ID NO: 55277 - RNA, 18 nt, Artificial Sequence
  Description of Artificial Sequence: Synthetic oligonucleotide
gacggccgucgcugcgca

SEQ ID NO: 55278 - RNA, 18 nt, Artificial Sequence
  Description of Artificial Sequence: Synthetic oligonucleotide
gaccagacggccgucgcu

SEQ ID NO: 55279 - RNA, 18 nt, Artificial Sequence
  Description of Artificial Sequence: Synthetic oligonucleotide
ucccagaccagacggccg

SEQ ID NO: 55280 - RNA, 18 nt, Artificial Sequence
  Description of Artificial Sequence: Synthetic oligonucleotide
caggcucccagaccagac

SEQ ID NO: 55281 - RNA, 18 nt, Artificial Sequence
  Description of Artificial Sequence: Synthetic oligonucleotide
gggcucaggcucccagac

SEQ ID NO: 55282 - RNA, 18 nt, Artificial Sequence
  Description of Artificial Sequence: Synthetic oligonucleotide
gcguguagcaggcacggg

SEQ ID NO: 55283 - RNA, 18 nt, Artificial Sequence
  Description of Artificial Sequence: Synthetic oligonucleotide
uccagcguguagcaggca

SEQ ID NO: 55284 - RNA, 18 nt, Artificial Sequence
  Description of Artificial Sequence: Synthetic oligonucleotide
ugaacuccagcguguagc

SEQ ID NO: 55285 - RNA, 18 nt, Artificial Sequence
  Description of Artificial Sequence: Synthetic oligonucleotide
cgccuugaacuccagcgu

SEQ ID NO: 55286 - RNA, 18 nt, Artificial Sequence
  Description of Artificial Sequence: Synthetic oligonucleotide
uugcccgccuugaacucc

SEQ ID NO: 55287 - RNA, 18 nt, Artificial Sequence
  Description of Artificial Sequence: Synthetic oligonucleotide
ccagcuugcccgccuuga

SEQ ID NO: 55288 - RNA, 18 nt, Artificial Sequence
  Description of Artificial Sequence: Synthetic oligonucleotide
gaaggccagcuugcccgc

SEQ ID NO: 55289 - RNA, 18 nt, Artificial Sequence
  Description of Artificial Sequence: Synthetic oligonucleotide
uccuugaaggccagcuug

SEQ ID NO: 55290 - RNA, 18 nt, Artificial Sequence
  Description of Artificial Sequence: Synthetic oligonucleotide
cgcaguccuugaaggcca

SEQ ID NO: 55291 - RNA, 18 nt, Artificial Sequence
  Description of Artificial Sequence: Synthetic oligonucleotide
gccgucgcaguccuugaa

SEQ ID NO: 55292 - RNA, 18 nt, Artificial Sequence
  Description of Artificial Sequence: Synthetic oligonucleotide
uaguggccgucgcagucc

SEQ ID NO: 55293 - RNA, 18 nt, Artificial Sequence
  Description of Artificial Sequence: Synthetic oligonucleotide
ccagguaguggccgucgc

SEQ ID NO: 55294 - RNA, 18 nt, Artificial Sequence
  Description of Artificial Sequence: Synthetic oligonucleotide
gggugccagguaguggcc

SEQ ID NO: 55295 - RNA, 18 nt, Artificial Sequence
  Description of Artificial Sequence: Synthetic oligonucleotide
cccacgggugccagguag

SEQ ID NO: 55296 - RNA, 18 nt, Artificial Sequence
  Description of Artificial Sequence: Synthetic oligonucleotide
cgggccccacgggugcca

SEQ ID NO: 55297 - RNA, 18 nt, Artificial Sequence
  Description of Artificial Sequence: Synthetic oligonucleotide
gccugcgggccccacggg

SEQ ID NO: 55298 - RNA, 18 nt, Artificial Sequence
  Description of Artificial Sequence: Synthetic oligonucleotide
agggugccugcgggcccc

SEQ ID NO: 55299 - RNA, 18 nt, Artificial Sequence
  Description of Artificial Sequence: Synthetic oligonucleotide
ccuugagggugccugcgg

SEQ ID NO: 55300 - RNA, 18 nt, Artificial Sequence
  Description of Artificial Sequence: Synthetic oligonucleotide
gccggccuugagggugcc

SEQ ID NO: 55301 - RNA, 18 nt, Artificial Sequence
  Description of Artificial Sequence: Synthetic oligonucleotide
uuucggccggccuugagg

SEQ ID NO: 55302 - RNA, 18 nt, Artificial Sequence
  Description of Artificial Sequence: Synthetic oligonucleotide
gcguguuucggccggccu

SEQ ID NO: 55303 - RNA, 18 nt, Artificial Sequence
  Description of Artificial Sequence: Synthetic oligonucleotide
aggucgcguguuucggcc

SEQ ID NO: 55304 - RNA, 18 nt, Artificial Sequence
  Description of Artificial Sequence: Synthetic oligonucleotide
uugccaggucgcguguuu

SEQ ID NO: 55305 - RNA, 18 nt, Artificial Sequence
  Description of Artificial Sequence: Synthetic oligonucleotide
cauccuugccaggucgcg

SEQ ID NO: 55306 - RNA, 18 nt, Artificial Sequence
  Description of Artificial Sequence: Synthetic oligonucleotide
gagcucauccuugccagg

SEQ ID NO: 55307 - RNA, 18 nt, Artificial Sequence
  Description of Artificial Sequence: Synthetic oligonucleotide
ucaaagagcucauccuug

SEQ ID NO: 55308 - RNA, 18 nt, Artificial Sequence
  Description of Artificial Sequence: Synthetic oligonucleotide
ccagaucaaagagcucau

SEQ ID NO: 55309 - RNA, 18 nt, Artificial Sequence
  Description of Artificial Sequence: Synthetic oligonucleotide
cuccuccagaucaaagag

SEQ ID NO: 55310 - RNA, 18 nt, Artificial Sequence
  Description of Artificial Sequence: Synthetic oligonucleotide
ugacucuccuccagauca

SEQ ID NO: 55311 - RNA, 18 nt, Artificial Sequence
  Description of Artificial Sequence: Synthetic oligonucleotide
gugggugacucuccucca

SEQ ID NO: 55312 - RNA, 18 nt, Artificial Sequence
  Description of Artificial Sequence: Synthetic oligonucleotide
caccugugggugacucuc

SEQ ID NO: 55313 - RNA, 18 nt, Artificial Sequence
  Description of Artificial Sequence: Synthetic oligonucleotide
agcaccaccuguggguga

SEQ ID NO: 55314 - RNA, 18 nt, Artificial Sequence
  Description of Artificial Sequence: Synthetic oligonucleotide
ccaccagcaccaccugug

SEQ ID NO: 55315 - RNA, 18 nt, Artificial Sequence
  Description of Artificial Sequence: Synthetic oligonucleotide
ggcagccaccagcaccac

SEQ ID NO: 55316 - RNA, 18 nt, Artificial Sequence
  Description of Artificial Sequence: Synthetic oligonucleotide
ugguuggcagccaccagc

SEQ ID NO: 55317 - RNA, 18 nt, Artificial Sequence
  Description of Artificial Sequence: Synthetic oligonucleotide
agcggugguuggcagcca

SEQ ID NO: 55318 - RNA, 18 nt, Artificial Sequence
  Description of Artificial Sequence: Synthetic oligonucleotide
gacguagcggugguuggc

SEQ ID NO: 55319 - RNA, 18 nt, Artificial Sequence
  Description of Artificial Sequence: Synthetic oligonucleotide
acagagacguagcggugg

SEQ ID NO: 55320 - RNA, 18 nt, Artificial Sequence
  Description of Artificial Sequence: Synthetic oligonucleotide
gccgcacagagacguagc

SEQ ID NO: 55321 - RNA, 18 nt, Artificial Sequence
  Description of Artificial Sequence: Synthetic oligonucleotide
gucgccaccugugcccuc

SEQ ID NO: 55322 - RNA, 18 nt, Artificial Sequence
  Description of Artificial Sequence: Synthetic oligonucleotide
aggaggucgccaccugug

SEQ ID NO: 55323 - RNA, 18 nt, Artificial Sequence
  Description of Artificial Sequence: Synthetic oligonucleotide
cccucaggaggucgccac

SEQ ID NO: 55324 - RNA, 18 nt, Artificial Sequence
  Description of Artificial Sequence: Synthetic oligonucleotide
agcaccccucaggagguc

SEQ ID NO: 55325 - RNA, 18 nt, Artificial Sequence
  Description of Artificial Sequence: Synthetic oligonucleotide
gucccagcaccccucagg

SEQ ID NO: 55326 - RNA, 18 nt, Artificial Sequence
  Description of Artificial Sequence: Synthetic oligonucleotide
gggucccagcaccccuca

SEQ ID NO: 55327 - RNA, 18 nt, Artificial Sequence
  Description of Artificial Sequence: Synthetic oligonucleotide
cuccucccugaagcaggg

SEQ ID NO: 55328 - RNA, 18 nt, Artificial Sequence
  Description of Artificial Sequence: Synthetic oligonucleotide
acggccuccucccugaag

SEQ ID NO: 55329 - RNA, 18 nt, Artificial Sequence
  Description of Artificial Sequence: Synthetic oligonucleotide
cccccacggccuccuccc

SEQ ID NO: 55330 - RNA, 18 nt, Artificial Sequence
  Description of Artificial Sequence: Synthetic oligonucleotide
ugagacccccacggccuc

SEQ ID NO: 55331 - RNA, 18 nt, Artificial Sequence
  Description of Artificial Sequence: Synthetic oligonucleotide
ccccgugagacccccacg

SEQ ID NO: 55332 - RNA, 18 nt, Artificial Sequence
  Description of Artificial Sequence: Synthetic oligonucleotide
ccacuccccgugagaccc

SEQ ID NO: 55333 - RNA, 18 nt, Artificial Sequence
  Description of Artificial Sequence: Synthetic oligonucleotide
cgauaccacuccccguga

SEQ ID NO: 55334 - RNA, 18 nt, Artificial Sequence
  Description of Artificial Sequence: Synthetic oligonucleotide
agacacgauaccacuccc

SEQ ID NO: 55335 - RNA, 18 nt, Artificial Sequence
  Description of Artificial Sequence: Synthetic oligonucleotide
cgcacagacacgauacca

SEQ ID NO: 55336 - RNA, 18 nt, Artificial Sequence
  Description of Artificial Sequence: Synthetic oligonucleotide
gugaacgcacagacacga

SEQ ID NO: 55337 - RNA, 18 nt, Artificial Sequence
  Description of Artificial Sequence: Synthetic oligonucleotide
gacaugugaacgcacaga

SEQ ID NO: 55338 - RNA, 18 nt, Artificial Sequence
  Description of Artificial Sequence: Synthetic oligonucleotide
gaacagacaugugaacgc

SEQ ID NO: 55339 - RNA, 18 nt, Artificial Sequence
  Description of Artificial Sequence: Synthetic oligonucleotide
gcccagaacagacaugug

SEQ ID NO: 55340 - RNA, 18 nt, Artificial Sequence
  Description of Artificial Sequence: Synthetic oligonucleotide
ccccagcccagaacagac

SEQ ID NO: 55341 - RNA, 18 nt, Artificial Sequence
  Description of Artificial Sequence: Synthetic oligonucleotide
uggacccccagcccagaa

SEQ ID NO: 55342 - RNA, 18 nt, Artificial Sequence
  Description of Artificial Sequence: Synthetic oligonucleotide
ccacauggacccccagcc

SEQ ID NO: 55343 - RNA, 18 nt, Artificial Sequence
  Description of Artificial Sequence: Synthetic oligonucleotide
augucccacauggacccc

SEQ ID NO: 55344 - RNA, 18 nt, Artificial Sequence
  Description of Artificial Sequence: Synthetic oligonucleotide
cacacaugucccacaugg

SEQ ID NO: 55345 - RNA, 18 nt, Artificial Sequence
  Description of Artificial Sequence: Synthetic oligonucleotide
guggccacacauguccca

SEQ ID NO: 55346 - RNA, 18 nt, Artificial Sequence
  Description of Artificial Sequence: Synthetic oligonucleotide
ccugaguggccacacaug

SEQ ID NO: 55347 - RNA, 18 nt, Artificial Sequence
  Description of Artificial Sequence: Synthetic oligonucleotide
uacacccugaguggccac

SEQ ID NO: 55348 - RNA, 18 nt, Artificial Sequence
  Description of Artificial Sequence: Synthetic oligonucleotide
ccaccuacacccugagug

SEQ ID NO: 55349 - RNA, 18 nt, Artificial Sequence
  Description of Artificial Sequence: Synthetic oligonucleotide
cccacccaccuacacccu

SEQ ID NO: 55350 - RNA, 18 nt, Artificial Sequence
  Description of Artificial Sequence: Synthetic oligonucleotide
cgaggcccacccaccuac

SEQ ID NO: 55351 - RNA, 18 nt, Artificial Sequence
  Description of Artificial Sequence: Synthetic oligonucleotide
uggcccgaggcccaccca

SEQ ID NO: 55352 - RNA, 18 nt, Artificial Sequence
  Description of Artificial Sequence: Synthetic oligonucleotide
gggcauggcccgaggccc

SEQ ID NO: 55353 - RNA, 18 nt, Artificial Sequence
  Description of Artificial Sequence: Synthetic oligonucleotide
cgccugggcauggcccga

SEQ ID NO: 55354 - RNA, 18 nt, Artificial Sequence
  Description of Artificial Sequence: Synthetic oligonucleotide
gggucgccugggcauggc

SEQ ID NO: 55355 - RNA, 18 nt, Artificial Sequence
  Description of Artificial Sequence: Synthetic oligonucleotide
ccaccaccccucaguggg

SEQ ID NO: 55356 - RNA, 18 nt, Artificial Sequence
  Description of Artificial Sequence: Synthetic oligonucleotide
ugaagccaccaccccuca

SEQ ID NO: 55357 - RNA, 18 nt, Artificial Sequence
  Description of Artificial Sequence: Synthetic oligonucleotide
gacccugaagccaccacc

SEQ ID NO: 55358 - RNA, 18 nt, Artificial Sequence
  Description of Artificial Sequence: Synthetic oligonucleotide
ccucugacccugaagcca

SEQ ID NO: 55359 - RNA, 18 nt, Artificial Sequence
  Description of Artificial Sequence: Synthetic oligonucleotide
ccuugccucugacccuga

SEQ ID NO: 55360 - RNA, 18 nt, Artificial Sequence
  Description of Artificial Sequence: Synthetic oligonucleotide
ggaacccuugccucugac

SEQ ID NO: 55361 - RNA, 18 nt, Artificial Sequence
  Description of Artificial Sequence: Synthetic oligonucleotide
ggccaggaacccuugccu

SEQ ID NO: 55362 - RNA, 18 nt, Artificial Sequence
  Description of Artificial Sequence: Synthetic oligonucleotide
agaaaggccaggaacccu

SEQ ID NO: 55363 - RNA, 18 nt, Artificial Sequence
  Description of Artificial Sequence: Synthetic oligonucleotide
ugcugagaaaggccagga

SEQ ID NO: 55364 - RNA, 18 nt, Artificial Sequence
  Description of Artificial Sequence: Synthetic oligonucleotide
agcuaugcugagaaaggc

SEQ ID NO: 55365 - RNA, 18 nt, Artificial Sequence
  Description of Artificial Sequence: Synthetic oligonucleotide
ucuccagcuaugcugaga

SEQ ID NO: 55366 - RNA, 18 nt, Artificial Sequence
  Description of Artificial Sequence: Synthetic oligonucleotide
gacauucuccagcuaugc

SEQ ID NO: 55367 - RNA, 18 nt, Artificial Sequence
  Description of Artificial Sequence: Synthetic oligonucleotide
gcugagacauucuccagc

SEQ ID NO: 55368 - RNA, 18 nt, Artificial Sequence
  Description of Artificial Sequence: Synthetic oligonucleotide
gcuuggcugagacauucu

SEQ ID NO: 55369 - RNA, 18 nt, Artificial Sequence
  Description of Artificial Sequence: Synthetic oligonucleotide
ccagggcuuggcugagac

SEQ ID NO: 55370 - RNA, 18 nt, Artificial Sequence
  Description of Artificial Sequence: Synthetic oligonucleotide
gcugcccagggcuuggcu

SEQ ID NO: 55371 - RNA, 18 nt, Artificial Sequence
  Description of Artificial Sequence: Synthetic oligonucleotide
ccgcagcugcccagggcu

SEQ ID NO: 55372 - RNA, 18 nt, Artificial Sequence
  Description of Artificial Sequence: Synthetic oligonucleotide
agacuccgcagcugccca

SEQ ID NO: 55373 - RNA, 18 nt, Artificial Sequence
  Description of Artificial Sequence: Synthetic oligonucleotide
gucucagacuccgcagcu

SEQ ID NO: 55374 - RNA, 18 nt, Artificial Sequence
  Description of Artificial Sequence: Synthetic oligonucleotide
cuccagucucagacuccg

SEQ ID NO: 55375 - RNA, 18 nt, Artificial Sequence
  Description of Artificial Sequence: Synthetic oligonucleotide
caccucuccagucucaga

SEQ ID NO: 55376 - RNA, 18 nt, Artificial Sequence
  Description of Artificial Sequence: Synthetic oligonucleotide
gcccacaccucuccaguc

SEQ ID NO: 55377 - RNA, 18 nt, Artificial Sequence
  Description of Artificial Sequence: Synthetic oligonucleotide
gccuggcccacaccucuc

SEQ ID NO: 55378 - RNA, 18 nt, Artificial Sequence
  Description of Artificial Sequence: Synthetic oligonucleotide
ccaucgccuggcccacac

SEQ ID NO: 55379 - RNA, 18 nt, Artificial Sequence
  Description of Artificial Sequence: Synthetic oligonucleotide
acugcccaucgccuggcc

SEQ ID NO: 55380 - RNA, 18 nt, Artificial Sequence
  Description of Artificial Sequence: Synthetic oligonucleotide
ugggcacugcccaucgcc

SEQ ID NO: 55381 - RNA, 18 nt, Artificial Sequence
  Description of Artificial Sequence: Synthetic oligonucleotide
ccugcugggcacugccca

SEQ ID NO: 55382 - RNA, 18 nt, Artificial Sequence
  Description of Artificial Sequence: Synthetic oligonucleotide
cugccccugcugggcacu

SEQ ID NO: 55383 - RNA, 18 nt, Artificial Sequence
  Description of Artificial Sequence: Synthetic oligonucleotide
gccuccugccccugcugg

SEQ ID NO: 55384 - RNA, 18 nt, Artificial Sequence
  Description of Artificial Sequence: Synthetic oligonucleotide
ugugggccuccugccccu

SEQ ID NO: 55385 - RNA, 18 nt, Artificial Sequence
  Description of Artificial Sequence: Synthetic oligonucleotide
caggcugugggccuccug

SEQ ID NO: 55386 - RNA, 18 nt, Artificial Sequence
  Description of Artificial Sequence: Synthetic oligonucleotide
caggccaggcugugggcc

SEQ ID NO: 55387 - RNA, 18 nt, Artificial Sequence
  Description of Artificial Sequence: Synthetic oligonucleotide
ggcaccaggccaggcugu

SEQ ID NO: 55388 - RNA, 18 nt, Artificial Sequence
  Description of Artificial Sequence: Synthetic oligonucleotide
cucauggcaccaggccag

SEQ ID NO: 55389 - RNA, 18 nt, Artificial Sequence
  Description of Artificial Sequence: Synthetic oligonucleotide
ugccccucauggcaccag

SEQ ID NO: 55390 - RNA, 18 nt, Artificial Sequence
  Description of Artificial Sequence: Synthetic oligonucleotide
ccacaugccccucauggc

SEQ ID NO: 55391 - RNA, 18 nt, Artificial Sequence
  Description of Artificial Sequence: Synthetic oligonucleotide
ccugcccacaugccccuc

SEQ ID NO: 55392 - RNA, 18 nt, Artificial Sequence
  Description of Artificial Sequence: Synthetic oligonucleotide
agccuccugcccacaugc

SEQ ID NO: 55393 - RNA, 18 nt, Artificial Sequence
  Description of Artificial Sequence: Synthetic oligonucleotide
cccacagccuccugccca

SEQ ID NO: 55394 - RNA, 18 nt, Artificial Sequence
  Description of Artificial Sequence: Synthetic oligonucleotide
gaccccccacagccuccu

SEQ ID NO: 55395 - RNA, 18 nt, Artificial Sequence
  Description of Artificial Sequence: Synthetic oligonucleotide
auauggaccccccacagc

SEQ ID NO: 55396 - RNA, 18 nt, Artificial Sequence
  Description of Artificial Sequence: Synthetic oligonucleotide
gggagauauggacccccc

SEQ ID NO: 55397 - RNA, 18 nt, Artificial Sequence
  Description of Artificial Sequence: Synthetic oligonucleotide
ggguggagaaaaagaagg

SEQ ID NO: 55398 - RNA, 18 nt, Artificial Sequence
  Description of Artificial Sequence: Synthetic oligonucleotide
ugaaguccagaaaauggg

SEQ ID NO: 55399 - RNA, 18 nt, Artificial Sequence
  Description of Artificial Sequence: Synthetic oligonucleotide
auaaaugaaguccagaaa

SEQ ID NO: 55400 - RNA, 18 nt, Artificial Sequence
  Description of Artificial Sequence: Synthetic oligonucleotide
aauaaauaaaugaagucc

SEQ ID NO: 55401 - RNA, 18 nt, Artificial Sequence
  Description of Artificial Sequence: Synthetic oligonucleotide
aaauaaauaaauaaauga

SEQ ID NO: 55402 - RNA, 18 nt, Artificial Sequence
  Description of Artificial Sequence: Synthetic oligonucleotide
ucaaaaaauaaauaaaua

SEQ ID NO: 55403 - RNA, 18 nt, Artificial Sequence
  Description of Artificial Sequence: Synthetic oligonucleotide
cugucucaaaaaauaaau

SEQ ID NO: 55404 - RNA, 18 nt, Artificial Sequence
  Description of Artificial Sequence: Synthetic oligonucleotide
agacucugucucaaaaaa

SEQ ID NO: 55405 - RNA, 18 nt, Artificial Sequence
  Description of Artificial Sequence: Synthetic oligonucleotide
gagcgagacucugucuca

SEQ ID NO: 55406 - RNA, 18 nt, Artificial Sequence
  Description of Artificial Sequence: Synthetic oligonucleotide
ugacagagcgagacucug

SEQ ID NO: 55407 - RNA, 18 nt, Artificial Sequence
  Description of Artificial Sequence: Synthetic oligonucleotide
cugggugacagagcgaga

SEQ ID NO: 55408 - RNA, 18 nt, Artificial Sequence
  Description of Artificial Sequence: Synthetic oligonucleotide
ccagccugggugacagag

SEQ ID NO: 55409 - RNA, 18 nt, Artificial Sequence
  Description of Artificial Sequence: Synthetic oligonucleotide
gcgcuccagccuggguga

SEQ ID NO: 55410 - RNA, 18 nt, Artificial Sequence
  Description of Artificial Sequence: Synthetic oligonucleotide
ccacugcgcuccagccug

SEQ ID NO: 55411 - RNA, 18 nt, Artificial Sequence
  Description of Artificial Sequence: Synthetic oligonucleotide
ucacgccacugcgcucca

SEQ ID NO: 55412 - RNA, 18 nt, Artificial Sequence
  Description of Artificial Sequence: Synthetic oligonucleotide
ucucccaggaccccuggg

SEQ ID NO: 55413 - RNA, 18 nt, Artificial Sequence
  Description of Artificial Sequence: Synthetic oligonucleotide
uuggucucccaggacccc

SEQ ID NO: 55414 - RNA, 18 nt, Artificial Sequence
  Description of Artificial Sequence: Synthetic oligonucleotide
ugugcuuggucucccagg

SEQ ID NO: 55415 - RNA, 18 nt, Artificial Sequence
  Description of Artificial Sequence: Synthetic oligonucleotide
ccaucugugcuuggucuc

SEQ ID NO: 55416 - RNA, 18 nt, Artificial Sequence
  Description of Artificial Sequence: Synthetic oligonucleotide
cccaaccaucugugcuug

SEQ ID NO: 55417 - RNA, 18 nt, Artificial Sequence
  Description of Artificial Sequence: Synthetic oligonucleotide
cuuuccccaaccaucugu

SEQ ID NO: 55418 - RNA, 18 nt, Artificial Sequence
  Description of Artificial Sequence: Synthetic oligonucleotide
ugcagcuuuccccaacca

SEQ ID NO: 55419 - RNA, 18 nt, Artificial Sequence
  Description of Artificial Sequence: Synthetic oligonucleotide
accucugcagcuuucccc

SEQ ID NO: 55420 - RNA, 18 nt, Artificial Sequence
  Description of Artificial Sequence: Synthetic oligonucleotide
cugucaccucugcagcuu

SEQ ID NO: 55421 - RNA, 18 nt, Artificial Sequence
  Description of Artificial Sequence: Synthetic oligonucleotide
ggucccugucaccucugc

SEQ ID NO: 55422 - RNA, 18 nt, Artificial Sequence
  Description of Artificial Sequence: Synthetic oligonucleotide
gggcuggucccugucacc

SEQ ID NO: 55423 - RNA, 18 nt, Artificial Sequence
  Description of Artificial Sequence: Synthetic oligonucleotide
ccugggcuccagccaggg

SEQ ID NO: 55424 - RNA, 18 nt, Artificial Sequence
  Description of Artificial Sequence: Synthetic oligonucleotide
ccccugggcuccagccag

SEQ ID NO: 55425 - RNA, 18 nt, Artificial Sequence
  Description of Artificial Sequence: Synthetic oligonucleotide
gggcaccccugggcucca

SEQ ID NO: 55426 - RNA, 18 nt, Artificial Sequence
  Description of Artificial Sequence: Synthetic oligonucleotide
ggugcggauggugauggg

SEQ ID NO: 55427 - RNA, 18 nt, Artificial Sequence
  Description of Artificial Sequence: Synthetic oligonucleotide
uggugcggauggugaugg

SEQ ID NO: 55428 - RNA, 18 nt, Artificial Sequence
  Description of Artificial Sequence: Synthetic oligonucleotide
gcaggaccuaaugaaggg

SEQ ID NO: 55429 - RNA, 18 nt, Artificial Sequence
  Description of Artificial Sequence: Synthetic oligonucleotide
cacaggcaggaccuaaug

SEQ ID NO: 55430 - RNA, 18 nt, Artificial Sequence
  Description of Artificial Sequence: Synthetic oligonucleotide
augggcacaggcaggacc

SEQ ID NO: 55431 - RNA, 18 nt, Artificial Sequence
  Description of Artificial Sequence: Synthetic oligonucleotide
gcuggaugggcacaggca

SEQ ID NO: 55432 - RNA, 18 nt, Artificial Sequence
  Description of Artificial Sequence: Synthetic oligonucleotide
aagcugcuggaugggcac

SEQ ID NO: 55433 - RNA, 18 nt, Artificial Sequence
  Description of Artificial Sequence: Synthetic oligonucleotide
acccuaagcugcuggaug

SEQ ID NO: 55434 - RNA, 18 nt, Artificial Sequence
  Description of Artificial Sequence: Synthetic oligonucleotide
aacucacccuaagcugcu

SEQ ID NO: 55435 - RNA, 18 nt, Artificial Sequence
  Description of Artificial Sequence: Synthetic oligonucleotide
uuuauaacucacccuaag

SEQ ID NO: 55436 - RNA, 18 nt, Artificial Sequence
  Description of Artificial Sequence: Synthetic oligonucleotide
cucuauuuauaacucacc

SEQ ID NO: 55437 - RNA, 18 nt, Artificial Sequence
  Description of Artificial Sequence: Synthetic oligonucleotide
ccagccucuauuuauaac

SEQ ID NO: 55438 - RNA, 18 nt, Artificial Sequence
  Description of Artificial Sequence: Synthetic oligonucleotide
uuaccccagccucuauuu

SEQ ID NO: 55439 - RNA, 18 nt, Artificial Sequence
  Description of Artificial Sequence: Synthetic oligonucleotide
agggcuuaccccagccuc

SEQ ID NO: 55440 - RNA, 18 nt, Artificial Sequence
  Description of Artificial Sequence: Synthetic oligonucleotide
gacccagggcuuacccca

SEQ ID NO: 55441 - RNA, 18 nt, Artificial Sequence
  Description of Artificial Sequence: Synthetic oligonucleotide
cucuugacccagggcuua

SEQ ID NO: 55442 - RNA, 18 nt, Artificial Sequence
  Description of Artificial Sequence: Synthetic oligonucleotide
cugcucucuugacccagg

SEQ ID NO: 55443 - RNA, 18 nt, Artificial Sequence
  Description of Artificial Sequence: Synthetic oligonucleotide
uugcccugcucucuugac

SEQ ID NO: 55444 - RNA, 18 nt, Artificial Sequence
  Description of Artificial Sequence: Synthetic oligonucleotide
ucuccuugcccugcucuc

SEQ ID NO: 55445 - RNA, 18 nt, Artificial Sequence
  Description of Artificial Sequence: Synthetic oligonucleotide
gguaaucuccuugcccug

SEQ ID NO: 55446 - RNA, 18 nt, Artificial Sequence
  Description of Artificial Sequence: Synthetic oligonucleotide
cagcugguaaucuccuug

SEQ ID NO: 55447 - RNA, 18 nt, Artificial Sequence
  Description of Artificial Sequence: Synthetic oligonucleotide
guaaucagcugguaaucu

SEQ ID NO: 55448 - RNA, 18 nt, Artificial Sequence
  Description of Artificial Sequence: Synthetic oligonucleotide
aaucaguaaucagcuggu

SEQ ID NO: 55449 - RNA, 18 nt, Artificial Sequence
  Description of Artificial Sequence: Synthetic oligonucleotide
cugcuaaucaguaaucag

SEQ ID NO: 55450 - RNA, 18 nt, Artificial Sequence
  Description of Artificial Sequence: Synthetic oligonucleotide
acucucugcuaaucagua

SEQ ID NO: 55451 - RNA, 18 nt, Artificial Sequence
  Description of Artificial Sequence: Synthetic oligonucleotide
cccccacucucugcuaau

SEQ ID NO: 55452 - RNA, 18 nt, Artificial Sequence
  Description of Artificial Sequence: Synthetic oligonucleotide
cacagcccccacucucug

SEQ ID NO: 55453 - RNA, 18 nt, Artificial Sequence
  Description of Artificial Sequence: Synthetic oligonucleotide
cuuggcacagcccccacu

SEQ ID NO: 55454 - RNA, 18 nt, Artificial Sequence
  Description of Artificial Sequence: Synthetic oligonucleotide
uucugcuuggcacagccc

SEQ ID NO: 55455 - RNA, 18 nt, Artificial Sequence
  Description of Artificial Sequence: Synthetic oligonucleotide
ggcccuucugcuuggcac

SEQ ID NO: 55456 - RNA, 18 nt, Artificial Sequence
  Description of Artificial Sequence: Synthetic oligonucleotide
agccaggcccuucugcuu

SEQ ID NO: 55457 - RNA, 18 nt, Artificial Sequence
  Description of Artificial Sequence: Synthetic oligonucleotide
ccaggagccaggcccuuc

SEQ ID NO: 55458 - RNA, 18 nt, Artificial Sequence
  Description of Artificial Sequence: Synthetic oligonucleotide
cacccccaggagccaggc

SEQ ID NO: 55459 - RNA, 18 nt, Artificial Sequence
  Description of Artificial Sequence: Synthetic oligonucleotide
cuccacacccccaggagc

SEQ ID NO: 55460 - RNA, 18 nt, Artificial Sequence
  Description of Artificial Sequence: Synthetic oligonucleotide
ccucccuccacaccccca

SEQ ID NO: 55461 - RNA, 18 nt, Artificial Sequence
  Description of Artificial Sequence: Synthetic oligonucleotide
ccugaccucccuccacac

SEQ ID NO: 55462 - RNA, 18 nt, Artificial Sequence
  Description of Artificial Sequence: Synthetic oligonucleotide
ggagcccugaccucccuc

SEQ ID NO: 55463 - RNA, 18 nt, Artificial Sequence
  Description of Artificial Sequence: Synthetic oligonucleotide
ccaagggagcccugaccu

SEQ ID NO: 55464 - RNA, 18 nt, Artificial Sequence
  Description of Artificial Sequence: Synthetic oligonucleotide
uguccccaagggagcccu

SEQ ID NO: 55465 - RNA, 18 nt, Artificial Sequence
  Description of Artificial Sequence: Synthetic oligonucleotide
cacacuguccccaaggga

SEQ ID NO: 55466 - RNA, 18 nt, Artificial Sequence
  Description of Artificial Sequence: Synthetic oligonucleotide
cccugcacacugucccca

SEQ ID NO: 55467 - RNA, 18 nt, Artificial Sequence
  Description of Artificial Sequence: Synthetic oligonucleotide
guggacccugcacacugu

SEQ ID NO: 55468 - RNA, 18 nt, Artificial Sequence
  Description of Artificial Sequence: Synthetic oligonucleotide
cgucuguggacccugcac

SEQ ID NO: 55469 - RNA, 18 nt, Artificial Sequence
  Description of Artificial Sequence: Synthetic oligonucleotide
ugugccgucuguggaccc

SEQ ID NO: 55470 - RNA, 18 nt, Artificial Sequence
  Description of Artificial Sequence: Synthetic oligonucleotide
ccauaugugccgucugug

SEQ ID NO: 55471 - RNA, 18 nt, Artificial Sequence
  Description of Artificial Sequence: Synthetic oligonucleotide
cagggccauaugugccgu

SEQ ID NO: 55472 - RNA, 18 nt, Artificial Sequence
  Description of Artificial Sequence: Synthetic oligonucleotide
ugccccagggccauaugu

SEQ ID NO: 55473 - RNA, 18 nt, Artificial Sequence
  Description of Artificial Sequence: Synthetic oligonucleotide
aacccugccccagggcca

SEQ ID NO: 55474 - RNA, 18 nt, Artificial Sequence
  Description of Artificial Sequence: Synthetic oligonucleotide
cugggaacccugccccag

SEQ ID NO: 55475 - RNA, 18 nt, Artificial Sequence
  Description of Artificial Sequence: Synthetic oligonucleotide
agacccugggaacccugc

SEQ ID NO: 55476 - RNA, 18 nt, Artificial Sequence
  Description of Artificial Sequence: Synthetic oligonucleotide
cucagagacccugggaac

SEQ ID NO: 55477 - RNA, 18 nt, Artificial Sequence
  Description of Artificial Sequence: Synthetic oligonucleotide
caccucucagagacccug

SEQ ID NO: 55478 - RNA, 18 nt, Artificial Sequence
  Description of Artificial Sequence: Synthetic oligonucleotide
gaaggcaccucucagaga

SEQ ID NO: 55479 - RNA, 18 nt, Artificial Sequence
  Description of Artificial Sequence: Synthetic oligonucleotide
auuuggaaggcaccucuc

SEQ ID NO: 55480 - RNA, 18 nt, Artificial Sequence
  Description of Artificial Sequence: Synthetic oligonucleotide
agaagauuuggaaggcac

SEQ ID NO: 55481 - RNA, 18 nt, Artificial Sequence
  Description of Artificial Sequence: Synthetic oligonucleotide
acuugagaagauuuggaa

SEQ ID NO: 55482 - RNA, 18 nt, Artificial Sequence
  Description of Artificial Sequence: Synthetic oligonucleotide
ucuugacuugagaagauu

SEQ ID NO: 55483 - RNA, 18 nt, Artificial Sequence
  Description of Artificial Sequence: Synthetic oligonucleotide
aacccucuugacuugaga

SEQ ID NO: 55484 - RNA, 18 nt, Artificial Sequence
  Description of Artificial Sequence: Synthetic oligonucleotide
ucuagaacccucuugacu

SEQ ID NO: 55485 - RNA, 18 nt, Artificial Sequence
  Description of Artificial Sequence: Synthetic oligonucleotide
ucucaucuagaacccucu

SEQ ID NO: 55486 - RNA, 18 nt, Artificial Sequence
  Description of Artificial Sequence: Synthetic oligonucleotide
gugggucucaucuagaac

SEQ ID NO: 55487 - RNA, 18 nt, Artificial Sequence
  Description of Artificial Sequence: Synthetic oligonucleotide
cagaggugggucucaucu

SEQ ID NO: 55488 - RNA, 18 nt, Artificial Sequence
  Description of Artificial Sequence: Synthetic oligonucleotide
gaagccagaggugggucu

SEQ ID NO: 55489 - RNA, 18 nt, Artificial Sequence
  Description of Artificial Sequence: Synthetic oligonucleotide
ccccugaagccagaggug

SEQ ID NO: 55490 - RNA, 18 nt, Artificial Sequence
  Description of Artificial Sequence: Synthetic oligonucleotide
gggcaccccugaagccag

SEQ ID NO: 55491 - RNA, 18 nt, Artificial Sequence
  Description of Artificial Sequence: Synthetic oligonucleotide
ccuggguagggagcaggg

SEQ ID NO: 55492 - RNA, 18 nt, Artificial Sequence
  Description of Artificial Sequence: Synthetic oligonucleotide
uccuggguagggagcagg

SEQ ID NO: 55493 - RNA, 18 nt, Artificial Sequence
  Description of Artificial Sequence: Synthetic oligonucleotide
gccucuccuggguaggga

SEQ ID NO: 55494 - RNA, 18 nt, Artificial Sequence
  Description of Artificial Sequence: Synthetic oligonucleotide
cucacgccucuccugggu

SEQ ID NO: 55495 - RNA, 18 nt, Artificial Sequence
  Description of Artificial Sequence: Synthetic oligonucleotide
agccccucacgccucucc

SEQ ID NO: 55496 - RNA, 18 nt, Artificial Sequence
  Description of Artificial Sequence: Synthetic oligonucleotide
uuggcugagacguugacc

SEQ ID NO: 55497 - RNA, 18 nt, Artificial Sequence
  Description of Artificial Sequence: Synthetic oligonucleotide
ccugauuggcugagacgu

SEQ ID NO: 55498 - RNA, 18 nt, Artificial Sequence
  Description of Artificial Sequence: Synthetic oligonucleotide
aucauccugauuggcuga

SEQ ID NO: 55499 - RNA, 18 nt, Artificial Sequence
  Description of Artificial Sequence: Synthetic oligonucleotide
aguucaucauccugauug

SEQ ID NO: 55500 - RNA, 18 nt, Artificial Sequence
  Description of Artificial Sequence: Synthetic oligonucleotide
ggucuaguucaucauccu

SEQ ID NO: 55501 - RNA, 18 nt, Artificial Sequence
  Description of Artificial Sequence: Synthetic oligonucleotide
cucguggucuaguucauc

SEQ ID NO: 55502 - RNA, 18 nt, Artificial Sequence
  Description of Artificial Sequence: Synthetic oligonucleotide
aaggucucguggucuagu

SEQ ID NO: 55503 - RNA, 18 nt, Artificial Sequence
  Description of Artificial Sequence: Synthetic oligonucleotide
ucaggaaggucucguggu

SEQ ID NO: 55504 - RNA, 18 nt, Artificial Sequence
  Description of Artificial Sequence: Synthetic oligonucleotide
uugcaucaggaaggucuc

SEQ ID NO: 55505 - RNA, 18 nt, Artificial Sequence
  Description of Artificial Sequence: Synthetic oligonucleotide
ucaauuugcaucaggaag

SEQ ID NO: 55506 - RNA, 18 nt, Artificial Sequence
  Description of Artificial Sequence: Synthetic oligonucleotide
ccuggucaauuugcauca

SEQ ID NO: 55507 - RNA, 18 nt, Artificial Sequence
  Description of Artificial Sequence: Synthetic oligonucleotide
ugucuccuggucaauuug

SEQ ID NO: 55508 - RNA, 18 nt, Artificial Sequence
  Description of Artificial Sequence: Synthetic oligonucleotide
uucuuugucuccugguca

SEQ ID NO: 55509 - RNA, 18 nt, Artificial Sequence
  Description of Artificial Sequence: Synthetic oligonucleotide
ugcacuucuuugucuccu

SEQ ID NO: 55510 - RNA, 18 nt, Artificial Sequence
  Description of Artificial Sequence: Synthetic oligonucleotide
gaaggugcacuucuuugu

SEQ ID NO: 55511 - RNA, 18 nt, Artificial Sequence
  Description of Artificial Sequence: Synthetic oligonucleotide
gaauagaaggugcacuuc

SEQ ID NO: 55512 - RNA, 18 nt, Artificial Sequence
  Description of Artificial Sequence: Synthetic oligonucleotide
ugcuggaauagaaggugc

SEQ ID NO: 55513 - RNA, 18 nt, Artificial Sequence
  Description of Artificial Sequence: Synthetic oligonucleotide
cccagugcuggaauagaa

SEQ ID NO: 55514 - RNA, 18 nt, Artificial Sequence
  Description of Artificial Sequence: Synthetic oligonucleotide
uagcccccagugcuggaa

SEQ ID NO: 55515 - RNA, 18 nt, Artificial Sequence
  Description of Artificial Sequence: Synthetic oligonucleotide
uccaguagcccccagugc

SEQ ID NO: 55516 - RNA, 18 nt, Artificial Sequence
  Description of Artificial Sequence: Synthetic oligonucleotide
caggguccaguagccccc

SEQ ID NO: 55517 - RNA, 18 nt, Artificial Sequence
  Description of Artificial Sequence: Synthetic oligonucleotide
gugaccaggguccaguag

SEQ ID NO: 55518 - RNA, 18 nt, Artificial Sequence
  Description of Artificial Sequence: Synthetic oligonucleotide
caugggugaccagggucc

SEQ ID NO: 55519 - RNA, 18 nt, Artificial Sequence
  Description of Artificial Sequence: Synthetic oligonucleotide
gcccccaugggugaccag

SEQ ID NO: 55520 - RNA, 18 nt, Artificial Sequence
  Description of Artificial Sequence: Synthetic oligonucleotide
ugaaugcccccaugggug

SEQ ID NO: 55521 - RNA, 18 nt, Artificial Sequence
  Description of Artificial Sequence: Synthetic oligonucleotide
uggcgugaaugcccccau

SEQ ID NO: 55522 - RNA, 18 nt, Artificial Sequence
  Description of Artificial Sequence: Synthetic oligonucleotide
ggcuguggcgugaaugcc

SEQ ID NO: 55523 - RNA, 18 nt, Artificial Sequence
  Description of Artificial Sequence: Synthetic oligonucleotide
uguguggcuguggcguga

SEQ ID NO: 55524 - RNA, 18 nt, Artificial Sequence
  Description of Artificial Sequence: Synthetic oligonucleotide
aaacaugguguuggcaga

SEQ ID NO: 55525 - RNA, 18 nt, Artificial Sequence
  Description of Artificial Sequence: Synthetic oligonucleotide
aucucaaacaugguguug

SEQ ID NO: 55526 - RNA, 18 nt, Artificial Sequence
  Description of Artificial Sequence: Synthetic oligonucleotide
acuccaucucaaacaugg

SEQ ID NO: 55527 - RNA, 18 nt, Artificial Sequence
  Description of Artificial Sequence: Synthetic oligonucleotide
acgccacuccaucucaaa

SEQ ID NO: 55528 - RNA, 18 nt, Artificial Sequence
  Description of Artificial Sequence: Synthetic oligonucleotide
cggccacgccacuccauc

SEQ ID NO: 55529 - RNA, 18 nt, Artificial Sequence
  Description of Artificial Sequence: Synthetic oligonucleotide
cccgccggccacgccacu

SEQ ID NO: 55530 - RNA, 18 nt, Artificial Sequence
  Description of Artificial Sequence: Synthetic oligonucleotide
ugcuacccgccggccacg

SEQ ID NO: 55531 - RNA, 18 nt, Artificial Sequence
  Description of Artificial Sequence: Synthetic oligonucleotide
uugagugcuacccgccgg

SEQ ID NO: 55532 - RNA, 18 nt, Artificial Sequence
  Description of Artificial Sequence: Synthetic oligonucleotide
uggcuuugagugcuaccc

SEQ ID NO: 55533 - RNA, 18 nt, Artificial Sequence
  Description of Artificial Sequence: Synthetic oligonucleotide
guugcuggcuuugagugc

SEQ ID NO: 55534 - RNA, 18 nt, Artificial Sequence
  Description of Artificial Sequence: Synthetic oligonucleotide
cgcccguugcuggcuuug

SEQ ID NO: 55535 - RNA, 18 nt, Artificial Sequence
  Description of Artificial Sequence: Synthetic oligonucleotide
cguagcgcccguugcugg

SEQ ID NO: 55536 - RNA, 18 nt, Artificial Sequence
  Description of Artificial Sequence: Synthetic oligonucleotide
gcacacguagcgcccguu

SEQ ID NO: 55537 - RNA, 18 nt, Artificial Sequence
  Description of Artificial Sequence: Synthetic oligonucleotide
uucaugcacacguagcgc

SEQ ID NO: 55538 - RNA, 18 nt, Artificial Sequence
  Description of Artificial Sequence: Synthetic oligonucleotide
ucuucuucaugcacacgu

SEQ ID NO: 55539 - RNA, 18 nt, Artificial Sequence
  Description of Artificial Sequence: Synthetic oligonucleotide
cccauucuucuucaugca

SEQ ID NO: 55540 - RNA, 18 nt, Artificial Sequence
  Description of Artificial Sequence: Synthetic oligonucleotide
agcugcccauucuucuuc

SEQ ID NO: 55541 - RNA, 18 nt, Artificial Sequence
  Description of Artificial Sequence: Synthetic oligonucleotide
ccgccagcugcccauucu

SEQ ID NO: 55542 - RNA, 18 nt, Artificial Sequence
  Description of Artificial Sequence: Synthetic oligonucleotide
gauagccgccagcugccc

SEQ ID NO: 55543 - RNA, 18 nt, Artificial Sequence
  Description of Artificial Sequence: Synthetic oligonucleotide
ucgcugauagccgccagc

SEQ ID NO: 55544 - RNA, 18 nt, Artificial Sequence
  Description of Artificial Sequence: Synthetic oligonucleotide
caaaaucgcugauagccg

SEQ ID NO: 55545 - RNA, 18 nt, Artificial Sequence
  Description of Artificial Sequence: Synthetic oligonucleotide
uaccuggcaggcagagug

SEQ ID NO: 55546 - RNA, 18 nt, Artificial Sequence
  Description of Artificial Sequence: Synthetic oligonucleotide
cccaguaccuggcaggca

SEQ ID NO: 55547 - RNA, 18 nt, Artificial Sequence
  Description of Artificial Sequence: Synthetic oligonucleotide
ccugccccaguaccuggc

SEQ ID NO: 55548 - RNA, 18 nt, Artificial Sequence
  Description of Artificial Sequence: Synthetic oligonucleotide
cagccccugccccaguac

SEQ ID NO: 55549 - RNA, 18 nt, Artificial Sequence
  Description of Artificial Sequence: Synthetic oligonucleotide
ggagacagccccugcccc

SEQ ID NO: 55550 - RNA, 18 nt, Artificial Sequence
  Description of Artificial Sequence: Synthetic oligonucleotide
uggguggagacagccccu

SEQ ID NO: 55551 - RNA, 18 nt, Artificial Sequence
  Description of Artificial Sequence: Synthetic oligonucleotide
uucccuggguggagacag

SEQ ID NO: 55552 - RNA, 18 nt, Artificial Sequence
  Description of Artificial Sequence: Synthetic oligonucleotide
guccuuucccugggugga

SEQ ID NO: 55553 - RNA, 18 nt, Artificial Sequence
  Description of Artificial Sequence: Synthetic oligonucleotide
ggcagguccuuucccugg

SEQ ID NO: 55554 - RNA, 18 nt, Artificial Sequence
  Description of Artificial Sequence: Synthetic oligonucleotide
gucugggcagguccuuuc

SEQ ID NO: 55555 - RNA, 18 nt, Artificial Sequence
  Description of Artificial Sequence: Synthetic oligonucleotide
gggugucugggcaggucc

SEQ ID NO: 55556 - RNA, 18 nt, Artificial Sequence
  Description of Artificial Sequence: Synthetic oligonucleotide
gcucuugguggagauggg

SEQ ID NO: 55557 - RNA, 18 nt, Artificial Sequence
  Description of Artificial Sequence: Synthetic oligonucleotide
guccagcucuugguggag

SEQ ID NO: 55558 - RNA, 18 nt, Artificial Sequence
  Description of Artificial Sequence: Synthetic oligonucleotide
ggaggguccagcucuugg

SEQ ID NO: 55559 - RNA, 18 nt, Artificial Sequence
  Description of Artificial Sequence: Synthetic oligonucleotide
gggaggguccagcucuug

SEQ ID NO: 55560 - RNA, 18 nt, Artificial Sequence
  Description of Artificial Sequence: Synthetic oligonucleotide
cccguuccgugggcuggg

SEQ ID NO: 55561 - RNA, 18 nt, Artificial Sequence
  Description of Artificial Sequence: Synthetic oligonucleotide
cagcacccguuccguggg

SEQ ID NO: 55562 - RNA, 18 nt, Artificial Sequence
  Description of Artificial Sequence: Synthetic oligonucleotide
caugacagcacccguucc

SEQ ID NO: 55563 - RNA, 18 nt, Artificial Sequence
  Description of Artificial Sequence: Synthetic oligonucleotide
gacuccaugacagcaccc

SEQ ID NO: 55564 - RNA, 18 nt, Artificial Sequence
  Description of Artificial Sequence: Synthetic oligonucleotide
aguaugacuccaugacag

SEQ ID NO: 55565 - RNA, 18 nt, Artificial Sequence
  Description of Artificial Sequence: Synthetic oligonucleotide
uagcaaguaugacuccau

SEQ ID NO: 55566 - RNA, 18 nt, Artificial Sequence
  Description of Artificial Sequence: Synthetic oligonucleotide
uugacuagcaaguaugac

SEQ ID NO: 55567 - RNA, 18 nt, Artificial Sequence
  Description of Artificial Sequence: Synthetic oligonucleotide
uuaucuugacuagcaagu

SEQ ID NO: 55568 - RNA, 18 nt, Artificial Sequence
  Description of Artificial Sequence: Synthetic oligonucleotide
acgaguuaucuugacuag

SEQ ID NO: 55569 - RNA, 18 nt, Artificial Sequence
  Description of Artificial Sequence: Synthetic oligonucleotide
ccaagacgaguuaucuug

SEQ ID NO: 55570 - RNA, 18 nt, Artificial Sequence
  Description of Artificial Sequence: Synthetic oligonucleotide
ccuugccaagacgaguua

SEQ ID NO: 55571 - RNA, 18 nt, Artificial Sequence
  Description of Artificial Sequence: Synthetic oligonucleotide
guuucccuugccaagacg

SEQ ID NO: 55572 - RNA, 18 nt, Artificial Sequence
  Description of Artificial Sequence: Synthetic oligonucleotide
ugacuccaugacagcacc

SEQ ID NO: 55573 - RNA, 18 nt, Artificial Sequence
  Description of Artificial Sequence: Synthetic oligonucleotide
aaguaugacuccaugaca

SEQ ID NO: 55574 - RNA, 18 nt, Artificial Sequence
  Description of Artificial Sequence: Synthetic oligonucleotide
cuagcaaguaugacucca

SEQ ID NO: 55575 - RNA, 18 nt, Artificial Sequence
  Description of Artificial Sequence: Synthetic oligonucleotide
cuugacuagcaaguauga

SEQ ID NO: 55576 - RNA, 18 nt, Artificial Sequence
  Description of Artificial Sequence: Synthetic oligonucleotide
guuaucuugacuagcaag

SEQ ID NO: 55577 - RNA, 18 nt, Artificial Sequence
  Description of Artificial Sequence: Synthetic oligonucleotide
gacgaguuaucuugacua

SEQ ID NO: 55578 - RNA, 18 nt, Artificial Sequence
  Description of Artificial Sequence: Synthetic oligonucleotide
gccaagacgaguuaucuu

SEQ ID NO: 55579 - RNA, 18 nt, Artificial Sequence
  Description of Artificial Sequence: Synthetic oligonucleotide
cccuugccaagacgaguu

SEQ ID NO: 55580 - RNA, 18 nt, Artificial Sequence
  Description of Artificial Sequence: Synthetic oligonucleotide
uguuucccuugccaagac

SEQ ID NO: 55581 - RNA, 18 nt, Artificial Sequence
  Description of Artificial Sequence: Synthetic oligonucleotide
agaccuguuucccuugcc

SEQ ID NO: 55582 - RNA, 18 nt, Artificial Sequence
  Description of Artificial Sequence: Synthetic oligonucleotide
cauucagaccuguuuccc

SEQ ID NO: 55583 - RNA, 18 nt, Artificial Sequence
  Description of Artificial Sequence: Synthetic oligonucleotide
aaggacauucagaccugu

SEQ ID NO: 55584 - RNA, 18 nt, Artificial Sequence
  Description of Artificial Sequence: Synthetic oligonucleotide
gagauaaggacauucaga

SEQ ID NO: 55585 - RNA, 18 nt, Artificial Sequence
  Description of Artificial Sequence: Synthetic oligonucleotide
cagcggagauaaggacau

SEQ ID NO: 55586 - RNA, 18 nt, Artificial Sequence
  Description of Artificial Sequence: Synthetic oligonucleotide
cccagcagcggagauaag

SEQ ID NO: 55587 - RNA, 18 nt, Artificial Sequence
  Description of Artificial Sequence: Synthetic oligonucleotide
ggguucccagcagcggag

SEQ ID NO: 55588 - RNA, 18 nt, Artificial Sequence
  Description of Artificial Sequence: Synthetic oligonucleotide
uuggcaaggcgccuaggg

SEQ ID NO: 55589 - RNA, 18 nt, Artificial Sequence
  Description of Artificial Sequence: Synthetic oligonucleotide
ggccuuggcaaggcgccu

SEQ ID NO: 55590 - RNA, 18 nt, Artificial Sequence
  Description of Artificial Sequence: Synthetic oligonucleotide
ugugcggccuuggcaagg

SEQ ID NO: 55591 - RNA, 18 nt, Artificial Sequence
  Description of Artificial Sequence: Synthetic oligonucleotide
ccucaugugcggccuugg

SEQ ID NO: 55592 - RNA, 18 nt, Artificial Sequence
  Description of Artificial Sequence: Synthetic oligonucleotide
cauugccucaugugcggc

SEQ ID NO: 55593 - RNA, 18 nt, Artificial Sequence
  Description of Artificial Sequence: Synthetic oligonucleotide
ccugccauugccucaugu

SEQ ID NO: 55594 - RNA, 18 nt, Artificial Sequence
  Description of Artificial Sequence: Synthetic oligonucleotide
ccaggccugccauugccu

SEQ ID NO: 55595 - RNA, 18 nt, Artificial Sequence
  Description of Artificial Sequence: Synthetic oligonucleotide
gggacccaggccugccau

SEQ ID NO: 55596 - RNA, 18 nt, Artificial Sequence
  Description of Artificial Sequence: Synthetic oligonucleotide
acuuagggacccaggccu

SEQ ID NO: 55597 - RNA, 18 nt, Artificial Sequence
  Description of Artificial Sequence: Synthetic oligonucleotide
ccuggacuuagggaccca

SEQ ID NO: 55598 - RNA, 18 nt, Artificial Sequence
  Description of Artificial Sequence: Synthetic oligonucleotide
cccuguccaggccgggcg

SEQ ID NO: 55599 - RNA, 18 nt, Artificial Sequence
  Description of Artificial Sequence: Synthetic oligonucleotide
accuucccuguccaggcc

SEQ ID NO: 55600 - RNA, 18 nt, Artificial Sequence
  Description of Artificial Sequence: Synthetic oligonucleotide
ccgccaccuucccugucc

SEQ ID NO: 55601 - RNA, 18 nt, Artificial Sequence
  Description of Artificial Sequence: Synthetic oligonucleotide
cccucccgccaccuuccc

SEQ ID NO: 55602 - RNA, 18 nt, Artificial Sequence
  Description of Artificial Sequence: Synthetic oligonucleotide
gcugccccucccgccacc

SEQ ID NO: 55603 - RNA, 18 nt, Artificial Sequence
  Description of Artificial Sequence: Synthetic oligonucleotide
gcugcgcugccccucccg

SEQ ID NO: 55604 - RNA, 18 nt, Artificial Sequence
  Description of Artificial Sequence: Synthetic oligonucleotide
cgucugcugcgcugcccc

SEQ ID NO: 55605 - RNA, 18 nt, Artificial Sequence
  Description of Artificial Sequence: Synthetic oligonucleotide
gagagcgucugcugcgcu

SEQ ID NO: 55606 - RNA, 18 nt, Artificial Sequence
  Description of Artificial Sequence: Synthetic oligonucleotide
gggagagcgucugcugcg

SEQ ID NO: 55607 - RNA, 18 nt, Artificial Sequence
  Description of Artificial Sequence: Synthetic oligonucleotide
ucguccuugccuggcggg

SEQ ID NO: 55608 - RNA, 18 nt, Artificial Sequence
  Description of Artificial Sequence: Synthetic oligonucleotide
acucuucguccuugccug

SEQ ID NO: 55609 - RNA, 18 nt, Artificial Sequence
  Description of Artificial Sequence: Synthetic oligonucleotide
ggugaacucuucguccuu

SEQ ID NO: 55610 - RNA, 18 nt, Artificial Sequence
  Description of Artificial Sequence: Synthetic oligonucleotide
uugagggugaacucuucg

SEQ ID NO: 55611 - RNA, 18 nt, Artificial Sequence
  Description of Artificial Sequence: Synthetic oligonucleotide
ugagcuugagggugaacu

SEQ ID NO: 55612 - RNA, 18 nt, Artificial Sequence
  Description of Artificial Sequence: Synthetic oligonucleotide
guugaugagcuugagggu

SEQ ID NO: 55613 - RNA, 18 nt, Artificial Sequence
  Description of Artificial Sequence: Synthetic oligonucleotide
ggccgguugaugagcuug

SEQ ID NO: 55614 - RNA, 18 nt, Artificial Sequence
  Description of Artificial Sequence: Synthetic oligonucleotide
ggaugggccgguugauga

SEQ ID NO: 55615 - RNA, 18 nt, Artificial Sequence
  Description of Artificial Sequence: Synthetic oligonucleotide
caccaggaugggccgguu

SEQ ID NO: 55616 - RNA, 18 nt, Artificial Sequence
  Description of Artificial Sequence: Synthetic oligonucleotide
cgcagcaccaggaugggc

SEQ ID NO: 55617 - RNA, 18 nt, Artificial Sequence
  Description of Artificial Sequence: Synthetic oligonucleotide
ggccgcgcagcaccagga

SEQ ID NO: 55618 - RNA, 18 nt, Artificial Sequence
  Description of Artificial Sequence: Synthetic oligonucleotide
guccaggccgcgcagcac

SEQ ID NO: 55619 - RNA, 18 nt, Artificial Sequence
  Description of Artificial Sequence: Synthetic oligonucleotide
aagccguccaggccgcgc

SEQ ID NO: 55620 - RNA, 18 nt, Artificial Sequence
  Description of Artificial Sequence: Synthetic oligonucleotide
agacgaagccguccaggc

SEQ ID NO: 55621 - RNA, 18 nt, Artificial Sequence
  Description of Artificial Sequence: Synthetic oligonucleotide
guggcagacgaagccguc

SEQ ID NO: 55622 - RNA, 18 nt, Artificial Sequence
  Description of Artificial Sequence: Synthetic oligonucleotide
cggugguggcagacgaag

SEQ ID NO: 55623 - RNA, 18 nt, Artificial Sequence
  Description of Artificial Sequence: Synthetic oligonucleotide
agccgcggugguggcaga

SEQ ID NO: 55624 - RNA, 18 nt, Artificial Sequence
  Description of Artificial Sequence: Synthetic oligonucleotide
guuggagccgcgguggug

SEQ ID NO: 55625 - RNA, 18 nt, Artificial Sequence
  Description of Artificial Sequence: Synthetic oligonucleotide
agcugguuggagccgcgg

SEQ ID NO: 55626 - RNA, 18 nt, Artificial Sequence
  Description of Artificial Sequence: Synthetic oligonucleotide
uguccagcugguuggagc

SEQ ID NO: 55627 - RNA, 18 nt, Artificial Sequence
  Description of Artificial Sequence: Synthetic oligonucleotide
guugguguccagcugguu

SEQ ID NO: 55628 - RNA, 18 nt, Artificial Sequence
  Description of Artificial Sequence: Synthetic oligonucleotide
gagcgguugguguccagc

SEQ ID NO: 55629 - RNA, 18 nt, Artificial Sequence
  Description of Artificial Sequence: Synthetic oligonucleotide
agacggagcgguuggugu

SEQ ID NO: 55630 - RNA, 18 nt, Artificial Sequence
  Description of Artificial Sequence: Synthetic oligonucleotide
gucguagacggagcgguu

SEQ ID NO: 55631 - RNA, 18 nt, Artificial Sequence
  Description of Artificial Sequence: Synthetic oligonucleotide
aagacgucguagacggag

SEQ ID NO: 55632 - RNA, 18 nt, Artificial Sequence
  Description of Artificial Sequence: Synthetic oligonucleotide
gguggaagacgucguaga

SEQ ID NO: 55633 - RNA, 18 nt, Artificial Sequence
  Description of Artificial Sequence: Synthetic oligonucleotide
gcucagguggaagacguc

SEQ ID NO: 55634 - RNA, 18 nt, Artificial Sequence
  Description of Artificial Sequence: Synthetic oligonucleotide
cugaagcucagguggaag

SEQ ID NO: 55635 - RNA, 18 nt, Artificial Sequence
  Description of Artificial Sequence: Synthetic oligonucleotide
cgucgcugaagcucaggu

SEQ ID NO: 55636 - RNA, 18 nt, Artificial Sequence
  Description of Artificial Sequence: Synthetic oligonucleotide
ggcgccgucgcugaagcu

SEQ ID NO: 55637 - RNA, 18 nt, Artificial Sequence
  Description of Artificial Sequence: Synthetic oligonucleotide
cgguaggcgccgucgcug

SEQ ID NO: 55638 - RNA, 18 nt, Artificial Sequence
  Description of Artificial Sequence: Synthetic oligonucleotide
ggauccgguaggcgccgu

SEQ ID NO: 55639 - RNA, 18 nt, Artificial Sequence
  Description of Artificial Sequence: Synthetic oligonucleotide
uucacgauggguccccac

SEQ ID NO: 55640 - RNA, 18 nt, Artificial Sequence
  Description of Artificial Sequence: Synthetic oligonucleotide
ccaucuucacgauggguc

SEQ ID NO: 55641 - RNA, 18 nt, Artificial Sequence
  Description of Artificial Sequence: Synthetic oligonucleotide
ccacgccaucuucacgau

SEQ ID NO: 55642 - RNA, 18 nt, Artificial Sequence
  Description of Artificial Sequence: Synthetic oligonucleotide
cagggccacgccaucuuc

SEQ ID NO: 55643 - RNA, 18 nt, Artificial Sequence
  Description of Artificial Sequence: Synthetic oligonucleotide
ccucucagggccacgcca

SEQ ID NO: 55644 - RNA, 18 nt, Artificial Sequence
  Description of Artificial Sequence: Synthetic oligonucleotide
ggcugccucucagggcca

SEQ ID NO: 55645 - RNA, 18 nt, Artificial Sequence
  Description of Artificial Sequence: Synthetic oligonucleotide
agaauggcugccucucag

SEQ ID NO: 55646 - RNA, 18 nt, Artificial Sequence
  Description of Artificial Sequence: Synthetic oligonucleotide
agaagagaauggcugccu

SEQ ID NO: 55647 - RNA, 18 nt, Artificial Sequence
  Description of Artificial Sequence: Synthetic oligonucleotide
uuggcagaagagaauggc

SEQ ID NO: 55648 - RNA, 18 nt, Artificial Sequence
  Description of Artificial Sequence: Synthetic oligonucleotide
cugguuuggcagaagaga

SEQ ID NO: 55649 - RNA, 18 nt, Artificial Sequence
  Description of Artificial Sequence: Synthetic oligonucleotide
ggaaccugguuuggcaga

SEQ ID NO: 55650 - RNA, 18 nt, Artificial Sequence
  Description of Artificial Sequence: Synthetic oligonucleotide
gaaccggaaccugguuug

SEQ ID NO: 55651 - RNA, 18 nt, Artificial Sequence
  Description of Artificial Sequence: Synthetic oligonucleotide
cuguggaaccggaaccug

SEQ ID NO: 55652 - RNA, 18 nt, Artificial Sequence
  Description of Artificial Sequence: Synthetic oligonucleotide
ggaagcuguggaaccgga

SEQ ID NO: 55653 - RNA, 18 nt, Artificial Sequence
  Description of Artificial Sequence: Synthetic oligonucleotide
ggacaggaagcuguggaa

SEQ ID NO: 55654 - RNA, 18 nt, Artificial Sequence
  Description of Artificial Sequence: Synthetic oligonucleotide
agacuggacaggaagcug

SEQ ID NO: 55655 - RNA, 18 nt, Artificial Sequence
  Description of Artificial Sequence: Synthetic oligonucleotide
gucgcagacuggacagga

SEQ ID NO: 55656 - RNA, 18 nt, Artificial Sequence
  Description of Artificial Sequence: Synthetic oligonucleotide
gggaagucgcagacugga

SEQ ID NO: 55657 - RNA, 18 nt, Artificial Sequence
  Description of Artificial Sequence: Synthetic oligonucleotide
gguggguucaggucaggg

SEQ ID NO: 55658 - RNA, 18 nt, Artificial Sequence
  Description of Artificial Sequence: Synthetic oligonucleotide
ggguggguucaggucagg

SEQ ID NO: 55659 - RNA, 18 nt, Artificial Sequence
  Description of Artificial Sequence: Synthetic oligonucleotide
cucuguaaggguccuggg

SEQ ID NO: 55660 - RNA, 18 nt, Artificial Sequence
  Description of Artificial Sequence: Synthetic oligonucleotide
gugcccuggugaggccaa

SEQ ID NO: 55661 - RNA, 18 nt, Artificial Sequence
  Description of Artificial Sequence: Synthetic oligonucleotide
cagaagugcccuggugag

SEQ ID NO: 55662 - RNA, 18 nt, Artificial Sequence
  Description of Artificial Sequence: Synthetic oligonucleotide
gaggucagaagugcccug

SEQ ID NO: 55663 - RNA, 18 nt, Artificial Sequence
  Description of Artificial Sequence: Synthetic oligonucleotide
aaagugaggucagaagug

SEQ ID NO: 55664 - RNA, 18 nt, Artificial Sequence
  Description of Artificial Sequence: Synthetic oligonucleotide
uugugaaagugaggucag

SEQ ID NO: 55665 - RNA, 18 nt, Artificial Sequence
  Description of Artificial Sequence: Synthetic oligonucleotide
uccuauugugaaagugag

SEQ ID NO: 55666 - RNA, 18 nt, Artificial Sequence
  Description of Artificial Sequence: Synthetic oligonucleotide
acugguccuauugugaaa

SEQ ID NO: 55667 - RNA, 18 nt, Artificial Sequence
  Description of Artificial Sequence: Synthetic oligonucleotide
ucaacacugguccuauug

SEQ ID NO: 55668 - RNA, 18 nt, Artificial Sequence
  Description of Artificial Sequence: Synthetic oligonucleotide
ggguaucaacacuggucc

SEQ ID NO: 55669 - RNA, 18 nt, Artificial Sequence
  Description of Artificial Sequence: Synthetic oligonucleotide
aggcuggguaucaacacu

SEQ ID NO: 55670 - RNA, 18 nt, Artificial Sequence
  Description of Artificial Sequence: Synthetic oligonucleotide
ccaagaggcuggguauca

SEQ ID NO: 55671 - RNA, 18 nt, Artificial Sequence
  Description of Artificial Sequence: Synthetic oligonucleotide
gaacaccaagaggcuggg

SEQ ID NO: 55672 - RNA, 18 nt, Artificial Sequence
  Description of Artificial Sequence: Synthetic oligonucleotide
gggaugaacaccaagagg

SEQ ID NO: 55673 - RNA, 18 nt, Artificial Sequence
  Description of Artificial Sequence: Synthetic oligonucleotide
cuugagggaugaacacca

SEQ ID NO: 55674 - RNA, 18 nt, Artificial Sequence
  Description of Artificial Sequence: Synthetic oligonucleotide
ugcuucuugagggaugaa

SEQ ID NO: 55675 - RNA, 18 nt, Artificial Sequence
  Description of Artificial Sequence: Synthetic oligonucleotide
gccagugcuucuugaggg

SEQ ID NO: 55676 - RNA, 18 nt, Artificial Sequence
  Description of Artificial Sequence: Synthetic oligonucleotide
uuucugccagugcuucuu

SEQ ID NO: 55677 - RNA, 18 nt, Artificial Sequence
  Description of Artificial Sequence: Synthetic oligonucleotide
cuggguuucugccagugc

SEQ ID NO: 55678 - RNA, 18 nt, Artificial Sequence
  Description of Artificial Sequence: Synthetic oligonucleotide
gauuccuggguuucugcc

SEQ ID NO: 55679 - RNA, 18 nt, Artificial Sequence
  Description of Artificial Sequence: Synthetic oligonucleotide
aauuugauuccuggguuu

SEQ ID NO: 55680 - RNA, 18 nt, Artificial Sequence
  Description of Artificial Sequence: Synthetic oligonucleotide
ugcccaauuugauuccug

SEQ ID NO: 55681 - RNA, 18 nt, Artificial Sequence
  Description of Artificial Sequence: Synthetic oligonucleotide
uuuugugcccaauuugau

SEQ ID NO: 55682 - RNA, 18 nt, Artificial Sequence
  Description of Artificial Sequence: Synthetic oligonucleotide
accauuuuugugcccaau

SEQ ID NO: 55683 - RNA, 18 nt, Artificial Sequence
  Description of Artificial Sequence: Synthetic oligonucleotide
uccuuaccauuuuugugc

SEQ ID NO: 55684 - RNA, 18 nt, Artificial Sequence
  Description of Artificial Sequence: Synthetic oligonucleotide
ccauuuccuuaccauuuu

SEQ ID NO: 55685 - RNA, 18 nt, Artificial Sequence
  Description of Artificial Sequence: Synthetic oligonucleotide
cuuugccauuuccuuacc

SEQ ID NO: 55686 - RNA, 18 nt, Artificial Sequence
  Description of Artificial Sequence: Synthetic oligonucleotide
aaauacuuugccauuucc

SEQ ID NO: 55687 - RNA, 18 nt, Artificial Sequence
  Description of Artificial Sequence: Synthetic oligonucleotide
guucuaaauacuuugcca

SEQ ID NO: 55688 - RNA, 18 nt, Artificial Sequence
  Description of Artificial Sequence: Synthetic oligonucleotide
gcgaaguucuaaauacuu

SEQ ID NO: 55689 - RNA, 18 nt, Artificial Sequence
  Description of Artificial Sequence: Synthetic oligonucleotide
agcgggcgaaguucuaaa

SEQ ID NO: 55690 - RNA, 18 nt, Artificial Sequence
  Description of Artificial Sequence: Synthetic oligonucleotide
caauuagcgggcgaaguu

SEQ ID NO: 55691 - RNA, 18 nt, Artificial Sequence
  Description of Artificial Sequence: Synthetic oligonucleotide
aaacacaauuagcgggcg

SEQ ID NO: 55692 - RNA, 18 nt, Artificial Sequence
  Description of Artificial Sequence: Synthetic oligonucleotide
uggagaaacacaauuagc

SEQ ID NO: 55693 - RNA, 18 nt, Artificial Sequence
  Description of Artificial Sequence: Synthetic oligonucleotide
gucccuggagaaacacaa

SEQ ID NO: 55694 - RNA, 18 nt, Artificial Sequence
  Description of Artificial Sequence: Synthetic oligonucleotide
aaacagucccuggagaaa

SEQ ID NO: 55695 - RNA, 18 nt, Artificial Sequence
  Description of Artificial Sequence: Synthetic oligonucleotide
gaggaaaacagucccugg

SEQ ID NO: 55696 - RNA, 18 nt, Artificial Sequence
  Description of Artificial Sequence: Synthetic oligonucleotide
uguuugaggaaaacaguc

SEQ ID NO: 55697 - RNA, 18 nt, Artificial Sequence
  Description of Artificial Sequence: Synthetic oligonucleotide
gaggauguuugaggaaaa

SEQ ID NO: 55698 - RNA, 18 nt, Artificial Sequence
  Description of Artificial Sequence: Synthetic oligonucleotide
uuucagaggauguuugag

SEQ ID NO: 55699 - RNA, 18 nt, Artificial Sequence
  Description of Artificial Sequence: Synthetic oligonucleotide
caggauuucagaggaugu

SEQ ID NO: 55700 - RNA, 18 nt, Artificial Sequence
  Description of Artificial Sequence: Synthetic oligonucleotide
aggaccaggauuucagag

SEQ ID NO: 55701 - RNA, 18 nt, Artificial Sequence
  Description of Artificial Sequence: Synthetic oligonucleotide
gauauaggaccaggauuu

SEQ ID NO: 55702 - RNA, 18 nt, Artificial Sequence
  Description of Artificial Sequence: Synthetic oligonucleotide
cugcugauauaggaccag

SEQ ID NO: 55703 - RNA, 18 nt, Artificial Sequence
  Description of Artificial Sequence: Synthetic oligonucleotide
auucccugcugauauagg

SEQ ID NO: 55704 - RNA, 18 nt, Artificial Sequence
  Description of Artificial Sequence: Synthetic oligonucleotide
gccucauucccugcugau

SEQ ID NO: 55705 - RNA, 18 nt, Artificial Sequence
  Description of Artificial Sequence: Synthetic oligonucleotide
cuguggccucauucccug

SEQ ID NO: 55706 - RNA, 18 nt, Artificial Sequence
  Description of Artificial Sequence: Synthetic oligonucleotide
ucagucuguggccucauu

SEQ ID NO: 55707 - RNA, 18 nt, Artificial Sequence
  Description of Artificial Sequence: Synthetic oligonucleotide
ucucaucagucuguggcc

SEQ ID NO: 55708 - RNA, 18 nt, Artificial Sequence
  Description of Artificial Sequence: Synthetic oligonucleotide
uuuccucucaucagucug

SEQ ID NO: 55709 - RNA, 18 nt, Artificial Sequence
  Description of Artificial Sequence: Synthetic oligonucleotide
uaaaauuuccucucauca

SEQ ID NO: 55710 - RNA, 18 nt, Artificial Sequence
  Description of Artificial Sequence: Synthetic oligonucleotide
uaaaauaaaauuuccucu

SEQ ID NO: 55711 - RNA, 18 nt, Artificial Sequence
  Description of Artificial Sequence: Synthetic oligonucleotide
auagcuaaaauaaaauuu

SEQ ID NO: 55712 - RNA, 18 nt, Artificial Sequence
  Description of Artificial Sequence: Synthetic oligonucleotide
uggaaauagcuaaaauaa

SEQ ID NO: 55713 - RNA, 18 nt, Artificial Sequence
  Description of Artificial Sequence: Synthetic oligonucleotide
aaauguggaaauagcuaa

SEQ ID NO: 55714 - RNA, 18 nt, Artificial Sequence
  Description of Artificial Sequence: Synthetic oligonucleotide
gagaaaaauguggaaaua

SEQ ID NO: 55715 - RNA, 18 nt, Artificial Sequence
  Description of Artificial Sequence: Synthetic oligonucleotide
ugaaugagaaaaaugugg

SEQ ID NO: 55716 - RNA, 18 nt, Artificial Sequence
  Description of Artificial Sequence: Synthetic oligonucleotide
ggaccugaaugagaaaaa

SEQ ID NO: 55717 - RNA, 18 nt, Artificial Sequence
  Description of Artificial Sequence: Synthetic oligonucleotide
uuagaggaccugaaugag

SEQ ID NO: 55718 - RNA, 18 nt, Artificial Sequence
  Description of Artificial Sequence: Synthetic oligonucleotide
ccacauuagaggaccuga

SEQ ID NO: 55719 - RNA, 18 nt, Artificial Sequence
  Description of Artificial Sequence: Synthetic oligonucleotide
acuaaccacauuagagga

SEQ ID NO: 55720 - RNA, 18 nt, Artificial Sequence
  Description of Artificial Sequence: Synthetic oligonucleotide
ccacaacuaaccacauua

SEQ ID NO: 55721 - RNA, 18 nt, Artificial Sequence
  Description of Artificial Sequence: Synthetic oligonucleotide
ucaggccacaacuaacca

SEQ ID NO: 55722 - RNA, 18 nt, Artificial Sequence
  Description of Artificial Sequence: Synthetic oligonucleotide
cauuuucaggccacaacu

SEQ ID NO: 55723 - RNA, 18 nt, Artificial Sequence
  Description of Artificial Sequence: Synthetic oligonucleotide
aauaucauuuucaggcca

SEQ ID NO: 55724 - RNA, 18 nt, Artificial Sequence
  Description of Artificial Sequence: Synthetic oligonucleotide
uuggaaauaucauuuuca

SEQ ID NO: 55725 - RNA, 18 nt, Artificial Sequence
  Description of Artificial Sequence: Synthetic oligonucleotide
uucauuuggaaauaucau

SEQ ID NO: 55726 - RNA, 18 nt, Artificial Sequence
  Description of Artificial Sequence: Synthetic oligonucleotide
uccuauucauuuggaaau

SEQ ID NO: 55727 - RNA, 18 nt, Artificial Sequence
  Description of Artificial Sequence: Synthetic oligonucleotide
uuccuuccuauucauuug

SEQ ID NO: 55728 - RNA, 18 nt, Artificial Sequence
  Description of Artificial Sequence: Synthetic oligonucleotide
uuuccuuccuuccuauuc

SEQ ID NO: 55729 - RNA, 18 nt, Artificial Sequence
  Description of Artificial Sequence: Synthetic oligonucleotide
aacaauuuccuuccuucc

SEQ ID NO: 55730 - RNA, 18 nt, Artificial Sequence
  Description of Artificial Sequence: Synthetic oligonucleotide
acaaaaacaauuuccuuc

SEQ ID NO: 55731 - RNA, 18 nt, Artificial Sequence
  Description of Artificial Sequence: Synthetic oligonucleotide
aaacaacaaaaacaauuu

SEQ ID NO: 55732 - RNA, 18 nt, Artificial Sequence
  Description of Artificial Sequence: Synthetic oligonucleotide
aucuuaaacaacaaaaac

SEQ ID NO: 55733 - RNA, 18 nt, Artificial Sequence
  Description of Artificial Sequence: Synthetic oligonucleotide
cuuccaucuuaaacaaca

SEQ ID NO: 55734 - RNA, 18 nt, Artificial Sequence
  Description of Artificial Sequence: Synthetic oligonucleotide
auuuccuuccaucuuaaa

SEQ ID NO: 55735 - RNA, 18 nt, Artificial Sequence
  Description of Artificial Sequence: Synthetic oligonucleotide
ccuauauuuccuuccauc

SEQ ID NO: 55736 - RNA, 18 nt, Artificial Sequence
  Description of Artificial Sequence: Synthetic oligonucleotide
augcaccuauauuuccuu

SEQ ID NO: 55737 - RNA, 18 nt, Artificial Sequence
  Description of Artificial Sequence: Synthetic oligonucleotide
uuuaaaugcaccuauauu

SEQ ID NO: 55738 - RNA, 18 nt, Artificial Sequence
  Description of Artificial Sequence: Synthetic oligonucleotide
cauuuuuuaaaugcaccu

SEQ ID NO: 55739 - RNA, 18 nt, Artificial Sequence
  Description of Artificial Sequence: Synthetic oligonucleotide
agcuccauuuuuuaaaug

SEQ ID NO: 55740 - RNA, 18 nt, Artificial Sequence
  Description of Artificial Sequence: Synthetic oligonucleotide
aaccaagcuccauuuuuu

SEQ ID NO: 55741 - RNA, 18 nt, Artificial Sequence
  Description of Artificial Sequence: Synthetic oligonucleotide
caugcaaccaagcuccau

SEQ ID NO: 55742 - RNA, 18 nt, Artificial Sequence
  Description of Artificial Sequence: Synthetic oligonucleotide
aaaaucaugcaaccaagc

SEQ ID NO: 55743 - RNA, 18 nt, Artificial Sequence
  Description of Artificial Sequence: Synthetic oligonucleotide
gagcgaaaaucaugcaac

SEQ ID NO: 55744 - RNA, 18 nt, Artificial Sequence
  Description of Artificial Sequence: Synthetic oligonucleotide
cucaagagcgaaaaucau

SEQ ID NO: 55745 - RNA, 18 nt, Artificial Sequence
  Description of Artificial Sequence: Synthetic oligonucleotide
gaugacucaagagcgaaa

SEQ ID NO: 55746 - RNA, 18 nt, Artificial Sequence
  Description of Artificial Sequence: Synthetic oligonucleotide
ggcuagaugacucaagag

SEQ ID NO: 55747 - RNA, 18 nt, Artificial Sequence
  Description of Artificial Sequence: Synthetic oligonucleotide
uagagggcuagaugacuc

SEQ ID NO: 55748 - RNA, 18 nt, Artificial Sequence
  Description of Artificial Sequence: Synthetic oligonucleotide
aucauuagagggcuagau

SEQ ID NO: 55749 - RNA, 18 nt, Artificial Sequence
  Description of Artificial Sequence: Synthetic oligonucleotide
aggcaaucauuagagggc

SEQ ID NO: 55750 - RNA, 18 nt, Artificial Sequence
  Description of Artificial Sequence: Synthetic oligonucleotide
guaugaggcaaucauuag

SEQ ID NO: 55751 - RNA, 18 nt, Artificial Sequence
  Description of Artificial Sequence: Synthetic oligonucleotide
caccgguaugaggcaauc

SEQ ID NO: 55752 - RNA, 18 nt, Artificial Sequence
  Description of Artificial Sequence: Synthetic oligonucleotide
guaaucaccgguaugagg

SEQ ID NO: 55753 - RNA, 18 nt, Artificial Sequence
  Description of Artificial Sequence: Synthetic oligonucleotide
cgcucguaaucaccggua

SEQ ID NO: 55754 - RNA, 18 nt, Artificial Sequence
  Description of Artificial Sequence: Synthetic oligonucleotide
aaagccgcucguaaucac

SEQ ID NO: 55755 - RNA, 18 nt, Artificial Sequence
  Description of Artificial Sequence: Synthetic oligonucleotide
caugaaaagccgcucgua

SEQ ID NO: 55756 - RNA, 18 nt, Artificial Sequence
  Description of Artificial Sequence: Synthetic oligonucleotide
gggucaugaaaagccgcu

SEQ ID NO: 55757 - RNA, 18 nt, Artificial Sequence
  Description of Artificial Sequence: Synthetic oligonucleotide
aaaugguacauauggaag

SEQ ID NO: 55758 - RNA, 18 nt, Artificial Sequence
  Description of Artificial Sequence: Synthetic oligonucleotide
uuuuaaaaugguacauau

SEQ ID NO: 55759 - RNA, 18 nt, Artificial Sequence
  Description of Artificial Sequence: Synthetic oligonucleotide
cagcauuuuaaaauggua

SEQ ID NO: 55760 - RNA, 18 nt, Artificial Sequence
  Description of Artificial Sequence: Synthetic oligonucleotide
guaaucagcauuuuaaaa

SEQ ID NO: 55761 - RNA, 18 nt, Artificial Sequence
  Description of Artificial Sequence: Synthetic oligonucleotide
aagaaguaaucagcauuu

SEQ ID NO: 55762 - RNA, 18 nt, Artificial Sequence
  Description of Artificial Sequence: Synthetic oligonucleotide
uucucaagaaguaaucag

SEQ ID NO: 55763 - RNA, 18 nt, Artificial Sequence
  Description of Artificial Sequence: Synthetic oligonucleotide
ucuuauucucaagaagua

SEQ ID NO: 55764 - RNA, 18 nt, Artificial Sequence
  Description of Artificial Sequence: Synthetic oligonucleotide
gcuucucuuauucucaag

SEQ ID NO: 55765 - RNA, 18 nt, Artificial Sequence
  Description of Artificial Sequence: Synthetic oligonucleotide
auuaggcuucucuuauuc

SEQ ID NO: 55766 - RNA, 18 nt, Artificial Sequence
  Description of Artificial Sequence: Synthetic oligonucleotide
cugaaauuaggcuucucu

SEQ ID NO: 55767 - RNA, 18 nt, Artificial Sequence
  Description of Artificial Sequence: Synthetic oligonucleotide
auauucugaaauuaggcu

SEQ ID NO: 55768 - RNA, 18 nt, Artificial Sequence
  Description of Artificial Sequence: Synthetic oligonucleotide
uaaugauauucugaaauu

SEQ ID NO: 55769 - RNA, 18 nt, Artificial Sequence
  Description of Artificial Sequence: Synthetic oligonucleotide
uacccuaaugauauucug

SEQ ID NO: 55770 - RNA, 18 nt, Artificial Sequence
  Description of Artificial Sequence: Synthetic oligonucleotide
auagguacccuaaugaua

SEQ ID NO: 55771 - RNA, 18 nt, Artificial Sequence
  Description of Artificial Sequence: Synthetic oligonucleotide
cuucaauagguacccuaa

SEQ ID NO: 55772 - RNA, 18 nt, Artificial Sequence
  Description of Artificial Sequence: Synthetic oligonucleotide
caagacuucaauagguac

SEQ ID NO: 55773 - RNA, 18 nt, Artificial Sequence
  Description of Artificial Sequence: Synthetic oligonucleotide
gcagucaagacuucaaua

SEQ ID NO: 55774 - RNA, 18 nt, Artificial Sequence
  Description of Artificial Sequence: Synthetic oligonucleotide
uaugugcagucaagacuu

SEQ ID NO: 55775 - RNA, 18 nt, Artificial Sequence
  Description of Artificial Sequence: Synthetic oligonucleotide
cuaaauaugugcagucaa

SEQ ID NO: 55776 - RNA, 18 nt, Artificial Sequence
  Description of Artificial Sequence: Synthetic oligonucleotide
guaugcuaaauaugugca

SEQ ID NO: 55777 - RNA, 18 nt, Artificial Sequence
  Description of Artificial Sequence: Synthetic oligonucleotide
agggaguaugcuaaauau

SEQ ID NO: 55778 - RNA, 18 nt, Artificial Sequence
  Description of Artificial Sequence: Synthetic oligonucleotide
uucccagggaguaugcua

SEQ ID NO: 55779 - RNA, 18 nt, Artificial Sequence
  Description of Artificial Sequence: Synthetic oligonucleotide
uauaauucccagggagua

SEQ ID NO: 55780 - RNA, 18 nt, Artificial Sequence
  Description of Artificial Sequence: Synthetic oligonucleotide
uaaaauauaauucccagg

SEQ ID NO: 55781 - RNA, 18 nt, Artificial Sequence
  Description of Artificial Sequence: Synthetic oligonucleotide
guccuuaaaauauaauuc

SEQ ID NO: 55782 - RNA, 18 nt, Artificial Sequence
  Description of Artificial Sequence: Synthetic oligonucleotide
aaaauguccuuaaaauau

SEQ ID NO: 55783 - RNA, 18 nt, Artificial Sequence
  Description of Artificial Sequence: Synthetic oligonucleotide
auagaaaaauguccuuaa

SEQ ID NO: 55784 - RNA, 18 nt, Artificial Sequence
  Description of Artificial Sequence: Synthetic oligonucleotide
auuuaauagaaaaauguc

SEQ ID NO: 55785 - RNA, 18 nt, Artificial Sequence
  Description of Artificial Sequence: Synthetic oligonucleotide
caaugauuuaauagaaaa

SEQ ID NO: 55786 - RNA, 18 nt, Artificial Sequence
  Description of Artificial Sequence: Synthetic oligonucleotide
auaugcaaugauuuaaua

SEQ ID NO: 55787 - RNA, 18 nt, Artificial Sequence
  Description of Artificial Sequence: Synthetic oligonucleotide
cuuccauaugcaaugauu

SEQ ID NO: 55788 - RNA, 18 nt, Artificial Sequence
  Description of Artificial Sequence: Synthetic oligonucleotide
aguuucuuccauaugcaa

SEQ ID NO: 55789 - RNA, 18 nt, Artificial Sequence
  Description of Artificial Sequence: Synthetic oligonucleotide
uauugaguuucuuccaua

SEQ ID NO: 55790 - RNA, 18 nt, Artificial Sequence
  Description of Artificial Sequence: Synthetic oligonucleotide
uauuauauugaguuucuu

SEQ ID NO: 55791 - RNA, 18 nt, Artificial Sequence
  Description of Artificial Sequence: Synthetic oligonucleotide
ucagcuauuauauugagu

SEQ ID NO: 55792 - RNA, 18 nt, Artificial Sequence
  Description of Artificial Sequence: Synthetic oligonucleotide
aaauaucagcuauuauau

SEQ ID NO: 55793 - RNA, 18 nt, Artificial Sequence
  Description of Artificial Sequence: Synthetic oligonucleotide
caaguaaauaucagcuau

SEQ ID NO: 55794 - RNA, 18 nt, Artificial Sequence
  Description of Artificial Sequence: Synthetic oligonucleotide
gaacccaaguaaauauca

SEQ ID NO: 55795 - RNA, 18 nt, Artificial Sequence
  Description of Artificial Sequence: Synthetic oligonucleotide
auuaagaacccaaguaaa

SEQ ID NO: 55796 - RNA, 18 nt, Artificial Sequence
  Description of Artificial Sequence: Synthetic oligonucleotide
uucugauuaagaacccaa

SEQ ID NO: 55797 - RNA, 18 nt, Artificial Sequence
  Description of Artificial Sequence: Synthetic oligonucleotide
caauguucugauuaagaa

SEQ ID NO: 55798 - RNA, 18 nt, Artificial Sequence
  Description of Artificial Sequence: Synthetic oligonucleotide
acagccaauguucugauu

SEQ ID NO: 55799 - RNA, 18 nt, Artificial Sequence
  Description of Artificial Sequence: Synthetic oligonucleotide
aucacacagccaauguuc

SEQ ID NO: 55800 - RNA, 18 nt, Artificial Sequence
  Description of Artificial Sequence: Synthetic oligonucleotide
ugaaaaucacacagccaa

SEQ ID NO: 55801 - RNA, 18 nt, Artificial Sequence
  Description of Artificial Sequence: Synthetic oligonucleotide
aaucaugaaaaucacaca

SEQ ID NO: 55802 - RNA, 18 nt, Artificial Sequence
  Description of Artificial Sequence: Synthetic oligonucleotide
aucauaaucaugaaaauc

SEQ ID NO: 55803 - RNA, 18 nt, Artificial Sequence
  Description of Artificial Sequence: Synthetic oligonucleotide
ugaaaaucauaaucauga

SEQ ID NO: 55804 - RNA, 18 nt, Artificial Sequence
  Description of Artificial Sequence: Synthetic oligonucleotide
ugcaaugaaaaucauaau

SEQ ID NO: 55805 - RNA, 18 nt, Artificial Sequence
  Description of Artificial Sequence: Synthetic oligonucleotide
uuaauugcaaugaaaauc

SEQ ID NO: 55806 - RNA, 18 nt, Artificial Sequence
  Description of Artificial Sequence: Synthetic oligonucleotide
ucaacuuaauugcaauga

SEQ ID NO: 55807 - RNA, 18 nt, Artificial Sequence
  Description of Artificial Sequence: Synthetic oligonucleotide
aaacaucaacuuaauugc

SEQ ID NO: 55808 - RNA, 18 nt, Artificial Sequence
  Description of Artificial Sequence: Synthetic oligonucleotide
cuacaaaacaucaacuua

SEQ ID NO: 55809 - RNA, 18 nt, Artificial Sequence
  Description of Artificial Sequence: Synthetic oligonucleotide
acugucuacaaaacauca

SEQ ID NO: 55810 - RNA, 18 nt, Artificial Sequence
  Description of Artificial Sequence: Synthetic oligonucleotide
auuucacugucuacaaaa

SEQ ID NO: 55811 - RNA, 18 nt, Artificial Sequence
  Description of Artificial Sequence: Synthetic oligonucleotide
ugguaauuucacugucua

SEQ ID NO: 55812 - RNA, 18 nt, Artificial Sequence
  Description of Artificial Sequence: Synthetic oligonucleotide
guagaugguaauuucacu

SEQ ID NO: 55813 - RNA, 18 nt, Artificial Sequence
  Description of Artificial Sequence: Synthetic oligonucleotide
uuggaguagaugguaauu

SEQ ID NO: 55814 - RNA, 18 nt, Artificial Sequence
  Description of Artificial Sequence: Synthetic oligonucleotide
aucuuuuggaguagaugg

SEQ ID NO: 55815 - RNA, 18 nt, Artificial Sequence
  Description of Artificial Sequence: Synthetic oligonucleotide
uugcaaucuuuuggagua

SEQ ID NO: 55816 - RNA, 18 nt, Artificial Sequence
  Description of Artificial Sequence: Synthetic oligonucleotide
cuauuuugcaaucuuuug

SEQ ID NO: 55817 - RNA, 18 nt, Artificial Sequence
  Description of Artificial Sequence: Synthetic oligonucleotide
aaauucuauuuugcaauc

SEQ ID NO: 55818 - RNA, 18 nt, Artificial Sequence
  Description of Artificial Sequence: Synthetic oligonucleotide
agguuaaauucuauuuug

SEQ ID NO: 55819 - RNA, 18 nt, Artificial Sequence
  Description of Artificial Sequence: Synthetic oligonucleotide
cucuaagguuaaauucua

SEQ ID NO: 55820 - RNA, 18 nt, Artificial Sequence
  Description of Artificial Sequence: Synthetic oligonucleotide
auuggcucuaagguuaaa

SEQ ID NO: 55821 - RNA, 18 nt, Artificial Sequence
  Description of Artificial Sequence: Synthetic oligonucleotide
ccugcauuggcucuaagg

SEQ ID NO: 55822 - RNA, 18 nt, Artificial Sequence
  Description of Artificial Sequence: Synthetic oligonucleotide
uuuucccugcauuggcuc

SEQ ID NO: 55823 - RNA, 18 nt, Artificial Sequence
  Description of Artificial Sequence: Synthetic oligonucleotide
acaaguuuucccugcauu

SEQ ID NO: 55824 - RNA, 18 nt, Artificial Sequence
  Description of Artificial Sequence: Synthetic oligonucleotide
cagaaacaaguuuucccu

SEQ ID NO: 55825 - RNA, 18 nt, Artificial Sequence
  Description of Artificial Sequence: Synthetic oligonucleotide
accugcagaaacaaguuu

SEQ ID NO: 55826 - RNA, 18 nt, Artificial Sequence
  Description of Artificial Sequence: Synthetic oligonucleotide
aaugcaccugcagaaaca

SEQ ID NO: 55827 - RNA, 18 nt, Artificial Sequence
  Description of Artificial Sequence: Synthetic oligonucleotide
caaaaaaugcaccugcag

SEQ ID NO: 55828 - RNA, 18 nt, Artificial Sequence
  Description of Artificial Sequence: Synthetic oligonucleotide
aguuucaaaaaaugcacc

SEQ ID NO: 55829 - RNA, 18 nt, Artificial Sequence
  Description of Artificial Sequence: Synthetic oligonucleotide
guugaaguuucaaaaaau

SEQ ID NO: 55830 - RNA, 18 nt, Artificial Sequence
  Description of Artificial Sequence: Synthetic oligonucleotide
uaucuguugaaguuucaa

SEQ ID NO: 55831 - RNA, 18 nt, Artificial Sequence
  Description of Artificial Sequence: Synthetic oligonucleotide
ccugcuaucuguugaagu

SEQ ID NO: 55832 - RNA, 18 nt, Artificial Sequence
  Description of Artificial Sequence: Synthetic oligonucleotide
uucccccugcuaucuguu

SEQ ID NO: 55833 - RNA, 18 nt, Artificial Sequence
  Description of Artificial Sequence: Synthetic oligonucleotide
uuuuuuucccccugcuau

SEQ ID NO: 55834 - RNA, 18 nt, Artificial Sequence
  Description of Artificial Sequence: Synthetic oligonucleotide
ucacuuuuuuuucccccu

SEQ ID NO: 55835 - RNA, 18 nt, Artificial Sequence
  Description of Artificial Sequence: Synthetic oligonucleotide
uucugucacuuuuuuuuc

SEQ ID NO: 55836 - RNA, 18 nt, Artificial Sequence
  Description of Artificial Sequence: Synthetic oligonucleotide
gauccuucugucacuuuu

SEQ ID NO: 55837 - RNA, 18 nt, Artificial Sequence
  Description of Artificial Sequence: Synthetic oligonucleotide
acugugauccuucuguca

SEQ ID NO: 55838 - RNA, 18 nt, Artificial Sequence
  Description of Artificial Sequence: Synthetic oligonucleotide
gcugaacugugauccuuc

SEQ ID NO: 55839 - RNA, 18 nt, Artificial Sequence
  Description of Artificial Sequence: Synthetic oligonucleotide
auacugcugaacugugau

SEQ ID NO: 55840 - RNA, 18 nt, Artificial Sequence
  Description of Artificial Sequence: Synthetic oligonucleotide
aauucauacugcugaacu

SEQ ID NO: 55841 - RNA, 18 nt, Artificial Sequence
  Description of Artificial Sequence: Synthetic oligonucleotide
cagacaauucauacugcu

SEQ ID NO: 55842 - RNA, 18 nt, Artificial Sequence
  Description of Artificial Sequence: Synthetic oligonucleotide
gccagcagacaauucaua

SEQ ID NO: 55843 - RNA, 18 nt, Artificial Sequence
  Description of Artificial Sequence: Synthetic oligonucleotide
aggcugccagcagacaau

SEQ ID NO: 55844 - RNA, 18 nt, Artificial Sequence
  Description of Artificial Sequence: Synthetic oligonucleotide
uugcaaggcugccagcag

SEQ ID NO: 55845 - RNA, 18 nt, Artificial Sequence
  Description of Artificial Sequence: Synthetic oligonucleotide
ccagauugcaaggcugcc

SEQ ID NO: 55846 - RNA, 18 nt, Artificial Sequence
  Description of Artificial Sequence: Synthetic oligonucleotide
gcacaccagauugcaagg

SEQ ID NO: 55847 - RNA, 18 nt, Artificial Sequence
  Description of Artificial Sequence: Synthetic oligonucleotide
ugccugcacaccagauug

SEQ ID NO: 55848 - RNA, 18 nt, Artificial Sequence
  Description of Artificial Sequence: Synthetic oligonucleotide
cucacugccugcacacca

SEQ ID NO: 55849 - RNA, 18 nt, Artificial Sequence
  Description of Artificial Sequence: Synthetic oligonucleotide
acaaucucacugccugca

SEQ ID NO: 55850 - RNA, 18 nt, Artificial Sequence
  Description of Artificial Sequence: Synthetic oligonucleotide
acaccacaaucucacugc

SEQ ID NO: 55851 - RNA, 18 nt, Artificial Sequence
  Description of Artificial Sequence: Synthetic oligonucleotide
cauguacaccacaaucuc

SEQ ID NO: 55852 - RNA, 18 nt, Artificial Sequence
  Description of Artificial Sequence: Synthetic oligonucleotide
ggugacauguacaccaca

SEQ ID NO: 55853 - RNA, 18 nt, Artificial Sequence
  Description of Artificial Sequence: Synthetic oligonucleotide
aaucaggugacauguaca

SEQ ID NO: 55854 - RNA, 18 nt, Artificial Sequence
  Description of Artificial Sequence: Synthetic oligonucleotide
uguaguccugguggcaug

SEQ ID NO: 55855 - RNA, 18 nt, Artificial Sequence
  Description of Artificial Sequence: Synthetic oligonucleotide
gccccuguaguccuggug

SEQ ID NO: 55856 - RNA, 18 nt, Artificial Sequence
  Description of Artificial Sequence: Synthetic oligonucleotide
acucugccccuguagucc

SEQ ID NO: 55857 - RNA, 18 nt, Artificial Sequence
  Description of Artificial Sequence: Synthetic oligonucleotide
gagacacucugccccugu

SEQ ID NO: 55858 - RNA, 18 nt, Artificial Sequence
  Description of Artificial Sequence: Synthetic oligonucleotide
cagaggagacacucugcc

SEQ ID NO: 55859 - RNA, 18 nt, Artificial Sequence
  Description of Artificial Sequence: Synthetic oligonucleotide
gcugccagaggagacacu

SEQ ID NO: 55860 - RNA, 18 nt, Artificial Sequence
  Description of Artificial Sequence: Synthetic oligonucleotide
ucagagcugccagaggag

SEQ ID NO: 55861 - RNA, 18 nt, Artificial Sequence
  Description of Artificial Sequence: Synthetic oligonucleotide
ugaucucagagcugccag

SEQ ID NO: 55862 - RNA, 18 nt, Artificial Sequence
  Description of Artificial Sequence: Synthetic oligonucleotide
ggauuugaucucagagcu

SEQ ID NO: 55863 - RNA, 18 nt, Artificial Sequence
  Description of Artificial Sequence: Synthetic oligonucleotide
ucaucggauuugaucuca

SEQ ID NO: 55864 - RNA, 18 nt, Artificial Sequence
  Description of Artificial Sequence: Synthetic oligonucleotide
ccucgucaucggauuuga

SEQ ID NO: 55865 - RNA, 18 nt, Artificial Sequence
  Description of Artificial Sequence: Synthetic oligonucleotide
aucacccucgucaucgga

SEQ ID NO: 55866 - RNA, 18 nt, Artificial Sequence
  Description of Artificial Sequence: Synthetic oligonucleotide
uucucaucacccucguca

SEQ ID NO: 55867 - RNA, 18 nt, Artificial Sequence
  Description of Artificial Sequence: Synthetic oligonucleotide
gcagguucucaucacccu

SEQ ID NO: 55868 - RNA, 18 nt, Artificial Sequence
  Description of Artificial Sequence: Synthetic oligonucleotide
gucuugcagguucucauc

SEQ ID NO: 55869 - RNA, 18 nt, Artificial Sequence
  Description of Artificial Sequence: Synthetic oligonucleotide
uucgugucuugcagguuc

SEQ ID NO: 55870 - RNA, 18 nt, Artificial Sequence
  Description of Artificial Sequence: Synthetic oligonucleotide
aagauuucgugucuugca

SEQ ID NO: 55871 - RNA, 18 nt, Artificial Sequence
  Description of Artificial Sequence: Synthetic oligonucleotide
cuccgaagauuucguguc

SEQ ID NO: 55872 - RNA, 18 nt, Artificial Sequence
  Description of Artificial Sequence: Synthetic oligonucleotide
uuguccuccgaagauuuc

SEQ ID NO: 55873 - RNA, 18 nt, Artificial Sequence
  Description of Artificial Sequence: Synthetic oligonucleotide
auuucuuguccuccgaag

SEQ ID NO: 55874 - RNA, 18 nt, Artificial Sequence
  Description of Artificial Sequence: Synthetic oligonucleotide
aucuaauuucuuguccuc

SEQ ID NO: 55875 - RNA, 18 nt, Artificial Sequence
  Description of Artificial Sequence: Synthetic oligonucleotide
ucgucaucuaauuucuug

SEQ ID NO: 55876 - RNA, 18 nt, Artificial Sequence
  Description of Artificial Sequence: Synthetic oligonucleotide
ucuugucgucaucuaauu

SEQ ID NO: 55877 - RNA, 18 nt, Artificial Sequence
  Description of Artificial Sequence: Synthetic oligonucleotide
auccuucuugucgucauc

SEQ ID NO: 55878 - RNA, 18 nt, Artificial Sequence
  Description of Artificial Sequence: Synthetic oligonucleotide
uugauauccuucuugucg

SEQ ID NO: 55879 - RNA, 18 nt, Artificial Sequence
  Description of Artificial Sequence: Synthetic oligonucleotide
uugauuugauauccuucu

SEQ ID NO: 55880 - RNA, 18 nt, Artificial Sequence
  Description of Artificial Sequence: Synthetic oligonucleotide
aguaauugauuugauauc

SEQ ID NO: 55881 - RNA, 18 nt, Artificial Sequence
  Description of Artificial Sequence: Synthetic oligonucleotide
uucacgauggguccccac

SEQ ID NO: 55882 - RNA, 18 nt, Artificial Sequence
  Description of Artificial Sequence: Synthetic oligonucleotide
ccaucuucacgauggguc

SEQ ID NO: 55883 - RNA, 18 nt, Artificial Sequence
  Description of Artificial Sequence: Synthetic oligonucleotide
ccacgccaucuucacgau

SEQ ID NO: 55884 - RNA, 18 nt, Artificial Sequence
  Description of Artificial Sequence: Synthetic oligonucleotide
cagggccacgccaucuuc

SEQ ID NO: 55885 - RNA, 18 nt, Artificial Sequence
  Description of Artificial Sequence: Synthetic oligonucleotide
ccucucagggccacgcca

SEQ ID NO: 55886 - RNA, 18 nt, Artificial Sequence
  Description of Artificial Sequence: Synthetic oligonucleotide
ggcugccucucagggcca

SEQ ID NO: 55887 - RNA, 18 nt, Artificial Sequence
  Description of Artificial Sequence: Synthetic oligonucleotide
agaauggcugccucucag

SEQ ID NO: 55888 - RNA, 18 nt, Artificial Sequence
  Description of Artificial Sequence: Synthetic oligonucleotide
agaagagaauggcugccu

SEQ ID NO: 55889 - RNA, 18 nt, Artificial Sequence
  Description of Artificial Sequence: Synthetic oligonucleotide
uuggcagaagagaauggc

SEQ ID NO: 55890 - RNA, 18 nt, Artificial Sequence
  Description of Artificial Sequence: Synthetic oligonucleotide
cugguuuggcagaagaga

SEQ ID NO: 55891 - RNA, 18 nt, Artificial Sequence
  Description of Artificial Sequence: Synthetic oligonucleotide
ggaaccugguuuggcaga

SEQ ID NO: 55892 - RNA, 18 nt, Artificial Sequence
  Description of Artificial Sequence: Synthetic oligonucleotide
gaaccggaaccugguuug

SEQ ID NO: 55893 - RNA, 18 nt, Artificial Sequence
  Description of Artificial Sequence: Synthetic oligonucleotide
cuguggaaccggaaccug

SEQ ID NO: 55894 - RNA, 18 nt, Artificial Sequence
  Description of Artificial Sequence: Synthetic oligonucleotide
ggaagcuguggaaccgga

SEQ ID NO: 55895 - RNA, 18 nt, Artificial Sequence
  Description of Artificial Sequence: Synthetic oligonucleotide
ggacaggaagcuguggaa

SEQ ID NO: 55896 - RNA, 18 nt, Artificial Sequence
  Description of Artificial Sequence: Synthetic oligonucleotide
agacuggacaggaagcug

SEQ ID NO: 55897 - RNA, 18 nt, Artificial Sequence
  Description of Artificial Sequence: Synthetic oligonucleotide
gucgcagacuggacagga

SEQ ID NO: 55898 - RNA, 18 nt, Artificial Sequence
  Description of Artificial Sequence: Synthetic oligonucleotide
gggaagucgcagacugga

SEQ ID NO: 55899 - RNA, 18 nt, Artificial Sequence
  Description of Artificial Sequence: Synthetic oligonucleotide
gguggguucaggucaggg

SEQ ID NO: 55900 - RNA, 18 nt, Artificial Sequence
  Description of Artificial Sequence: Synthetic oligonucleotide
ggguggguucaggucagg

SEQ ID NO: 55901 - RNA, 18 nt, Artificial Sequence
  Description of Artificial Sequence: Synthetic oligonucleotide
cucuguaaggguccuggg

SEQ ID NO: 55902 - RNA, 18 nt, Artificial Sequence
  Description of Artificial Sequence: Synthetic oligonucleotide
gugcccuggugaggccaa

SEQ ID NO: 55903 - RNA, 18 nt, Artificial Sequence
  Description of Artificial Sequence: Synthetic oligonucleotide
cagaagugcccuggugag

SEQ ID NO: 55904 - RNA, 18 nt, Artificial Sequence
  Description of Artificial Sequence: Synthetic oligonucleotide
gaggucagaagugcccug

SEQ ID NO: 55905 - RNA, 18 nt, Artificial Sequence
  Description of Artificial Sequence: Synthetic oligonucleotide
aaagugaggucagaagug

SEQ ID NO: 55906 - RNA, 18 nt, Artificial Sequence
  Description of Artificial Sequence: Synthetic oligonucleotide
uugugaaagugaggucag

SEQ ID NO: 55907 - RNA, 18 nt, Artificial Sequence
  Description of Artificial Sequence: Synthetic oligonucleotide
uccuauugugaaagugag

SEQ ID NO: 55908 - RNA, 18 nt, Artificial Sequence
  Description of Artificial Sequence: Synthetic oligonucleotide
acugguccuauugugaaa

SEQ ID NO: 55909 - RNA, 18 nt, Artificial Sequence
  Description of Artificial Sequence: Synthetic oligonucleotide
ucaacacugguccuauug

SEQ ID NO: 55910 - RNA, 18 nt, Artificial Sequence
  Description of Artificial Sequence: Synthetic oligonucleotide
ggguaucaacacuggucc

SEQ ID NO: 55911 - RNA, 18 nt, Artificial Sequence
  Description of Artificial Sequence: Synthetic oligonucleotide
aggcuggguaucaacacu

SEQ ID NO: 55912 - RNA, 18 nt, Artificial Sequence
  Description of Artificial Sequence: Synthetic oligonucleotide
ccaagaggcuggguauca

SEQ ID NO: 55913 - RNA, 18 nt, Artificial Sequence
  Description of Artificial Sequence: Synthetic oligonucleotide
gaacaccaagaggcuggg

SEQ ID NO: 55914 - RNA, 18 nt, Artificial Sequence
  Description of Artificial Sequence: Synthetic oligonucleotide
gggaugaacaccaagagg

SEQ ID NO: 55915 - RNA, 18 nt, Artificial Sequence
  Description of Artificial Sequence: Synthetic oligonucleotide
cuugagggaugaacacca

SEQ ID NO: 55916 - RNA, 18 nt, Artificial Sequence
  Description of Artificial Sequence: Synthetic oligonucleotide
ugcuucuugagggaugaa

SEQ ID NO: 55917 - RNA, 18 nt, Artificial Sequence
  Description of Artificial Sequence: Synthetic oligonucleotide
gccagugcuucuugaggg

SEQ ID NO: 55918 - RNA, 18 nt, Artificial Sequence
  Description of Artificial Sequence: Synthetic oligonucleotide
uuucugccagugcuucuu

SEQ ID NO: 55919 - RNA, 18 nt, Artificial Sequence
  Description of Artificial Sequence: Synthetic oligonucleotide
cuggguuucugccagugc

SEQ ID NO: 55920 - RNA, 18 nt, Artificial Sequence
  Description of Artificial Sequence: Synthetic oligonucleotide
gauuccuggguuucugcc

SEQ ID NO: 55921 - RNA, 18 nt, Artificial Sequence
  Description of Artificial Sequence: Synthetic oligonucleotide
aauuugauuccuggguuu

SEQ ID NO: 55922 - RNA, 18 nt, Artificial Sequence
  Description of Artificial Sequence: Synthetic oligonucleotide
ugcccaauuugauuccug

SEQ ID NO: 55923 - RNA, 18 nt, Artificial Sequence
  Description of Artificial Sequence: Synthetic oligonucleotide
uuuugugcccaauuugau

SEQ ID NO: 55924 - RNA, 18 nt, Artificial Sequence
  Description of Artificial Sequence: Synthetic oligonucleotide
accauuuuugugcccaau

SEQ ID NO: 55925 - RNA, 18 nt, Artificial Sequence
  Description of Artificial Sequence: Synthetic oligonucleotide
uccuuaccauuuuugugc

SEQ ID NO: 55926 - RNA, 18 nt, Artificial Sequence
  Description of Artificial Sequence: Synthetic oligonucleotide
ccauuuccuuaccauuuu

SEQ ID NO: 55927 - RNA, 18 nt, Artificial Sequence
  Description of Artificial Sequence: Synthetic oligonucleotide
cuuugccauuuccuuacc

SEQ ID NO: 55928 - RNA, 18 nt, Artificial Sequence
  Description of Artificial Sequence: Synthetic oligonucleotide
aaauacuuugccauuucc

SEQ ID NO: 55929 - RNA, 18 nt, Artificial Sequence
  Description of Artificial Sequence: Synthetic oligonucleotide
guucuaaauacuuugcca

SEQ ID NO: 55930 - RNA, 18 nt, Artificial Sequence
  Description of Artificial Sequence: Synthetic oligonucleotide
gcgaaguucuaaauacuu

SEQ ID NO: 55931 - RNA, 18 nt, Artificial Sequence
  Description of Artificial Sequence: Synthetic oligonucleotide
agcgggcgaaguucuaaa

SEQ ID NO: 55932 - RNA, 18 nt, Artificial Sequence
  Description of Artificial Sequence: Synthetic oligonucleotide
caauuagcgggcgaaguu

SEQ ID NO: 55933 - RNA, 18 nt, Artificial Sequence
  Description of Artificial Sequence: Synthetic oligonucleotide
aaacacaauuagcgggcg

SEQ ID NO: 55934 - RNA, 18 nt, Artificial Sequence
  Description of Artificial Sequence: Synthetic oligonucleotide
uggagaaacacaauuagc

SEQ ID NO: 55935 - RNA, 18 nt, Artificial Sequence
  Description of Artificial Sequence: Synthetic oligonucleotide
gucccuggagaaacacaa

SEQ ID NO: 55936 - RNA, 18 nt, Artificial Sequence
  Description of Artificial Sequence: Synthetic oligonucleotide
aaacagucccuggagaaa

SEQ ID NO: 55937 - RNA, 18 nt, Artificial Sequence
  Description of Artificial Sequence: Synthetic oligonucleotide
gaggaaaacagucccugg

SEQ ID NO: 55938 - RNA, 18 nt, Artificial Sequence
  Description of Artificial Sequence: Synthetic oligonucleotide
uguuugaggaaaacaguc

SEQ ID NO: 55939 - RNA, 18 nt, Artificial Sequence
  Description of Artificial Sequence: Synthetic oligonucleotide
gaggauguuugaggaaaa

SEQ ID NO: 55940 - RNA, 18 nt, Artificial Sequence
  Description of Artificial Sequence: Synthetic oligonucleotide
uuucagaggauguuugag

SEQ ID NO: 55941 - RNA, 18 nt, Artificial Sequence
  Description of Artificial Sequence: Synthetic oligonucleotide
caggauuucagaggaugu

SEQ ID NO: 55942 - RNA, 18 nt, Artificial Sequence
  Description of Artificial Sequence: Synthetic oligonucleotide
aggaccaggauuucagag

SEQ ID NO: 55943 - RNA, 18 nt, Artificial Sequence
  Description of Artificial Sequence: Synthetic oligonucleotide
gauauaggaccaggauuu

SEQ ID NO: 55944 - RNA, 18 nt, Artificial Sequence
  Description of Artificial Sequence: Synthetic oligonucleotide
cugcugauauaggaccag

SEQ ID NO: 55945 - RNA, 18 nt, Artificial Sequence
  Description of Artificial Sequence: Synthetic oligonucleotide
auucccugcugauauagg

SEQ ID NO: 55946 - RNA, 18 nt, Artificial Sequence
  Description of Artificial Sequence: Synthetic oligonucleotide
gccucauucccugcugau

SEQ ID NO: 55947 - RNA, 18 nt, Artificial Sequence
  Description of Artificial Sequence: Synthetic oligonucleotide
cuguggccucauucccug

SEQ ID NO: 55948 - RNA, 18 nt, Artificial Sequence
  Description of Artificial Sequence: Synthetic oligonucleotide
ucagucuguggccucauu

SEQ ID NO: 55949 - RNA, 18 nt, Artificial Sequence
  Description of Artificial Sequence: Synthetic oligonucleotide
ucucaucagucuguggcc

SEQ ID NO: 55950 - RNA, 18 nt, Artificial Sequence
  Description of Artificial Sequence: Synthetic oligonucleotide
uuuccucucaucagucug

SEQ ID NO: 55951 - RNA, 18 nt, Artificial Sequence
  Description of Artificial Sequence: Synthetic oligonucleotide
uaaaauuuccucucauca

SEQ ID NO: 55952 - RNA, 18 nt, Artificial Sequence
  Description of Artificial Sequence: Synthetic oligonucleotide
uaaaauaaaauuuccucu

SEQ ID NO: 55953 - RNA, 18 nt, Artificial Sequence
  Description of Artificial Sequence: Synthetic oligonucleotide
auagcuaaaauaaaauuu

SEQ ID NO: 55954 - RNA, 18 nt, Artificial Sequence
  Description of Artificial Sequence: Synthetic oligonucleotide
uggaaauagcuaaaauaa

SEQ ID NO: 55955 - RNA, 18 nt, Artificial Sequence
  Description of Artificial Sequence: Synthetic oligonucleotide
aaauguggaaauagcuaa

SEQ ID NO: 55956 - RNA, 18 nt, Artificial Sequence
  Description of Artificial Sequence: Synthetic oligonucleotide
gagaaaaauguggaaaua

SEQ ID NO: 55957 - RNA, 18 nt, Artificial Sequence
  Description of Artificial Sequence: Synthetic oligonucleotide
ugaaugagaaaaaugugg

SEQ ID NO: 55958 - RNA, 18 nt, Artificial Sequence
  Description of Artificial Sequence: Synthetic oligonucleotide
ggaccugaaugagaaaaa

SEQ ID NO: 55959 - RNA, 18 nt, Artificial Sequence
  Description of Artificial Sequence: Synthetic oligonucleotide
uuagaggaccugaaugag

SEQ ID NO: 55960 - RNA, 18 nt, Artificial Sequence
  Description of Artificial Sequence: Synthetic oligonucleotide
ccacauuagaggaccuga

SEQ ID NO: 55961 - RNA, 18 nt, Artificial Sequence
  Description of Artificial Sequence: Synthetic oligonucleotide
acuaaccacauuagagga

SEQ ID NO: 55962 - RNA, 18 nt, Artificial Sequence
  Description of Artificial Sequence: Synthetic oligonucleotide
ccacaacuaaccacauua

SEQ ID NO: 55963 - RNA, 18 nt, Artificial Sequence
  Description of Artificial Sequence: Synthetic oligonucleotide
ucaggccacaacuaacca

SEQ ID NO: 55964 - RNA, 18 nt, Artificial Sequence
  Description of Artificial Sequence: Synthetic oligonucleotide
cauuuucaggccacaacu

SEQ ID NO: 55965 - RNA, 18 nt, Artificial Sequence
  Description of Artificial Sequence: Synthetic oligonucleotide
aauaucauuuucaggcca

SEQ ID NO: 55966 - RNA, 18 nt, Artificial Sequence
  Description of Artificial Sequence: Synthetic oligonucleotide
uuggaaauaucauuuuca

SEQ ID NO: 55967 - RNA, 18 nt, Artificial Sequence
  Description of Artificial Sequence: Synthetic oligonucleotide
uucauuuggaaauaucau

SEQ ID NO: 55968 - RNA, 18 nt, Artificial Sequence
  Description of Artificial Sequence: Synthetic oligonucleotide
uccuauucauuuggaaau

SEQ ID NO: 55969 - RNA, 18 nt, Artificial Sequence
  Description of Artificial Sequence: Synthetic oligonucleotide
uuccuuccuauucauuug

SEQ ID NO: 55970 - RNA, 18 nt, Artificial Sequence
  Description of Artificial Sequence: Synthetic oligonucleotide
uuuccuuccuuccuauuc

SEQ ID NO: 55971 - RNA, 18 nt, Artificial Sequence
  Description of Artificial Sequence: Synthetic oligonucleotide
aacaauuuccuuccuucc

SEQ ID NO: 55972 - RNA, 18 nt, Artificial Sequence
  Description of Artificial Sequence: Synthetic oligonucleotide
acaaaaacaauuuccuuc

SEQ ID NO: 55973 - RNA, 18 nt, Artificial Sequence
  Description of Artificial Sequence: Synthetic oligonucleotide
aaacaacaaaaacaauuu

SEQ ID NO: 55974 - RNA, 18 nt, Artificial Sequence
  Description of Artificial Sequence: Synthetic oligonucleotide
aucuuaaacaacaaaaac

SEQ ID NO: 55975 - RNA, 18 nt, Artificial Sequence
  Description of Artificial Sequence: Synthetic oligonucleotide
cuuccaucuuaaacaaca

SEQ ID NO: 55976 - RNA, 18 nt, Artificial Sequence
  Description of Artificial Sequence: Synthetic oligonucleotide
auuuccuuccaucuuaaa

SEQ ID NO: 55977 - RNA, 18 nt, Artificial Sequence
  Description of Artificial Sequence: Synthetic oligonucleotide
ccuauauuuccuuccauc

SEQ ID NO: 55978 - RNA, 18 nt, Artificial Sequence
  Description of Artificial Sequence: Synthetic oligonucleotide
augcaccuauauuuccuu

SEQ ID NO: 55979 - RNA, 18 nt, Artificial Sequence
  Description of Artificial Sequence: Synthetic oligonucleotide
uuuaaaugcaccuauauu

SEQ ID NO: 55980 - RNA, 18 nt, Artificial Sequence
  Description of Artificial Sequence: Synthetic oligonucleotide
cauuuuuuaaaugcaccu

SEQ ID NO: 55981 - RNA, 18 nt, Artificial Sequence
  Description of Artificial Sequence: Synthetic oligonucleotide
agcuccauuuuuuaaaug

SEQ ID NO: 55982 - RNA, 18 nt, Artificial Sequence
  Description of Artificial Sequence: Synthetic oligonucleotide
aaccaagcuccauuuuuu

SEQ ID NO: 55983 - RNA, 18 nt, Artificial Sequence
  Description of Artificial Sequence: Synthetic oligonucleotide
caugcaaccaagcuccau

SEQ ID NO: 55984 - RNA, 18 nt, Artificial Sequence
  Description of Artificial Sequence: Synthetic oligonucleotide
aaaaucaugcaaccaagc

SEQ ID NO: 55985 - RNA, 18 nt, Artificial Sequence
  Description of Artificial Sequence: Synthetic oligonucleotide
gagcgaaaaucaugcaac

SEQ ID NO: 55986 - RNA, 18 nt, Artificial Sequence
  Description of Artificial Sequence: Synthetic oligonucleotide
cucaagagcgaaaaucau

SEQ ID NO: 55987 - RNA, 18 nt, Artificial Sequence
  Description of Artificial Sequence: Synthetic oligonucleotide
gaugacucaagagcgaaa

SEQ ID NO: 55988 - RNA, 18 nt, Artificial Sequence
  Description of Artificial Sequence: Synthetic oligonucleotide
ggcuagaugacucaagag

SEQ ID NO: 55989 - RNA, 18 nt, Artificial Sequence
  Description of Artificial Sequence: Synthetic oligonucleotide
uagagggcuagaugacuc

SEQ ID NO: 55990 - RNA, 18 nt, Artificial Sequence
  Description of Artificial Sequence: Synthetic oligonucleotide
aucauuagagggcuagau

SEQ ID NO: 55991 - RNA, 18 nt, Artificial Sequence
  Description of Artificial Sequence: Synthetic oligonucleotide
aggcaaucauuagagggc

SEQ ID NO: 55992 - RNA, 18 nt, Artificial Sequence
  Description of Artificial Sequence: Synthetic oligonucleotide
guaugaggcaaucauuag

SEQ ID NO: 55993 - RNA, 18 nt, Artificial Sequence
  Description of Artificial Sequence: Synthetic oligonucleotide
caccgguaugaggcaauc

SEQ ID NO: 55994 - RNA, 18 nt, Artificial Sequence
  Description of Artificial Sequence: Synthetic oligonucleotide
guaaucaccgguaugagg

SEQ ID NO: 55995 - RNA, 18 nt, Artificial Sequence
  Description of Artificial Sequence: Synthetic oligonucleotide
cgcucguaaucaccggua

SEQ ID NO: 55996 - RNA, 18 nt, Artificial Sequence
  Description of Artificial Sequence: Synthetic oligonucleotide
aaagccgcucguaaucac

SEQ ID NO: 55997 - RNA, 18 nt, Artificial Sequence
  Description of Artificial Sequence: Synthetic oligonucleotide
caugaaaagccgcucgua

SEQ ID NO: 55998 - RNA, 18 nt, Artificial Sequence
  Description of Artificial Sequence: Synthetic oligonucleotide
gggucaugaaaagccgcu

SEQ ID NO: 55999 - RNA, 18 nt, Artificial Sequence
  Description of Artificial Sequence: Synthetic oligonucleotide
aaaugguacauauggaag

SEQ ID NO: 56000 - RNA, 18 nt, Artificial Sequence
  Description of Artificial Sequence: Synthetic oligonucleotide
uuuuaaaaugguacauau

SEQ ID NO: 56001 - RNA, 18 nt, Artificial Sequence
  Description of Artificial Sequence: Synthetic oligonucleotide
cagcauuuuaaaauggua

SEQ ID NO: 56002 - RNA, 18 nt, Artificial Sequence
  Description of Artificial Sequence: Synthetic oligonucleotide
guaaucagcauuuuaaaa

SEQ ID NO: 56003 - RNA, 18 nt, Artificial Sequence
  Description of Artificial Sequence: Synthetic oligonucleotide
aagaaguaaucagcauuu

SEQ ID NO: 56004 - RNA, 18 nt, Artificial Sequence
  Description of Artificial Sequence: Synthetic oligonucleotide
uucucaagaaguaaucag

SEQ ID NO: 56005 - RNA, 18 nt, Artificial Sequence
  Description of Artificial Sequence: Synthetic oligonucleotide
ucuuauucucaagaagua

SEQ ID NO: 56006 - RNA, 18 nt, Artificial Sequence
  Description of Artificial Sequence: Synthetic oligonucleotide
gcuucucuuauucucaag

SEQ ID NO: 56007 - RNA, 18 nt, Artificial Sequence
  Description of Artificial Sequence: Synthetic oligonucleotide
auuaggcuucucuuauuc

SEQ ID NO: 56008 - RNA, 18 nt, Artificial Sequence
  Description of Artificial Sequence: Synthetic oligonucleotide
cugaaauuaggcuucucu

SEQ ID NO: 56009 - RNA, 18 nt, Artificial Sequence
  Description of Artificial Sequence: Synthetic oligonucleotide
auauucugaaauuaggcu

SEQ ID NO: 56010 - RNA, 18 nt, Artificial Sequence
  Description of Artificial Sequence: Synthetic oligonucleotide
uaaugauauucugaaauu

SEQ ID NO: 56011 - RNA, 18 nt, Artificial Sequence
  Description of Artificial Sequence: Synthetic oligonucleotide
uacccuaaugauauucug

SEQ ID NO: 56012 - RNA, 18 nt, Artificial Sequence
  Description of Artificial Sequence: Synthetic oligonucleotide
auagguacccuaaugaua

SEQ ID NO: 56013 - RNA, 18 nt, Artificial Sequence
  Description of Artificial Sequence: Synthetic oligonucleotide
cuucaauagguacccuaa

SEQ ID NO: 56014 - RNA, 18 nt, Artificial Sequence
  Description of Artificial Sequence: Synthetic oligonucleotide
caagacuucaauagguac

SEQ ID NO: 56015 - RNA, 18 nt, Artificial Sequence
  Description of Artificial Sequence: Synthetic oligonucleotide
gcagucaagacuucaaua

SEQ ID NO: 56016 - RNA, 18 nt, Artificial Sequence
  Description of Artificial Sequence: Synthetic oligonucleotide
uaugugcagucaagacuu

SEQ ID NO: 56017 - RNA, 18 nt, Artificial Sequence
  Description of Artificial Sequence: Synthetic oligonucleotide
cuaaauaugugcagucaa

SEQ ID NO: 56018 - RNA, 18 nt, Artificial Sequence
  Description of Artificial Sequence: Synthetic oligonucleotide
guaugcuaaauaugugca

SEQ ID NO: 56019 - RNA, 18 nt, Artificial Sequence
  Description of Artificial Sequence: Synthetic oligonucleotide
agggaguaugcuaaauau

SEQ ID NO: 56020 - RNA, 18 nt, Artificial Sequence
  Description of Artificial Sequence: Synthetic oligonucleotide
uucccagggaguaugcua

SEQ ID NO: 56021 - RNA, 18 nt, Artificial Sequence
  Description of Artificial Sequence: Synthetic oligonucleotide
uauaauucccagggagua

SEQ ID NO: 56022 - RNA, 18 nt, Artificial Sequence
  Description of Artificial Sequence: Synthetic oligonucleotide
uaaaauauaauucccagg

SEQ ID NO: 56023 - RNA, 18 nt, Artificial Sequence
  Description of Artificial Sequence: Synthetic oligonucleotide
guccuuaaaauauaauuc

SEQ ID NO: 56024 - RNA, 18 nt, Artificial Sequence
  Description of Artificial Sequence: Synthetic oligonucleotide
aaaauguccuuaaaauau

SEQ ID NO: 56025 - RNA, 18 nt, Artificial Sequence
  Description of Artificial Sequence: Synthetic oligonucleotide
auagaaaaauguccuuaa

SEQ ID NO: 56026 - RNA, 18 nt, Artificial Sequence
  Description of Artificial Sequence: Synthetic oligonucleotide
auuuaauagaaaaauguc

SEQ ID NO: 56027 - RNA, 18 nt, Artificial Sequence
  Description of Artificial Sequence: Synthetic oligonucleotide
caaugauuuaauagaaaa

SEQ ID NO: 56028 - RNA, 18 nt, Artificial Sequence
  Description of Artificial Sequence: Synthetic oligonucleotide
auaugcaaugauuuaaua

SEQ ID NO: 56029 - RNA, 18 nt, Artificial Sequence
  Description of Artificial Sequence: Synthetic oligonucleotide
cuuccauaugcaaugauu

SEQ ID NO: 56030 - RNA, 18 nt, Artificial Sequence
  Description of Artificial Sequence: Synthetic oligonucleotide
aguuucuuccauaugcaa

SEQ ID NO: 56031 - RNA, 18 nt, Artificial Sequence
  Description of Artificial Sequence: Synthetic oligonucleotide
uauugaguuucuuccaua

SEQ ID NO: 56032 - RNA, 18 nt, Artificial Sequence
  Description of Artificial Sequence: Synthetic oligonucleotide
uauuauauugaguuucuu

SEQ ID NO: 56033 - RNA, 18 nt, Artificial Sequence
  Description of Artificial Sequence: Synthetic oligonucleotide
ucagcuauuauauugagu

SEQ ID NO: 56034 - RNA, 18 nt, Artificial Sequence
  Description of Artificial Sequence: Synthetic oligonucleotide
aaauaucagcuauuauau

SEQ ID NO: 56035 - RNA, 18 nt, Artificial Sequence
  Description of Artificial Sequence: Synthetic oligonucleotide
caaguaaauaucagcuau

SEQ ID NO: 56036 - RNA, 18 nt, Artificial Sequence
  Description of Artificial Sequence: Synthetic oligonucleotide
gaacccaaguaaauauca

SEQ ID NO: 56037 - RNA, 18 nt, Artificial Sequence
  Description of Artificial Sequence: Synthetic oligonucleotide
auuaagaacccaaguaaa

SEQ ID NO: 56038 - RNA, 18 nt, Artificial Sequence
  Description of Artificial Sequence: Synthetic oligonucleotide
uucugauuaagaacccaa

SEQ ID NO: 56039 - RNA, 18 nt, Artificial Sequence
  Description of Artificial Sequence: Synthetic oligonucleotide
caauguucugauuaagaa

SEQ ID NO: 56040 - RNA, 18 nt, Artificial Sequence
  Description of Artificial Sequence: Synthetic oligonucleotide
acagccaauguucugauu

SEQ ID NO: 56041 - RNA, 18 nt, Artificial Sequence
  Description of Artificial Sequence: Synthetic oligonucleotide
aucacacagccaauguuc

SEQ ID NO: 56042 - RNA, 18 nt, Artificial Sequence
  Description of Artificial Sequence: Synthetic oligonucleotide
ugaaaaucacacagccaa

SEQ ID NO: 56043 - RNA, 18 nt, Artificial Sequence
  Description of Artificial Sequence: Synthetic oligonucleotide
aaucaugaaaaucacaca

SEQ ID NO: 56044 - RNA, 18 nt, Artificial Sequence
  Description of Artificial Sequence: Synthetic oligonucleotide
aucauaaucaugaaaauc

SEQ ID NO: 56045 - RNA, 18 nt, Artificial Sequence
  Description of Artificial Sequence: Synthetic oligonucleotide
ugaaaaucauaaucauga

SEQ ID NO: 56046 - RNA, 18 nt, Artificial Sequence
  Description of Artificial Sequence: Synthetic oligonucleotide
ugcaaugaaaaucauaau

SEQ ID NO: 56047 - RNA, 18 nt, Artificial Sequence
  Description of Artificial Sequence: Synthetic oligonucleotide
uuaauugcaaugaaaauc

SEQ ID NO: 56048 - RNA, 18 nt, Artificial Sequence
  Description of Artificial Sequence: Synthetic oligonucleotide
ucaacuuaauugcaauga

SEQ ID NO: 56049 - RNA, 18 nt, Artificial Sequence
  Description of Artificial Sequence: Synthetic oligonucleotide
aaacaucaacuuaauugc

SEQ ID NO: 56050 - RNA, 18 nt, Artificial Sequence
  Description of Artificial Sequence: Synthetic oligonucleotide
cuacaaaacaucaacuua

SEQ ID NO: 56051 - RNA, 18 nt, Artificial Sequence
  Description of Artificial Sequence: Synthetic oligonucleotide
acugucuacaaaacauca

SEQ ID NO: 56052 - RNA, 18 nt, Artificial Sequence
  Description of Artificial Sequence: Synthetic oligonucleotide
auuucacugucuacaaaa

SEQ ID NO: 56053 - RNA, 18 nt, Artificial Sequence
  Description of Artificial Sequence: Synthetic oligonucleotide
ugguaauuucacugucua

SEQ ID NO: 56054 - RNA, 18 nt, Artificial Sequence
  Description of Artificial Sequence: Synthetic oligonucleotide
guagaugguaauuucacu

SEQ ID NO: 56055 - RNA, 18 nt, Artificial Sequence
  Description of Artificial Sequence: Synthetic oligonucleotide
uuggaguagaugguaauu

SEQ ID NO: 56056 - RNA, 18 nt, Artificial Sequence
  Description of Artificial Sequence: Synthetic oligonucleotide
aucuuuuggaguagaugg

SEQ ID NO: 56057 - RNA, 18 nt, Artificial Sequence
  Description of Artificial Sequence: Synthetic oligonucleotide
uugcaaucuuuuggagua

SEQ ID NO: 56058 - RNA, 18 nt, Artificial Sequence
  Description of Artificial Sequence: Synthetic oligonucleotide
cuauuuugcaaucuuuug

SEQ ID NO: 56059 - RNA, 18 nt, Artificial Sequence
  Description of Artificial Sequence: Synthetic oligonucleotide
aaauucuauuuugcaauc

SEQ ID NO: 56060 - RNA, 18 nt, Artificial Sequence
  Description of Artificial Sequence: Synthetic oligonucleotide
agguuaaauucuauuuug

SEQ ID NO: 56061 - RNA, 18 nt, Artificial Sequence
  Description of Artificial Sequence: Synthetic oligonucleotide
cucuaagguuaaauucua

SEQ ID NO: 56062 - RNA, 18 nt, Artificial Sequence
  Description of Artificial Sequence: Synthetic oligonucleotide
auuggcucuaagguuaaa

SEQ ID NO: 56063 - RNA, 18 nt, Artificial Sequence
  Description of Artificial Sequence: Synthetic oligonucleotide
ccugcauuggcucuaagg

SEQ ID NO: 56064 - RNA, 18 nt, Artificial Sequence
  Description of Artificial Sequence: Synthetic oligonucleotide
uuuucccugcauuggcuc

SEQ ID NO: 56065 - RNA, 18 nt, Artificial Sequence
  Description of Artificial Sequence: Synthetic oligonucleotide
acaaguuuucccugcauu

SEQ ID NO: 56066 - RNA, 18 nt, Artificial Sequence
  Description of Artificial Sequence: Synthetic oligonucleotide
cagaaacaaguuuucccu

SEQ ID NO: 56067 - RNA, 18 nt, Artificial Sequence
  Description of Artificial Sequence: Synthetic oligonucleotide
accugcagaaacaaguuu

SEQ ID NO: 56068 - RNA, 18 nt, Artificial Sequence
  Description of Artificial Sequence: Synthetic oligonucleotide
aaugcaccugcagaaaca

SEQ ID NO: 56069 - RNA, 18 nt, Artificial Sequence
  Description of Artificial Sequence: Synthetic oligonucleotide
caaaaaaugcaccugcag

SEQ ID NO: 56070 - RNA, 18 nt, Artificial Sequence
  Description of Artificial Sequence: Synthetic oligonucleotide
aguuucaaaaaaugcacc

SEQ ID NO: 56071 - RNA, 18 nt, Artificial Sequence
  Description of Artificial Sequence: Synthetic oligonucleotide
guugaaguuucaaaaaau

SEQ ID NO: 56072 - RNA, 18 nt, Artificial Sequence
  Description of Artificial Sequence: Synthetic oligonucleotide
uaucuguugaaguuucaa

SEQ ID NO: 56073 - RNA, 18 nt, Artificial Sequence
  Description of Artificial Sequence: Synthetic oligonucleotide
ccugcuaucuguugaagu

SEQ ID NO: 56074 - RNA, 18 nt, Artificial Sequence
  Description of Artificial Sequence: Synthetic oligonucleotide
uucccccugcuaucuguu

SEQ ID NO: 56075 - RNA, 18 nt, Artificial Sequence
  Description of Artificial Sequence: Synthetic oligonucleotide
uuuuuuucccccugcuau

SEQ ID NO: 56076 - RNA, 18 nt, Artificial Sequence
  Description of Artificial Sequence: Synthetic oligonucleotide
ucacuuuuuuuucccccu

SEQ ID NO: 56077 - RNA, 18 nt, Artificial Sequence
  Description of Artificial Sequence: Synthetic oligonucleotide
uucugucacuuuuuuuuc

SEQ ID NO: 56078 - RNA, 18 nt, Artificial Sequence
  Description of Artificial Sequence: Synthetic oligonucleotide
gauccuucugucacuuuu

SEQ ID NO: 56079 - RNA, 18 nt, Artificial Sequence
  Description of Artificial Sequence: Synthetic oligonucleotide
acugugauccuucuguca

SEQ ID NO: 56080 - RNA, 18 nt, Artificial Sequence
  Description of Artificial Sequence: Synthetic oligonucleotide
gcugaacugugauccuuc

SEQ ID NO: 56081 - RNA, 18 nt, Artificial Sequence
  Description of Artificial Sequence: Synthetic oligonucleotide
auacugcugaacugugau

SEQ ID NO: 56082 - RNA, 18 nt, Artificial Sequence
  Description of Artificial Sequence: Synthetic oligonucleotide
aauucauacugcugaacu

SEQ ID NO: 56083 - RNA, 18 nt, Artificial Sequence
  Description of Artificial Sequence: Synthetic oligonucleotide
cagacaauucauacugcu

SEQ ID NO: 56084 - RNA, 18 nt, Artificial Sequence
  Description of Artificial Sequence: Synthetic oligonucleotide
gccagcagacaauucaua

SEQ ID NO: 56085 - RNA, 18 nt, Artificial Sequence
  Description of Artificial Sequence: Synthetic oligonucleotide
aggcugccagcagacaau

SEQ ID NO: 56086 - RNA, 18 nt, Artificial Sequence
  Description of Artificial Sequence: Synthetic oligonucleotide
uugcaaggcugccagcag

SEQ ID NO: 56087 - RNA, 18 nt, Artificial Sequence
  Description of Artificial Sequence: Synthetic oligonucleotide
ccagauugcaaggcugcc

SEQ ID NO: 56088 - RNA, 18 nt, Artificial Sequence
  Description of Artificial Sequence: Synthetic oligonucleotide
gcacaccagauugcaagg

SEQ ID NO: 56089 - RNA, 18 nt, Artificial Sequence
  Description of Artificial Sequence: Synthetic oligonucleotide
ugccugcacaccagauug

SEQ ID NO: 56090 - RNA, 18 nt, Artificial Sequence
  Description of Artificial Sequence: Synthetic oligonucleotide
cucacugccugcacacca

SEQ ID NO: 56091 - RNA, 18 nt, Artificial Sequence
  Description of Artificial Sequence: Synthetic oligonucleotide
acaaucucacugccugca

SEQ ID NO: 56092 - RNA, 18 nt, Artificial Sequence
  Description of Artificial Sequence: Synthetic oligonucleotide
acaccacaaucucacugc

SEQ ID NO: 56093 - RNA, 18 nt, Artificial Sequence
  Description of Artificial Sequence: Synthetic oligonucleotide
cauguacaccacaaucuc

SEQ ID NO: 56094 - RNA, 18 nt, Artificial Sequence
  Description of Artificial Sequence: Synthetic oligonucleotide
ggugacauguacaccaca

SEQ ID NO: 56095 - RNA, 18 nt, Artificial Sequence
  Description of Artificial Sequence: Synthetic oligonucleotide
aaucaggugacauguaca

SEQ ID NO: 56096 - RNA, 18 nt, Artificial Sequence
  Description of Artificial Sequence: Synthetic oligonucleotide
uguaguccugguggcaug

SEQ ID NO: 56097 - RNA, 18 nt, Artificial Sequence
  Description of Artificial Sequence: Synthetic oligonucleotide
gccccuguaguccuggug

SEQ ID NO: 56098 - RNA, 18 nt, Artificial Sequence
  Description of Artificial Sequence: Synthetic oligonucleotide
acucugccccuguagucc

SEQ ID NO: 56099 - RNA, 18 nt, Artificial Sequence
  Description of Artificial Sequence: Synthetic oligonucleotide
gagacacucugccccugu

SEQ ID NO: 56100 - RNA, 18 nt, Artificial Sequence
  Description of Artificial Sequence: Synthetic oligonucleotide
cagaggagacacucugcc

SEQ ID NO: 56101 - RNA, 18 nt, Artificial Sequence
  Description of Artificial Sequence: Synthetic oligonucleotide
gcugccagaggagacacu

SEQ ID NO: 56102 - RNA, 18 nt, Artificial Sequence
  Description of Artificial Sequence: Synthetic oligonucleotide
ucagagcugccagaggag

SEQ ID NO: 56103 - RNA, 18 nt, Artificial Sequence
  Description of Artificial Sequence: Synthetic oligonucleotide
ugaucucagagcugccag

SEQ ID NO: 56104 - RNA, 18 nt, Artificial Sequence
  Description of Artificial Sequence: Synthetic oligonucleotide
ggauuugaucucagagcu

SEQ ID NO: 56105 - RNA, 18 nt, Artificial Sequence
  Description of Artificial Sequence: Synthetic oligonucleotide
ucaucggauuugaucuca

SEQ ID NO: 56106 - RNA, 18 nt, Artificial Sequence
  Description of Artificial Sequence: Synthetic oligonucleotide
ccucgucaucggauuuga

SEQ ID NO: 56107 - RNA, 18 nt, Artificial Sequence
  Description of Artificial Sequence: Synthetic oligonucleotide
aucacccucgucaucgga

SEQ ID NO: 56108 - RNA, 18 nt, Artificial Sequence
  Description of Artificial Sequence: Synthetic oligonucleotide
uucucaucacccucguca

SEQ ID NO: 56109 - RNA, 18 nt, Artificial Sequence
  Description of Artificial Sequence: Synthetic oligonucleotide
gcagguucucaucacccu

SEQ ID NO: 56110 - RNA, 18 nt, Artificial Sequence
  Description of Artificial Sequence: Synthetic oligonucleotide
gucuugcagguucucauc

SEQ ID NO: 56111 - RNA, 18 nt, Artificial Sequence
  Description of Artificial Sequence: Synthetic oligonucleotide
uucgugucuugcagguuc

SEQ ID NO: 56112 - RNA, 18 nt, Artificial Sequence
  Description of Artificial Sequence: Synthetic oligonucleotide
aagauuucgugucuugca

SEQ ID NO: 56113 - RNA, 18 nt, Artificial Sequence
  Description of Artificial Sequence: Synthetic oligonucleotide
cuccgaagauuucguguc

SEQ ID NO: 56114 - RNA, 18 nt, Artificial Sequence
  Description of Artificial Sequence: Synthetic oligonucleotide
uuguccuccgaagauuuc

SEQ ID NO: 56115 - RNA, 18 nt, Artificial Sequence
  Description of Artificial Sequence: Synthetic oligonucleotide
auuucuuguccuccgaag

SEQ ID NO: 56116 - RNA, 18 nt, Artificial Sequence
  Description of Artificial Sequence: Synthetic oligonucleotide
aucuaauuucuuguccuc

SEQ ID NO: 56117 - RNA, 18 nt, Artificial Sequence
  Description of Artificial Sequence: Synthetic oligonucleotide
ucgucaucuaauuucuug

SEQ ID NO: 56118 - RNA, 18 nt, Artificial Sequence
  Description of Artificial Sequence: Synthetic oligonucleotide
ucuugucgucaucuaauu

SEQ ID NO: 56119 - RNA, 18 nt, Artificial Sequence
  Description of Artificial Sequence: Synthetic oligonucleotide
auccuucuugucgucauc

SEQ ID NO: 56120 - RNA, 18 nt, Artificial Sequence
  Description of Artificial Sequence: Synthetic oligonucleotide
uugauauccuucuugucg

SEQ ID NO: 56121 - RNA, 18 nt, Artificial Sequence
  Description of Artificial Sequence: Synthetic oligonucleotide
uugauuugauauccuucu

SEQ ID NO: 56122 - RNA, 18 nt, Artificial Sequence
  Description of Artificial Sequence: Synthetic oligonucleotide
aguaauugauuugauauc

SEQ ID NO: 56123 - RNA, 18 nt, Artificial Sequence
  Description of Artificial Sequence: Synthetic oligonucleotide
uucacgauggguccccac

SEQ ID NO: 56124 - RNA, 18 nt, Artificial Sequence
  Description of Artificial Sequence: Synthetic oligonucleotide
ccaucuucacgauggguc

SEQ ID NO: 56125 - RNA, 18 nt, Artificial Sequence
  Description of Artificial Sequence: Synthetic oligonucleotide
ccacgccaucuucacgau

SEQ ID NO: 56126 - RNA, 18 nt, Artificial Sequence
  Description of Artificial Sequence: Synthetic oligonucleotide
cagggccacgccaucuuc

SEQ ID NO: 56127 - RNA, 18 nt, Artificial Sequence
  Description of Artificial Sequence: Synthetic oligonucleotide
ccucucagggccacgcca

SEQ ID NO: 56128 - RNA, 18 nt, Artificial Sequence
  Description of Artificial Sequence: Synthetic oligonucleotide
ggcugccucucagggcca

SEQ ID NO: 56129 - RNA, 18 nt, Artificial Sequence
  Description of Artificial Sequence: Synthetic oligonucleotide
agaauggcugccucucag

SEQ ID NO: 56130 - RNA, 18 nt, Artificial Sequence
  Description of Artificial Sequence: Synthetic oligonucleotide
agaagagaauggcugccu

SEQ ID NO: 56131 - RNA, 18 nt, Artificial Sequence
  Description of Artificial Sequence: Synthetic oligonucleotide
uuggcagaagagaauggc

SEQ ID NO: 56132 - RNA, 18 nt, Artificial Sequence
  Description of Artificial Sequence: Synthetic oligonucleotide
cugguuuggcagaagaga

SEQ ID NO: 56133 - RNA, 18 nt, Artificial Sequence
  Description of Artificial Sequence: Synthetic oligonucleotide
ggaaccugguuuggcaga

SEQ ID NO: 56134 - RNA, 18 nt, Artificial Sequence
  Description of Artificial Sequence: Synthetic oligonucleotide
gaaccggaaccugguuug

SEQ ID NO: 56135 - RNA, 18 nt, Artificial Sequence
  Description of Artificial Sequence: Synthetic oligonucleotide
cuguggaaccggaaccug

SEQ ID NO: 56136 - RNA, 18 nt, Artificial Sequence
  Description of Artificial Sequence: Synthetic oligonucleotide
ggaagcuguggaaccgga

SEQ ID NO: 56137 - RNA, 18 nt, Artificial Sequence
  Description of Artificial Sequence: Synthetic oligonucleotide
ggacaggaagcuguggaa

SEQ ID NO: 56138 - RNA, 18 nt, Artificial Sequence
  Description of Artificial Sequence: Synthetic oligonucleotide
agacuggacaggaagcug

SEQ ID NO: 56139 - RNA, 18 nt, Artificial Sequence
  Description of Artificial Sequence: Synthetic oligonucleotide
gucgcagacuggacagga

SEQ ID NO: 56140 - RNA, 18 nt, Artificial Sequence
  Description of Artificial Sequence: Synthetic oligonucleotide
gggaagucgcagacugga

SEQ ID NO: 56141 - RNA, 18 nt, Artificial Sequence
  Description of Artificial Sequence: Synthetic oligonucleotide
gguggguucaggucaggg

SEQ ID NO: 56142 - RNA, 18 nt, Artificial Sequence
  Description of Artificial Sequence: Synthetic oligonucleotide
ggguggguucaggucagg

SEQ ID NO: 56143 - RNA, 18 nt, Artificial Sequence
  Description of Artificial Sequence: Synthetic oligonucleotide
cucuguaaggguccuggg

SEQ ID NO: 56144 - RNA, 18 nt, Artificial Sequence
  Description of Artificial Sequence: Synthetic oligonucleotide
gugcccuggugaggccaa

SEQ ID NO: 56145 - RNA, 18 nt, Artificial Sequence
  Description of Artificial Sequence: Synthetic oligonucleotide
cagaagugcccuggugag

SEQ ID NO: 56146 - RNA, 18 nt, Artificial Sequence
  Description of Artificial Sequence: Synthetic oligonucleotide
gaggucagaagugcccug

SEQ ID NO: 56147 - RNA, 18 nt, Artificial Sequence
  Description of Artificial Sequence: Synthetic oligonucleotide
aaagugaggucagaagug

SEQ ID NO: 56148 - RNA, 18 nt, Artificial Sequence
  Description of Artificial Sequence: Synthetic oligonucleotide
uugugaaagugaggucag

SEQ ID NO: 56149 - RNA, 18 nt, Artificial Sequence
  Description of Artificial Sequence: Synthetic oligonucleotide
uccuauugugaaagugag

SEQ ID NO: 56150 - RNA, 18 nt, Artificial Sequence
  Description of Artificial Sequence: Synthetic oligonucleotide
acugguccuauugugaaa

SEQ ID NO: 56151 - RNA, 18 nt, Artificial Sequence
  Description of Artificial Sequence: Synthetic oligonucleotide
ucaacacugguccuauug

SEQ ID NO: 56152 - RNA, 18 nt, Artificial Sequence
  Description of Artificial Sequence: Synthetic oligonucleotide
ggguaucaacacuggucc

SEQ ID NO: 56153 - RNA, 18 nt, Artificial Sequence
  Description of Artificial Sequence: Synthetic oligonucleotide
aggcuggguaucaacacu

SEQ ID NO: 56154 - RNA, 18 nt, Artificial Sequence
  Description of Artificial Sequence: Synthetic oligonucleotide
ccaagaggcuggguauca

SEQ ID NO: 56155 - RNA, 18 nt, Artificial Sequence
  Description of Artificial Sequence: Synthetic oligonucleotide
gaacaccaagaggcuggg

SEQ ID NO: 56156 - RNA, 18 nt, Artificial Sequence
  Description of Artificial Sequence: Synthetic oligonucleotide
gggaugaacaccaagagg

SEQ ID NO: 56157 - RNA, 18 nt, Artificial Sequence
  Description of Artificial Sequence: Synthetic oligonucleotide
cuugagggaugaacacca

SEQ ID NO: 56158 - RNA, 18 nt, Artificial Sequence
  Description of Artificial Sequence: Synthetic oligonucleotide
ugcuucuugagggaugaa

SEQ ID NO: 56159 - RNA, 18 nt, Artificial Sequence
  Description of Artificial Sequence: Synthetic oligonucleotide
gccagugcuucuugaggg

SEQ ID NO: 56160 - RNA, 18 nt, Artificial Sequence
  Description of Artificial Sequence: Synthetic oligonucleotide
uuucugccagugcuucuu

SEQ ID NO: 56161 - RNA, 18 nt, Artificial Sequence
  Description of Artificial Sequence: Synthetic oligonucleotide
cuggguuucugccagugc

SEQ ID NO: 56162 - RNA, 18 nt, Artificial Sequence
  Description of Artificial Sequence: Synthetic oligonucleotide
gauuccuggguuucugcc

SEQ ID NO: 56163 - RNA, 18 nt, Artificial Sequence
  Description of Artificial Sequence: Synthetic oligonucleotide
aauuugauuccuggguuu

SEQ ID NO: 56164 - RNA, 18 nt, Artificial Sequence
  Description of Artificial Sequence: Synthetic oligonucleotide
ugcccaauuugauuccug

SEQ ID NO: 56165 - RNA, 18 nt, Artificial Sequence
  Description of Artificial Sequence: Synthetic oligonucleotide
uuuugugcccaauuugau

SEQ ID NO: 56166 - RNA, 18 nt, Artificial Sequence
  Description of Artificial Sequence: Synthetic oligonucleotide
accauuuuugugcccaau

SEQ ID NO: 56167 - RNA, 18 nt, Artificial Sequence
  Description of Artificial Sequence: Synthetic oligonucleotide
uccuuaccauuuuugugc

SEQ ID NO: 56168 - RNA, 18 nt, Artificial Sequence
  Description of Artificial Sequence: Synthetic oligonucleotide
ccauuuccuuaccauuuu

SEQ ID NO: 56169 - RNA, 18 nt, Artificial Sequence
  Description of Artificial Sequence: Synthetic oligonucleotide
cuuugccauuuccuuacc

SEQ ID NO: 56170 - RNA, 18 nt, Artificial Sequence
  Description of Artificial Sequence: Synthetic oligonucleotide
aaauacuuugccauuucc

SEQ ID NO: 56171 - RNA, 18 nt, Artificial Sequence
  Description of Artificial Sequence: Synthetic oligonucleotide
guucuaaauacuuugcca

SEQ ID NO: 56172 - RNA, 18 nt, Artificial Sequence
  Description of Artificial Sequence: Synthetic oligonucleotide
gcgaaguucuaaauacuu

SEQ ID NO: 56173 - RNA, 18 nt, Artificial Sequence
  Description of Artificial Sequence: Synthetic oligonucleotide
agcgggcgaaguucuaaa

SEQ ID NO: 56174 - RNA, 18 nt, Artificial Sequence
  Description of Artificial Sequence: Synthetic oligonucleotide
caauuagcgggcgaaguu

SEQ ID NO: 56175 - RNA, 18 nt, Artificial Sequence
  Description of Artificial Sequence: Synthetic oligonucleotide
aaacacaauuagcgggcg

SEQ ID NO: 56176 - RNA, 18 nt, Artificial Sequence
  Description of Artificial Sequence: Synthetic oligonucleotide
uggagaaacacaauuagc

SEQ ID NO: 56177 - RNA, 18 nt, Artificial Sequence
  Description of Artificial Sequence: Synthetic oligonucleotide
gucccuggagaaacacaa

SEQ ID NO: 56178 - RNA, 18 nt, Artificial Sequence
  Description of Artificial Sequence: Synthetic oligonucleotide
aaacagucccuggagaaa

SEQ ID NO: 56179 - RNA, 18 nt, Artificial Sequence
  Description of Artificial Sequence: Synthetic oligonucleotide
gaggaaaacagucccugg

SEQ ID NO: 56180 - RNA, 18 nt, Artificial Sequence
  Description of Artificial Sequence: Synthetic oligonucleotide
uguuugaggaaaacaguc

SEQ ID NO: 56181 - RNA, 18 nt, Artificial Sequence
  Description of Artificial Sequence: Synthetic oligonucleotide
gaggauguuugaggaaaa

SEQ ID NO: 56182 - RNA, 18 nt, Artificial Sequence
  Description of Artificial Sequence: Synthetic oligonucleotide
uuucagaggauguuugag

SEQ ID NO: 56183 - RNA, 18 nt, Artificial Sequence
  Description of Artificial Sequence: Synthetic oligonucleotide
caggauuucagaggaugu

SEQ ID NO: 56184 - RNA, 18 nt, Artificial Sequence
  Description of Artificial Sequence: Synthetic oligonucleotide
aggaccaggauuucagag

SEQ ID NO: 56185 - RNA, 18 nt, Artificial Sequence
  Description of Artificial Sequence: Synthetic oligonucleotide
gauauaggaccaggauuu

SEQ ID NO: 56186 - RNA, 18 nt, Artificial Sequence
  Description of Artificial Sequence: Synthetic oligonucleotide
cugcugauauaggaccag

SEQ ID NO: 56187 - RNA, 18 nt, Artificial Sequence
  Description of Artificial Sequence: Synthetic oligonucleotide
auucccugcugauauagg

SEQ ID NO: 56188 - RNA, 18 nt, Artificial Sequence
  Description of Artificial Sequence: Synthetic oligonucleotide
gccucauucccugcugau

SEQ ID NO: 56189 - RNA, 18 nt, Artificial Sequence
  Description of Artificial Sequence: Synthetic oligonucleotide
cuguggccucauucccug

SEQ ID NO: 56190 - RNA, 18 nt, Artificial Sequence
  Description of Artificial Sequence: Synthetic oligonucleotide
ucagucuguggccucauu

SEQ ID NO: 56191 - RNA, 18 nt, Artificial Sequence
  Description of Artificial Sequence: Synthetic oligonucleotide
ucucaucagucuguggcc

SEQ ID NO: 56192 - RNA, 18 nt, Artificial Sequence
  Description of Artificial Sequence: Synthetic oligonucleotide
uuuccucucaucagucug

SEQ ID NO: 56193 - RNA, 18 nt, Artificial Sequence
  Description of Artificial Sequence: Synthetic oligonucleotide
uaaaauuuccucucauca

SEQ ID NO: 56194 - RNA, 18 nt, Artificial Sequence
  Description of Artificial Sequence: Synthetic oligonucleotide
uaaaauaaaauuuccucu

SEQ ID NO: 56195 - RNA, 18 nt, Artificial Sequence
  Description of Artificial Sequence: Synthetic oligonucleotide
auagcuaaaauaaaauuu

SEQ ID NO: 56196 - RNA, 18 nt, Artificial Sequence
  Description of Artificial Sequence: Synthetic oligonucleotide
uggaaauagcuaaaauaa

SEQ ID NO: 56197 - RNA, 18 nt, Artificial Sequence
  Description of Artificial Sequence: Synthetic oligonucleotide
aaauguggaaauagcuaa

SEQ ID NO: 56198 - RNA, 18 nt, Artificial Sequence
  Description of Artificial Sequence: Synthetic oligonucleotide
gagaaaaauguggaaaua

SEQ ID NO: 56199 - RNA, 18 nt, Artificial Sequence
  Description of Artificial Sequence: Synthetic oligonucleotide
ugaaugagaaaaaugugg

SEQ ID NO: 56200 - RNA, 18 nt, Artificial Sequence
  Description of Artificial Sequence: Synthetic oligonucleotide
ggaccugaaugagaaaaa

SEQ ID NO: 56201 - RNA, 18 nt, Artificial Sequence
  Description of Artificial Sequence: Synthetic oligonucleotide
uuagaggaccugaaugag

SEQ ID NO: 56202 - RNA, 18 nt, Artificial Sequence
  Description of Artificial Sequence: Synthetic oligonucleotide
ccacauuagaggaccuga

SEQ ID NO: 56203 - RNA, 18 nt, Artificial Sequence
  Description of Artificial Sequence: Synthetic oligonucleotide
acuaaccacauuagagga

SEQ ID NO: 56204 - RNA, 18 nt, Artificial Sequence
  Description of Artificial Sequence: Synthetic oligonucleotide
ccacaacuaaccacauua

SEQ ID NO: 56205 - RNA, 18 nt, Artificial Sequence
  Description of Artificial Sequence: Synthetic oligonucleotide
ucaggccacaacuaacca

SEQ ID NO: 56206 - RNA, 18 nt, Artificial Sequence
  Description of Artificial Sequence: Synthetic oligonucleotide
cauuuucaggccacaacu

SEQ ID NO: 56207 - RNA, 18 nt, Artificial Sequence
  Description of Artificial Sequence: Synthetic oligonucleotide
aauaucauuuucaggcca

SEQ ID NO: 56208 - RNA, 18 nt, Artificial Sequence
  Description of Artificial Sequence: Synthetic oligonucleotide
uuggaaauaucauuuuca

SEQ ID NO: 56209 - RNA, 18 nt, Artificial Sequence
  Description of Artificial Sequence: Synthetic oligonucleotide
uucauuuggaaauaucau

SEQ ID NO: 56210 - RNA, 18 nt, Artificial Sequence
  Description of Artificial Sequence: Synthetic oligonucleotide
uccuauucauuuggaaau

SEQ ID NO: 56211 - RNA, 18 nt, Artificial Sequence
  Description of Artificial Sequence: Synthetic oligonucleotide
uuccuuccuauucauuug

SEQ ID NO: 56212 - RNA, 18 nt, Artificial Sequence
  Description of Artificial Sequence: Synthetic oligonucleotide
uuuccuuccuuccuauuc

SEQ ID NO: 56213 - RNA, 18 nt, Artificial Sequence
  Description of Artificial Sequence: Synthetic oligonucleotide
aacaauuuccuuccuucc

SEQ ID NO: 56214 - RNA, 18 nt, Artificial Sequence
  Description of Artificial Sequence: Synthetic oligonucleotide
acaaaaacaauuuccuuc

SEQ ID NO: 56215 - RNA, 18 nt, Artificial Sequence
  Description of Artificial Sequence: Synthetic oligonucleotide
aaacaacaaaaacaauuu

SEQ ID NO: 56216 - RNA, 18 nt, Artificial Sequence
  Description of Artificial Sequence: Synthetic oligonucleotide
aucuuaaacaacaaaaac

SEQ ID NO: 56217 - RNA, 18 nt, Artificial Sequence
  Description of Artificial Sequence: Synthetic oligonucleotide
cuuccaucuuaaacaaca

SEQ ID NO: 56218 - RNA, 18 nt, Artificial Sequence
  Description of Artificial Sequence: Synthetic oligonucleotide
auuuccuuccaucuuaaa

SEQ ID NO: 56219 - RNA, 18 nt, Artificial Sequence
  Description of Artificial Sequence: Synthetic oligonucleotide
ccuauauuuccuuccauc

SEQ ID NO: 56220 - RNA, 18 nt, Artificial Sequence
  Description of Artificial Sequence: Synthetic oligonucleotide
augcaccuauauuuccuu

SEQ ID NO: 56221 - RNA, 18 nt, Artificial Sequence
  Description of Artificial Sequence: Synthetic oligonucleotide
uuuaaaugcaccuauauu

SEQ ID NO: 56222 - RNA, 18 nt, Artificial Sequence
  Description of Artificial Sequence: Synthetic oligonucleotide
cauuuuuuaaaugcaccu

SEQ ID NO: 56223 - RNA, 18 nt, Artificial Sequence
  Description of Artificial Sequence: Synthetic oligonucleotide
agcuccauuuuuuaaaug

SEQ ID NO: 56224 - RNA, 18 nt, Artificial Sequence
  Description of Artificial Sequence: Synthetic oligonucleotide
aaccaagcuccauuuuuu

SEQ ID NO: 56225 - RNA, 18 nt, Artificial Sequence
  Description of Artificial Sequence: Synthetic oligonucleotide
caugcaaccaagcuccau

SEQ ID NO: 56226 - RNA, 18 nt, Artificial Sequence
  Description of Artificial Sequence: Synthetic oligonucleotide
aaaaucaugcaaccaagc

SEQ ID NO: 56227 - RNA, 18 nt, Artificial Sequence
  Description of Artificial Sequence: Synthetic oligonucleotide
gagcgaaaaucaugcaac

SEQ ID NO: 56228 - RNA, 18 nt, Artificial Sequence
  Description of Artificial Sequence: Synthetic oligonucleotide
cucaagagcgaaaaucau

SEQ ID NO: 56229 - RNA, 18 nt, Artificial Sequence
  Description of Artificial Sequence: Synthetic oligonucleotide
gaugacucaagagcgaaa

SEQ ID NO: 56230 - RNA, 18 nt, Artificial Sequence
  Description of Artificial Sequence: Synthetic oligonucleotide
ggcuagaugacucaagag

SEQ ID NO: 56231 - RNA, 18 nt, Artificial Sequence
  Description of Artificial Sequence: Synthetic oligonucleotide
uagagggcuagaugacuc

SEQ ID NO: 56232 - RNA, 18 nt, Artificial Sequence
  Description of Artificial Sequence: Synthetic oligonucleotide
aucauuagagggcuagau

SEQ ID NO: 56233 - RNA, 18 nt, Artificial Sequence
  Description of Artificial Sequence: Synthetic oligonucleotide
aggcaaucauuagagggc

SEQ ID NO: 56234 - RNA, 18 nt, Artificial Sequence
  Description of Artificial Sequence: Synthetic oligonucleotide
guaugaggcaaucauuag

SEQ ID NO: 56235 - RNA, 18 nt, Artificial Sequence
  Description of Artificial Sequence: Synthetic oligonucleotide
caccgguaugaggcaauc

SEQ ID NO: 56236 - RNA, 18 nt, Artificial Sequence
  Description of Artificial Sequence: Synthetic oligonucleotide
guaaucaccgguaugagg

SEQ ID NO: 56237 - RNA, 18 nt, Artificial Sequence
  Description of Artificial Sequence: Synthetic oligonucleotide
cgcucguaaucaccggua

SEQ ID NO: 56238 - RNA, 18 nt, Artificial Sequence
  Description of Artificial Sequence: Synthetic oligonucleotide
aaagccgcucguaaucac

SEQ ID NO: 56239 - RNA, 18 nt, Artificial Sequence
  Description of Artificial Sequence: Synthetic oligonucleotide
caugaaaagccgcucgua

SEQ ID NO: 56240 - RNA, 18 nt, Artificial Sequence
  Description of Artificial Sequence: Synthetic oligonucleotide
gggucaugaaaagccgcu

SEQ ID NO: 56241 - RNA, 18 nt, Artificial Sequence
  Description of Artificial Sequence: Synthetic oligonucleotide
aaaugguacauauggaag

SEQ ID NO: 56242 - RNA, 18 nt, Artificial Sequence
  Description of Artificial Sequence: Synthetic oligonucleotide
uuuuaaaaugguacauau

SEQ ID NO: 56243 - RNA, 18 nt, Artificial Sequence
  Description of Artificial Sequence: Synthetic oligonucleotide
cagcauuuuaaaauggua

SEQ ID NO: 56244 - RNA, 18 nt, Artificial Sequence
  Description of Artificial Sequence: Synthetic oligonucleotide
guaaucagcauuuuaaaa

SEQ ID NO: 56245 - RNA, 18 nt, Artificial Sequence
  Description of Artificial Sequence: Synthetic oligonucleotide
aagaaguaaucagcauuu

SEQ ID NO: 56246 - RNA, 18 nt, Artificial Sequence
  Description of Artificial Sequence: Synthetic oligonucleotide
uucucaagaaguaaucag

SEQ ID NO: 56247 - RNA, 18 nt, Artificial Sequence
  Description of Artificial Sequence: Synthetic oligonucleotide
ucuuauucucaagaagua

SEQ ID NO: 56248 - RNA, 18 nt, Artificial Sequence
  Description of Artificial Sequence: Synthetic oligonucleotide
gcuucucuuauucucaag

SEQ ID NO: 56249 - RNA, 18 nt, Artificial Sequence
  Description of Artificial Sequence: Synthetic oligonucleotide
auuaggcuucucuuauuc

SEQ ID NO: 56250 - RNA, 18 nt, Artificial Sequence
  Description of Artificial Sequence: Synthetic oligonucleotide
cugaaauuaggcuucucu

SEQ ID NO: 56251 - RNA, 18 nt, Artificial Sequence
  Description of Artificial Sequence: Synthetic oligonucleotide
auauucugaaauuaggcu

SEQ ID NO: 56252 - RNA, 18 nt, Artificial Sequence
  Description of Artificial Sequence: Synthetic oligonucleotide
uaaugauauucugaaauu

SEQ ID NO: 56253 - RNA, 18 nt, Artificial Sequence
  Description of Artificial Sequence: Synthetic oligonucleotide
uacccuaaugauauucug

SEQ ID NO: 56254 - RNA, 18 nt, Artificial Sequence
  Description of Artificial Sequence: Synthetic oligonucleotide
auagguacccuaaugaua

SEQ ID NO: 56255 - RNA, 18 nt, Artificial Sequence
  Description of Artificial Sequence: Synthetic oligonucleotide
cuucaauagguacccuaa

SEQ ID NO: 56256 - RNA, 18 nt, Artificial Sequence
  Description of Artificial Sequence: Synthetic oligonucleotide
caagacuucaauagguac

SEQ ID NO: 56257 - RNA, 18 nt, Artificial Sequence
  Description of Artificial Sequence: Synthetic oligonucleotide
gcagucaagacuucaaua

SEQ ID NO: 56258 - RNA, 18 nt, Artificial Sequence
  Description of Artificial Sequence: Synthetic oligonucleotide
uaugugcagucaagacuu

SEQ ID NO: 56259 - RNA, 18 nt, Artificial Sequence
  Description of Artificial Sequence: Synthetic oligonucleotide
cuaaauaugugcagucaa

SEQ ID NO: 56260 - RNA, 18 nt, Artificial Sequence
  Description of Artificial Sequence: Synthetic oligonucleotide
guaugcuaaauaugugca

SEQ ID NO: 56261 - RNA, 18 nt, Artificial Sequence
  Description of Artificial Sequence: Synthetic oligonucleotide
agggaguaugcuaaauau

SEQ ID NO: 56262 - RNA, 18 nt, Artificial Sequence
  Description of Artificial Sequence: Synthetic oligonucleotide
uucccagggaguaugcua

SEQ ID NO: 56263 - RNA, 18 nt, Artificial Sequence
  Description of Artificial Sequence: Synthetic oligonucleotide
uauaauucccagggagua

SEQ ID NO: 56264 - RNA, 18 nt, Artificial Sequence
  Description of Artificial Sequence: Synthetic oligonucleotide
uaaaauauaauucccagg

SEQ ID NO: 56265 - RNA, 18 nt, Artificial Sequence
  Description of Artificial Sequence: Synthetic oligonucleotide
guccuuaaaauauaauuc

SEQ ID NO: 56266 - RNA, 18 nt, Artificial Sequence
  Description of Artificial Sequence: Synthetic oligonucleotide
aaaauguccuuaaaauau

SEQ ID NO: 56267 - RNA, 18 nt, Artificial Sequence
  Description of Artificial Sequence: Synthetic oligonucleotide
auagaaaaauguccuuaa

SEQ ID NO: 56268 - RNA, 18 nt, Artificial Sequence
  Description of Artificial Sequence: Synthetic oligonucleotide
auuuaauagaaaaauguc

SEQ ID NO: 56269 - RNA, 18 nt, Artificial Sequence
  Description of Artificial Sequence: Synthetic oligonucleotide
caaugauuuaauagaaaa

SEQ ID NO: 56270 - RNA, 18 nt, Artificial Sequence
  Description of Artificial Sequence: Synthetic oligonucleotide
auaugcaaugauuuaaua

SEQ ID NO: 56271 - RNA, 18 nt, Artificial Sequence
  Description of Artificial Sequence: Synthetic oligonucleotide
cuuccauaugcaaugauu

SEQ ID NO: 56272 - RNA, 18 nt, Artificial Sequence
  Description of Artificial Sequence: Synthetic oligonucleotide
aguuucuuccauaugcaa

SEQ ID NO: 56273 - RNA, 18 nt, Artificial Sequence
  Description of Artificial Sequence: Synthetic oligonucleotide
uauugaguuucuuccaua

SEQ ID NO: 56274 - RNA, 18 nt, Artificial Sequence
  Description of Artificial Sequence: Synthetic oligonucleotide
uauuauauugaguuucuu

SEQ ID NO: 56275 - RNA, 18 nt, Artificial Sequence
  Description of Artificial Sequence: Synthetic oligonucleotide
ucagcuauuauauugagu

SEQ ID NO: 56276 - RNA, 18 nt, Artificial Sequence
  Description of Artificial Sequence: Synthetic oligonucleotide
aaauaucagcuauuauau

SEQ ID NO: 56277 - RNA, 18 nt, Artificial Sequence
  Description of Artificial Sequence: Synthetic oligonucleotide
caaguaaauaucagcuau

SEQ ID NO: 56278 - RNA, 18 nt, Artificial Sequence
  Description of Artificial Sequence: Synthetic oligonucleotide
gaacccaaguaaauauca

SEQ ID NO: 56279 - RNA, 18 nt, Artificial Sequence
  Description of Artificial Sequence: Synthetic oligonucleotide
auuaagaacccaaguaaa

SEQ ID NO: 56280 - RNA, 18 nt, Artificial Sequence
  Description of Artificial Sequence: Synthetic oligonucleotide
uucugauuaagaacccaa

SEQ ID NO: 56281 - RNA, 18 nt, Artificial Sequence
  Description of Artificial Sequence: Synthetic oligonucleotide
caauguucugauuaagaa

SEQ ID NO: 56282 - RNA, 18 nt, Artificial Sequence
  Description of Artificial Sequence: Synthetic oligonucleotide
acagccaauguucugauu

SEQ ID NO: 56283 - RNA, 18 nt, Artificial Sequence
  Description of Artificial Sequence: Synthetic oligonucleotide
aucacacagccaauguuc

SEQ ID NO: 56284 - RNA, 18 nt, Artificial Sequence
  Description of Artificial Sequence: Synthetic oligonucleotide
ugaaaaucacacagccaa

SEQ ID NO: 56285 - RNA, 18 nt, Artificial Sequence
  Description of Artificial Sequence: Synthetic oligonucleotide
aaucaugaaaaucacaca

SEQ ID NO: 56286 - RNA, 18 nt, Artificial Sequence
  Description of Artificial Sequence: Synthetic oligonucleotide
aucauaaucaugaaaauc

SEQ ID NO: 56287 - RNA, 18 nt, Artificial Sequence
  Description of Artificial Sequence: Synthetic oligonucleotide
ugaaaaucauaaucauga

SEQ ID NO: 56288 - RNA, 18 nt, Artificial Sequence
  Description of Artificial Sequence: Synthetic oligonucleotide
ugcaaugaaaaucauaau

SEQ ID NO: 56289 - RNA, 18 nt, Artificial Sequence
  Description of Artificial Sequence: Synthetic oligonucleotide
uuaauugcaaugaaaauc

SEQ ID NO: 56290 - RNA, 18 nt, Artificial Sequence
  Description of Artificial Sequence: Synthetic oligonucleotide
ucaacuuaauugcaauga

SEQ ID NO: 56291 - RNA, 18 nt, Artificial Sequence
  Description of Artificial Sequence: Synthetic oligonucleotide
aaacaucaacuuaauugc

SEQ ID NO: 56292 - RNA, 18 nt, Artificial Sequence
  Description of Artificial Sequence: Synthetic oligonucleotide
cuacaaaacaucaacuua

SEQ ID NO: 56293 - RNA, 18 nt, Artificial Sequence
  Description of Artificial Sequence: Synthetic oligonucleotide
acugucuacaaaacauca

SEQ ID NO: 56294 - RNA, 18 nt, Artificial Sequence
  Description of Artificial Sequence: Synthetic oligonucleotide
auuucacugucuacaaaa

SEQ ID NO: 56295 - RNA, 18 nt, Artificial Sequence
  Description of Artificial Sequence: Synthetic oligonucleotide
ugguaauuucacugucua

SEQ ID NO: 56296 - RNA, 18 nt, Artificial Sequence
  Description of Artificial Sequence: Synthetic oligonucleotide
guagaugguaauuucacu

SEQ ID NO: 56297 - RNA, 18 nt, Artificial Sequence
  Description of Artificial Sequence: Synthetic oligonucleotide
uuggaguagaugguaauu

SEQ ID NO: 56298 - RNA, 18 nt, Artificial Sequence
  Description of Artificial Sequence: Synthetic oligonucleotide
aucuuuuggaguagaugg

SEQ ID NO: 56299 - RNA, 18 nt, Artificial Sequence
  Description of Artificial Sequence: Synthetic oligonucleotide
uugcaaucuuuuggagua

SEQ ID NO: 56300 - RNA, 18 nt, Artificial Sequence
  Description of Artificial Sequence: Synthetic oligonucleotide
cuauuuugcaaucuuuug

SEQ ID NO: 56301 - RNA, 18 nt, Artificial Sequence
  Description of Artificial Sequence: Synthetic oligonucleotide
aaauucuauuuugcaauc

SEQ ID NO: 56302 - RNA, 18 nt, Artificial Sequence
  Description of Artificial Sequence: Synthetic oligonucleotide
agguuaaauucuauuuug

SEQ ID NO: 56303 - RNA, 18 nt, Artificial Sequence
  Description of Artificial Sequence: Synthetic oligonucleotide
cucuaagguuaaauucua

SEQ ID NO: 56304 - RNA, 18 nt, Artificial Sequence
  Description of Artificial Sequence: Synthetic oligonucleotide
auuggcucuaagguuaaa

SEQ ID NO: 56305 - RNA, 18 nt, Artificial Sequence
  Description of Artificial Sequence: Synthetic oligonucleotide
ccugcauuggcucuaagg

SEQ ID NO: 56306 - RNA, 18 nt, Artificial Sequence
  Description of Artificial Sequence: Synthetic oligonucleotide
uuuucccugcauuggcuc

SEQ ID NO: 56307 - RNA, 18 nt, Artificial Sequence
  Description of Artificial Sequence: Synthetic oligonucleotide
acaaguuuucccugcauu

SEQ ID NO: 56308 - RNA, 18 nt, Artificial Sequence
  Description of Artificial Sequence: Synthetic oligonucleotide
cagaaacaaguuuucccu

SEQ ID NO: 56309 - RNA, 18 nt, Artificial Sequence
  Description of Artificial Sequence: Synthetic oligonucleotide
accugcagaaacaaguuu

SEQ ID NO: 56310 - RNA, 18 nt, Artificial Sequence
  Description of Artificial Sequence: Synthetic oligonucleotide
aaugcaccugcagaaaca

SEQ ID NO: 56311 - RNA, 18 nt, Artificial Sequence
  Description of Artificial Sequence: Synthetic oligonucleotide
caaaaaaugcaccugcag

SEQ ID NO: 56312 - RNA, 18 nt, Artificial Sequence
  Description of Artificial Sequence: Synthetic oligonucleotide
aguuucaaaaaaugcacc

SEQ ID NO: 56313 - RNA, 18 nt, Artificial Sequence
  Description of Artificial Sequence: Synthetic oligonucleotide
guugaaguuucaaaaaau

SEQ ID NO: 56314 - RNA, 18 nt, Artificial Sequence
  Description of Artificial Sequence: Synthetic oligonucleotide
uaucuguugaaguuucaa

SEQ ID NO: 56315 - RNA, 18 nt, Artificial Sequence
  Description of Artificial Sequence: Synthetic oligonucleotide
ccugcuaucuguugaagu

SEQ ID NO: 56316 - RNA, 18 nt, Artificial Sequence
  Description of Artificial Sequence: Synthetic oligonucleotide
uucccccugcuaucuguu

SEQ ID NO: 56317 - RNA, 18 nt, Artificial Sequence
  Description of Artificial Sequence: Synthetic oligonucleotide
uuuuuuucccccugcuau

SEQ ID NO: 56318 - RNA, 18 nt, Artificial Sequence
  Description of Artificial Sequence: Synthetic oligonucleotide
ucacuuuuuuuucccccu

SEQ ID NO: 56319 - RNA, 18 nt, Artificial Sequence
  Description of Artificial Sequence: Synthetic oligonucleotide
uucugucacuuuuuuuuc

SEQ ID NO: 56320 - RNA, 18 nt, Artificial Sequence
  Description of Artificial Sequence: Synthetic oligonucleotide
gauccuucugucacuuuu

SEQ ID NO: 56321 - RNA, 18 nt, Artificial Sequence
  Description of Artificial Sequence: Synthetic oligonucleotide
acugugauccuucuguca

SEQ ID NO: 56322 - RNA, 18 nt, Artificial Sequence
  Description of Artificial Sequence: Synthetic oligonucleotide
gcugaacugugauccuuc

SEQ ID NO: 56323 - RNA, 18 nt, Artificial Sequence
  Description of Artificial Sequence: Synthetic oligonucleotide
auacugcugaacugugau

SEQ ID NO: 56324 - RNA, 18 nt, Artificial Sequence
  Description of Artificial Sequence: Synthetic oligonucleotide
aauucauacugcugaacu

SEQ ID NO: 56325 - RNA, 18 nt, Artificial Sequence
  Description of Artificial Sequence: Synthetic oligonucleotide
cagacaauucauacugcu

SEQ ID NO: 56326 - RNA, 18 nt, Artificial Sequence
  Description of Artificial Sequence: Synthetic oligonucleotide
gccagcagacaauucaua

SEQ ID NO: 56327 - RNA, 18 nt, Artificial Sequence
  Description of Artificial Sequence: Synthetic oligonucleotide
aggcugccagcagacaau

SEQ ID NO: 56328 - RNA, 18 nt, Artificial Sequence
  Description of Artificial Sequence: Synthetic oligonucleotide
uugcaaggcugccagcag

SEQ ID NO: 56329 - RNA, 18 nt, Artificial Sequence
  Description of Artificial Sequence: Synthetic oligonucleotide
ccagauugcaaggcugcc

SEQ ID NO: 56330 - RNA, 18 nt, Artificial Sequence
  Description of Artificial Sequence: Synthetic oligonucleotide
gcacaccagauugcaagg

SEQ ID NO: 56331 - RNA, 18 nt, Artificial Sequence
  Description of Artificial Sequence: Synthetic oligonucleotide
ugccugcacaccagauug

SEQ ID NO: 56332 - RNA, 18 nt, Artificial Sequence
  Description of Artificial Sequence: Synthetic oligonucleotide
cucacugccugcacacca

SEQ ID NO: 56333 - RNA, 18 nt, Artificial Sequence
  Description of Artificial Sequence: Synthetic oligonucleotide
acaaucucacugccugca

SEQ ID NO: 56334 - RNA, 18 nt, Artificial Sequence
  Description of Artificial Sequence: Synthetic oligonucleotide
acaccacaaucucacugc

SEQ ID NO: 56335 - RNA, 18 nt, Artificial Sequence
  Description of Artificial Sequence: Synthetic oligonucleotide
cauguacaccacaaucuc

SEQ ID NO: 56336 - RNA, 18 nt, Artificial Sequence
  Description of Artificial Sequence: Synthetic oligonucleotide
ggugacauguacaccaca

SEQ ID NO: 56337 - RNA, 18 nt, Artificial Sequence
  Description of Artificial Sequence: Synthetic oligonucleotide
aaucaggugacauguaca

SEQ ID NO: 56338 - RNA, 18 nt, Artificial Sequence
  Description of Artificial Sequence: Synthetic oligonucleotide
uguaguccugguggcaug

SEQ ID NO: 56339 - RNA, 18 nt, Artificial Sequence
  Description of Artificial Sequence: Synthetic oligonucleotide
gccccuguaguccuggug

SEQ ID NO: 56340 - RNA, 18 nt, Artificial Sequence
  Description of Artificial Sequence: Synthetic oligonucleotide
acucugccccuguagucc

SEQ ID NO: 56341 - RNA, 18 nt, Artificial Sequence
  Description of Artificial Sequence: Synthetic oligonucleotide
gagacacucugccccugu

SEQ ID NO: 56342 - RNA, 18 nt, Artificial Sequence
  Description of Artificial Sequence: Synthetic oligonucleotide
cagaggagacacucugcc

SEQ ID NO: 56343 - RNA, 18 nt, Artificial Sequence
  Description of Artificial Sequence: Synthetic oligonucleotide
gcugccagaggagacacu

SEQ ID NO: 56344 - RNA, 18 nt, Artificial Sequence
  Description of Artificial Sequence: Synthetic oligonucleotide
ucagagcugccagaggag

SEQ ID NO: 56345 - RNA, 18 nt, Artificial Sequence
  Description of Artificial Sequence: Synthetic oligonucleotide
ugaucucagagcugccag

SEQ ID NO: 56346 - RNA, 18 nt, Artificial Sequence
  Description of Artificial Sequence: Synthetic oligonucleotide
ggauuugaucucagagcu

SEQ ID NO: 56347 - RNA, 18 nt, Artificial Sequence
  Description of Artificial Sequence: Synthetic oligonucleotide
ucaucggauuugaucuca

SEQ ID NO: 56348 - RNA, 18 nt, Artificial Sequence
  Description of Artificial Sequence: Synthetic oligonucleotide
ccucgucaucggauuuga

SEQ ID NO: 56349 - RNA, 18 nt, Artificial Sequence
  Description of Artificial Sequence: Synthetic oligonucleotide
aucacccucgucaucgga

SEQ ID NO: 56350 - RNA, 18 nt, Artificial Sequence
  Description of Artificial Sequence: Synthetic oligonucleotide
uucucaucacccucguca

SEQ ID NO: 56351 - RNA, 18 nt, Artificial Sequence
  Description of Artificial Sequence: Synthetic oligonucleotide
gcagguucucaucacccu

SEQ ID NO: 56352 - RNA, 18 nt, Artificial Sequence
  Description of Artificial Sequence: Synthetic oligonucleotide
gucuugcagguucucauc

SEQ ID NO: 56353 - RNA, 18 nt, Artificial Sequence
  Description of Artificial Sequence: Synthetic oligonucleotide
uucgugucuugcagguuc

SEQ ID NO: 56354 - RNA, 18 nt, Artificial Sequence
  Description of Artificial Sequence: Synthetic oligonucleotide
aagauuucgugucuugca

SEQ ID NO: 56355 - RNA, 18 nt, Artificial Sequence
  Description of Artificial Sequence: Synthetic oligonucleotide
cuccgaagauuucguguc

SEQ ID NO: 56356 - RNA, 18 nt, Artificial Sequence
  Description of Artificial Sequence: Synthetic oligonucleotide
uuguccuccgaagauuuc

SEQ ID NO: 56357 - RNA, 18 nt, Artificial Sequence
  Description of Artificial Sequence: Synthetic oligonucleotide
auuucuuguccuccgaag

SEQ ID NO: 56358 - RNA, 18 nt, Artificial Sequence
  Description of Artificial Sequence: Synthetic oligonucleotide
aucuaauuucuuguccuc

SEQ ID NO: 56359 - RNA, 18 nt, Artificial Sequence
  Description of Artificial Sequence: Synthetic oligonucleotide
ucgucaucuaauuucuug

SEQ ID NO: 56360 - RNA, 18 nt, Artificial Sequence
  Description of Artificial Sequence: Synthetic oligonucleotide
ucuugucgucaucuaauu

SEQ ID NO: 56361 - RNA, 18 nt, Artificial Sequence
  Description of Artificial Sequence: Synthetic oligonucleotide
auccuucuugucgucauc

SEQ ID NO: 56362 - RNA, 18 nt, Artificial Sequence
  Description of Artificial Sequence: Synthetic oligonucleotide
uugauauccuucuugucg

SEQ ID NO: 56363 - RNA, 18 nt, Artificial Sequence
  Description of Artificial Sequence: Synthetic oligonucleotide
uugauuugauauccuucu

SEQ ID NO: 56364 - RNA, 18 nt, Artificial Sequence
  Description of Artificial Sequence: Synthetic oligonucleotide
aguaauugauuugauauc

SEQ ID NO: 56365 - RNA, 18 nt, Artificial Sequence
  Description of Artificial Sequence: Synthetic oligonucleotide
gaccuaguaauugauuug

SEQ ID NO: 56366 - RNA, 18 nt, Artificial Sequence
  Description of Artificial Sequence: Synthetic oligonucleotide
aucuugaccuaguaauug

SEQ ID NO: 56367 - RNA, 18 nt, Artificial Sequence
  Description of Artificial Sequence: Synthetic oligonucleotide
uucacgauggguccccac

SEQ ID NO: 56368 - RNA, 18 nt, Artificial Sequence
  Description of Artificial Sequence: Synthetic oligonucleotide
ccaucuucacgauggguc

SEQ ID NO: 56369 - RNA, 18 nt, Artificial Sequence
  Description of Artificial Sequence: Synthetic oligonucleotide
ccacgccaucuucacgau

SEQ ID NO: 56370 - RNA, 18 nt, Artificial Sequence
  Description of Artificial Sequence: Synthetic oligonucleotide
cagggccacgccaucuuc

SEQ ID NO: 56371 - RNA, 18 nt, Artificial Sequence
  Description of Artificial Sequence: Synthetic oligonucleotide
ccucucagggccacgcca

SEQ ID NO: 56372 - RNA, 18 nt, Artificial Sequence
  Description of Artificial Sequence: Synthetic oligonucleotide
ggcugccucucagggcca

SEQ ID NO: 56373 - RNA, 18 nt, Artificial Sequence
  Description of Artificial Sequence: Synthetic oligonucleotide
agaauggcugccucucag

SEQ ID NO: 56374 - RNA, 18 nt, Artificial Sequence
  Description of Artificial Sequence: Synthetic oligonucleotide
agaagagaauggcugccu

SEQ ID NO: 56375 - RNA, 18 nt, Artificial Sequence
  Description of Artificial Sequence: Synthetic oligonucleotide
uuggcagaagagaauggc

SEQ ID NO: 56376 - RNA, 18 nt, Artificial Sequence
  Description of Artificial Sequence: Synthetic oligonucleotide
cugguuuggcagaagaga

SEQ ID NO: 56377 - RNA, 18 nt, Artificial Sequence
  Description of Artificial Sequence: Synthetic oligonucleotide
ggaaccugguuuggcaga

SEQ ID NO: 56378 - RNA, 18 nt, Artificial Sequence
  Description of Artificial Sequence: Synthetic oligonucleotide
gaaccggaaccugguuug

SEQ ID NO: 56379 - RNA, 18 nt, Artificial Sequence
  Description of Artificial Sequence: Synthetic oligonucleotide
cuguggaaccggaaccug

SEQ ID NO: 56380 - RNA, 18 nt, Artificial Sequence
  Description of Artificial Sequence: Synthetic oligonucleotide
ggaagcuguggaaccgga

SEQ ID NO: 56381 - RNA, 18 nt, Artificial Sequence
  Description of Artificial Sequence: Synthetic oligonucleotide
ggacaggaagcuguggaa

SEQ ID NO: 56382 - RNA, 18 nt, Artificial Sequence
  Description of Artificial Sequence: Synthetic oligonucleotide
agacuggacaggaagcug

SEQ ID NO: 56383 - RNA, 18 nt, Artificial Sequence
  Description of Artificial Sequence: Synthetic oligonucleotide
gucgcagacuggacagga

SEQ ID NO: 56384 - RNA, 18 nt, Artificial Sequence
  Description of Artificial Sequence: Synthetic oligonucleotide
gggaagucgcagacugga

SEQ ID NO: 56385 - RNA, 18 nt, Artificial Sequence
  Description of Artificial Sequence: Synthetic oligonucleotide
gguggguucaggucaggg

SEQ ID NO: 56386 - RNA, 18 nt, Artificial Sequence
  Description of Artificial Sequence: Synthetic oligonucleotide
ggguggguucaggucagg

SEQ ID NO: 56387 - RNA, 18 nt, Artificial Sequence
  Description of Artificial Sequence: Synthetic oligonucleotide
cucuguaaggguccuggg

SEQ ID NO: 56388 - RNA, 18 nt, Artificial Sequence
  Description of Artificial Sequence: Synthetic oligonucleotide
gugcccuggugaggccaa

SEQ ID NO: 56389 - RNA, 18 nt, Artificial Sequence
  Description of Artificial Sequence: Synthetic oligonucleotide
cagaagugcccuggugag

SEQ ID NO: 56390 - RNA, 18 nt, Artificial Sequence
  Description of Artificial Sequence: Synthetic oligonucleotide
gaggucagaagugcccug

SEQ ID NO: 56391 - RNA, 18 nt, Artificial Sequence
  Description of Artificial Sequence: Synthetic oligonucleotide
aaagugaggucagaagug

SEQ ID NO: 56392 - RNA, 18 nt, Artificial Sequence
  Description of Artificial Sequence: Synthetic oligonucleotide
uugugaaagugaggucag

SEQ ID NO: 56393 - RNA, 18 nt, Artificial Sequence
  Description of Artificial Sequence: Synthetic oligonucleotide
uccuauugugaaagugag

SEQ ID NO: 56394 - RNA, 18 nt, Artificial Sequence
  Description of Artificial Sequence: Synthetic oligonucleotide
acugguccuauugugaaa

SEQ ID NO: 56395 - RNA, 18 nt, Artificial Sequence
  Description of Artificial Sequence: Synthetic oligonucleotide
ucaacacugguccuauug

SEQ ID NO: 56396 - RNA, 18 nt, Artificial Sequence
  Description of Artificial Sequence: Synthetic oligonucleotide
ggguaucaacacuggucc

SEQ ID NO: 56397 - RNA, 18 nt, Artificial Sequence
  Description of Artificial Sequence: Synthetic oligonucleotide
aggcuggguaucaacacu

SEQ ID NO: 56398 - RNA, 18 nt, Artificial Sequence
  Description of Artificial Sequence: Synthetic oligonucleotide
ccaagaggcuggguauca

SEQ ID NO: 56399 - RNA, 18 nt, Artificial Sequence
  Description of Artificial Sequence: Synthetic oligonucleotide
gaacaccaagaggcuggg

SEQ ID NO: 56400 - RNA, 18 nt, Artificial Sequence
  Description of Artificial Sequence: Synthetic oligonucleotide
gggaugaacaccaagagg

SEQ ID NO: 56401 - RNA, 18 nt, Artificial Sequence
  Description of Artificial Sequence: Synthetic oligonucleotide
cuugagggaugaacacca

SEQ ID NO: 56402 - RNA, 18 nt, Artificial Sequence
  Description of Artificial Sequence: Synthetic oligonucleotide
ugcuucuugagggaugaa

SEQ ID NO: 56403 - RNA, 18 nt, Artificial Sequence
  Description of Artificial Sequence: Synthetic oligonucleotide
gccagugcuucuugaggg

SEQ ID NO: 56404 - RNA, 18 nt, Artificial Sequence
  Description of Artificial Sequence: Synthetic oligonucleotide
uuucugccagugcuucuu

SEQ ID NO: 56405 - RNA, 18 nt, Artificial Sequence
  Description of Artificial Sequence: Synthetic oligonucleotide
cuggguuucugccagugc

SEQ ID NO: 56406 - RNA, 18 nt, Artificial Sequence
  Description of Artificial Sequence: Synthetic oligonucleotide
gauuccuggguuucugcc

SEQ ID NO: 56407 - RNA, 18 nt, Artificial Sequence
  Description of Artificial Sequence: Synthetic oligonucleotide
aauuugauuccuggguuu

SEQ ID NO: 56408 - RNA, 18 nt, Artificial Sequence
  Description of Artificial Sequence: Synthetic oligonucleotide
ugcccaauuugauuccug

SEQ ID NO: 56409 - RNA, 18 nt, Artificial Sequence
  Description of Artificial Sequence: Synthetic oligonucleotide
uuuugugcccaauuugau

SEQ ID NO: 56410 - RNA, 18 nt, Artificial Sequence
  Description of Artificial Sequence: Synthetic oligonucleotide
accauuuuugugcccaau

SEQ ID NO: 56411 - RNA, 18 nt, Artificial Sequence
  Description of Artificial Sequence: Synthetic oligonucleotide
uccuuaccauuuuugugc

SEQ ID NO: 56412 - RNA, 18 nt, Artificial Sequence
  Description of Artificial Sequence: Synthetic oligonucleotide
ccauuuccuuaccauuuu

SEQ ID NO: 56413 - RNA, 18 nt, Artificial Sequence
  Description of Artificial Sequence: Synthetic oligonucleotide
cuuugccauuuccuuacc

SEQ ID NO: 56414 - RNA, 18 nt, Artificial Sequence
  Description of Artificial Sequence: Synthetic oligonucleotide
aaauacuuugccauuucc

SEQ ID NO: 56415 - RNA, 18 nt, Artificial Sequence
  Description of Artificial Sequence: Synthetic oligonucleotide
guucuaaauacuuugcca

SEQ ID NO: 56416 - RNA, 18 nt, Artificial Sequence
  Description of Artificial Sequence: Synthetic oligonucleotide
gcgaaguucuaaauacuu

SEQ ID NO: 56417 - RNA, 18 nt, Artificial Sequence
  Description of Artificial Sequence: Synthetic oligonucleotide
agcgggcgaaguucuaaa

SEQ ID NO: 56418 - RNA, 18 nt, Artificial Sequence
  Description of Artificial Sequence: Synthetic oligonucleotide
caauuagcgggcgaaguu

SEQ ID NO: 56419 - RNA, 18 nt, Artificial Sequence
  Description of Artificial Sequence: Synthetic oligonucleotide
aaacacaauuagcgggcg

SEQ ID NO: 56420 - RNA, 18 nt, Artificial Sequence
  Description of Artificial Sequence: Synthetic oligonucleotide
uggagaaacacaauuagc

SEQ ID NO: 56421 - RNA, 18 nt, Artificial Sequence
  Description of Artificial Sequence: Synthetic oligonucleotide
gucccuggagaaacacaa

SEQ ID NO: 56422 - RNA, 18 nt, Artificial Sequence
  Description of Artificial Sequence: Synthetic oligonucleotide
aaacagucccuggagaaa

SEQ ID NO: 56423 - RNA, 18 nt, Artificial Sequence
  Description of Artificial Sequence: Synthetic oligonucleotide
gaggaaaacagucccugg

SEQ ID NO: 56424 - RNA, 18 nt, Artificial Sequence
  Description of Artificial Sequence: Synthetic oligonucleotide
uguuugaggaaaacaguc

SEQ ID NO: 56425 - RNA, 18 nt, Artificial Sequence
  Description of Artificial Sequence: Synthetic oligonucleotide
gaggauguuugaggaaaa

SEQ ID NO: 56426 - RNA, 18 nt, Artificial Sequence
  Description of Artificial Sequence: Synthetic oligonucleotide
uuucagaggauguuugag

SEQ ID NO: 56427 - RNA, 18 nt, Artificial Sequence
  Description of Artificial Sequence: Synthetic oligonucleotide
caggauuucagaggaugu

SEQ ID NO: 56428 - RNA, 18 nt, Artificial Sequence
  Description of Artificial Sequence: Synthetic oligonucleotide
aggaccaggauuucagag

SEQ ID NO: 56429 - RNA, 18 nt, Artificial Sequence
  Description of Artificial Sequence: Synthetic oligonucleotide
gauauaggaccaggauuu

SEQ ID NO: 56430 - RNA, 18 nt, Artificial Sequence
  Description of Artificial Sequence: Synthetic oligonucleotide
cugcugauauaggaccag

SEQ ID NO: 56431 - RNA, 18 nt, Artificial Sequence
  Description of Artificial Sequence: Synthetic oligonucleotide
auucccugcugauauagg

SEQ ID NO: 56432 - RNA, 18 nt, Artificial Sequence
  Description of Artificial Sequence: Synthetic oligonucleotide
gccucauucccugcugau

SEQ ID NO: 56433 - RNA, 18 nt, Artificial Sequence
  Description of Artificial Sequence: Synthetic oligonucleotide
cuguggccucauucccug

SEQ ID NO: 56434 - RNA, 18 nt, Artificial Sequence
  Description of Artificial Sequence: Synthetic oligonucleotide
ucagucuguggccucauu

SEQ ID NO: 56435 - RNA, 18 nt, Artificial Sequence
  Description of Artificial Sequence: Synthetic oligonucleotide
ucucaucagucuguggcc

SEQ ID NO: 56436 - RNA, 18 nt, Artificial Sequence
  Description of Artificial Sequence: Synthetic oligonucleotide
uuuccucucaucagucug

SEQ ID NO: 56437 - RNA, 18 nt, Artificial Sequence
  Description of Artificial Sequence: Synthetic oligonucleotide
uaaaauuuccucucauca

SEQ ID NO: 56438 - RNA, 18 nt, Artificial Sequence
  Description of Artificial Sequence: Synthetic oligonucleotide
uaaaauaaaauuuccucu

SEQ ID NO: 56439 - RNA, 18 nt, Artificial Sequence
  Description of Artificial Sequence: Synthetic oligonucleotide
auagcuaaaauaaaauuu

SEQ ID NO: 56440 - RNA, 18 nt, Artificial Sequence
  Description of Artificial Sequence: Synthetic oligonucleotide
uggaaauagcuaaaauaa

SEQ ID NO: 56441 - RNA, 18 nt, Artificial Sequence
  Description of Artificial Sequence: Synthetic oligonucleotide
aaauguggaaauagcuaa

SEQ ID NO: 56442 - RNA, 18 nt, Artificial Sequence
  Description of Artificial Sequence: Synthetic oligonucleotide
gagaaaaauguggaaaua

SEQ ID NO: 56443 - RNA, 18 nt, Artificial Sequence
  Description of Artificial Sequence: Synthetic oligonucleotide
ugaaugagaaaaaugugg

SEQ ID NO: 56444 - RNA, 18 nt, Artificial Sequence
  Description of Artificial Sequence: Synthetic oligonucleotide
ggaccugaaugagaaaaa

SEQ ID NO: 56445 - RNA, 18 nt, Artificial Sequence
  Description of Artificial Sequence: Synthetic oligonucleotide
uuagaggaccugaaugag

SEQ ID NO: 56446 - RNA, 18 nt, Artificial Sequence
  Description of Artificial Sequence: Synthetic oligonucleotide
ccacauuagaggaccuga

SEQ ID NO: 56447 - RNA, 18 nt, Artificial Sequence
  Description of Artificial Sequence: Synthetic oligonucleotide
acuaaccacauuagagga

SEQ ID NO: 56448 - RNA, 18 nt, Artificial Sequence
  Description of Artificial Sequence: Synthetic oligonucleotide
ccacaacuaaccacauua

SEQ ID NO: 56449 - RNA, 18 nt, Artificial Sequence
  Description of Artificial Sequence: Synthetic oligonucleotide
ucaggccacaacuaacca

SEQ ID NO: 56450 - RNA, 18 nt, Artificial Sequence
  Description of Artificial Sequence: Synthetic oligonucleotide
cauuuucaggccacaacu

SEQ ID NO: 56451 - RNA, 18 nt, Artificial Sequence
  Description of Artificial Sequence: Synthetic oligonucleotide
aauaucauuuucaggcca

SEQ ID NO: 56452 - RNA, 18 nt, Artificial Sequence
  Description of Artificial Sequence: Synthetic oligonucleotide
uuggaaauaucauuuuca

SEQ ID NO: 56453 - RNA, 18 nt, Artificial Sequence
  Description of Artificial Sequence: Synthetic oligonucleotide
uucauuuggaaauaucau

SEQ ID NO: 56454 - RNA, 18 nt, Artificial Sequence
  Description of Artificial Sequence: Synthetic oligonucleotide
uccuauucauuuggaaau

SEQ ID NO: 56455 - RNA, 18 nt, Artificial Sequence
  Description of Artificial Sequence: Synthetic oligonucleotide
uuccuuccuauucauuug

SEQ ID NO: 56456 - RNA, 18 nt, Artificial Sequence
  Description of Artificial Sequence: Synthetic oligonucleotide
uuuccuuccuuccuauuc

SEQ ID NO: 56457 - RNA, 18 nt, Artificial Sequence
  Description of Artificial Sequence: Synthetic oligonucleotide
aacaauuuccuuccuucc

SEQ ID NO: 56458 - RNA, 18 nt, Artificial Sequence
  Description of Artificial Sequence: Synthetic oligonucleotide
acaaaaacaauuuccuuc

SEQ ID NO: 56459 - RNA, 18 nt, Artificial Sequence
  Description of Artificial Sequence: Synthetic oligonucleotide
aaacaacaaaaacaauuu

SEQ ID NO: 56460 - RNA, 18 nt, Artificial Sequence
  Description of Artificial Sequence: Synthetic oligonucleotide
aucuuaaacaacaaaaac

SEQ ID NO: 56461 - RNA, 18 nt, Artificial Sequence
  Description of Artificial Sequence: Synthetic oligonucleotide
cuuccaucuuaaacaaca

SEQ ID NO: 56462 - RNA, 18 nt, Artificial Sequence
  Description of Artificial Sequence: Synthetic oligonucleotide
auuuccuuccaucuuaaa

SEQ ID NO: 56463 - RNA, 18 nt, Artificial Sequence
  Description of Artificial Sequence: Synthetic oligonucleotide
ccuauauuuccuuccauc

SEQ ID NO: 56464 - RNA, 18 nt, Artificial Sequence
  Description of Artificial Sequence: Synthetic oligonucleotide
augcaccuauauuuccuu

SEQ ID NO: 56465 - RNA, 18 nt, Artificial Sequence
  Description of Artificial Sequence: Synthetic oligonucleotide
uuuaaaugcaccuauauu

SEQ ID NO: 56466 - RNA, 18 nt, Artificial Sequence
  Description of Artificial Sequence: Synthetic oligonucleotide
cauuuuuuaaaugcaccu

SEQ ID NO: 56467 - RNA, 18 nt, Artificial Sequence
  Description of Artificial Sequence: Synthetic oligonucleotide
agcuccauuuuuuaaaug

SEQ ID NO: 56468 - RNA, 18 nt, Artificial Sequence
  Description of Artificial Sequence: Synthetic oligonucleotide
aaccaagcuccauuuuuu

SEQ ID NO: 56469 - RNA, 18 nt, Artificial Sequence
  Description of Artificial Sequence: Synthetic oligonucleotide
caugcaaccaagcuccau

SEQ ID NO: 56470 - RNA, 18 nt, Artificial Sequence
  Description of Artificial Sequence: Synthetic oligonucleotide
aaaaucaugcaaccaagc

SEQ ID NO: 56471 - RNA, 18 nt, Artificial Sequence
  Description of Artificial Sequence: Synthetic oligonucleotide
gagcgaaaaucaugcaac

SEQ ID NO: 56472 - RNA, 18 nt, Artificial Sequence
  Description of Artificial Sequence: Synthetic oligonucleotide
cucaagagcgaaaaucau

SEQ ID NO: 56473 - RNA, 18 nt, Artificial Sequence
  Description of Artificial Sequence: Synthetic oligonucleotide
gaugacucaagagcgaaa

SEQ ID NO: 56474 - RNA, 18 nt, Artificial Sequence
  Description of Artificial Sequence: Synthetic oligonucleotide
ggcuagaugacucaagag

SEQ ID NO: 56475 - RNA, 18 nt, Artificial Sequence
  Description of Artificial Sequence: Synthetic oligonucleotide
uagagggcuagaugacuc

SEQ ID NO: 56476 - RNA, 18 nt, Artificial Sequence
  Description of Artificial Sequence: Synthetic oligonucleotide
aucauuagagggcuagau

SEQ ID NO: 56477 - RNA, 18 nt, Artificial Sequence
  Description of Artificial Sequence: Synthetic oligonucleotide
aggcaaucauuagagggc

SEQ ID NO: 56478 - RNA, 18 nt, Artificial Sequence
  Description of Artificial Sequence: Synthetic oligonucleotide
guaugaggcaaucauuag

SEQ ID NO: 56479 - RNA, 18 nt, Artificial Sequence
  Description of Artificial Sequence: Synthetic oligonucleotide
caccgguaugaggcaauc

SEQ ID NO: 56480 - RNA, 18 nt, Artificial Sequence
  Description of Artificial Sequence: Synthetic oligonucleotide
guaaucaccgguaugagg

SEQ ID NO: 56481 - RNA, 18 nt, Artificial Sequence
  Description of Artificial Sequence: Synthetic oligonucleotide
cgcucguaaucaccggua

SEQ ID NO: 56482 - RNA, 18 nt, Artificial Sequence
  Description of Artificial Sequence: Synthetic oligonucleotide
aaagccgcucguaaucac

SEQ ID NO: 56483 - RNA, 18 nt, Artificial Sequence
  Description of Artificial Sequence: Synthetic oligonucleotide
caugaaaagccgcucgua

SEQ ID NO: 56484 - RNA, 18 nt, Artificial Sequence
  Description of Artificial Sequence: Synthetic oligonucleotide
gggucaugaaaagccgcu

SEQ ID NO: 56485 - RNA, 18 nt, Artificial Sequence
  Description of Artificial Sequence: Synthetic oligonucleotide
aaaugguacauauggaag

SEQ ID NO: 56486 - RNA, 18 nt, Artificial Sequence
  Description of Artificial Sequence: Synthetic oligonucleotide
uuuuaaaaugguacauau

SEQ ID NO: 56487 - RNA, 18 nt, Artificial Sequence
  Description of Artificial Sequence: Synthetic oligonucleotide
cagcauuuuaaaauggua

SEQ ID NO: 56488 - RNA, 18 nt, Artificial Sequence
  Description of Artificial Sequence: Synthetic oligonucleotide
guaaucagcauuuuaaaa

SEQ ID NO: 56489 - RNA, 18 nt, Artificial Sequence
  Description of Artificial Sequence: Synthetic oligonucleotide
aagaaguaaucagcauuu

SEQ ID NO: 56490 - RNA, 18 nt, Artificial Sequence
  Description of Artificial Sequence: Synthetic oligonucleotide
uucucaagaaguaaucag

SEQ ID NO: 56491 - RNA, 18 nt, Artificial Sequence
  Description of Artificial Sequence: Synthetic oligonucleotide
ucuuauucucaagaagua

SEQ ID NO: 56492 - RNA, 18 nt, Artificial Sequence
  Description of Artificial Sequence: Synthetic oligonucleotide
gcuucucuuauucucaag

SEQ ID NO: 56493 - RNA, 18 nt, Artificial Sequence
  Description of Artificial Sequence: Synthetic oligonucleotide
auuaggcuucucuuauuc

SEQ ID NO: 56494 - RNA, 18 nt, Artificial Sequence
  Description of Artificial Sequence: Synthetic oligonucleotide
cugaaauuaggcuucucu

SEQ ID NO: 56495 - RNA, 18 nt, Artificial Sequence
  Description of Artificial Sequence: Synthetic oligonucleotide
auauucugaaauuaggcu

SEQ ID NO: 56496 - RNA, 18 nt, Artificial Sequence
  Description of Artificial Sequence: Synthetic oligonucleotide
uaaugauauucugaaauu

SEQ ID NO: 56497 - RNA, 18 nt, Artificial Sequence
  Description of Artificial Sequence: Synthetic oligonucleotide
uacccuaaugauauucug

SEQ ID NO: 56498 - RNA, 18 nt, Artificial Sequence
  Description of Artificial Sequence: Synthetic oligonucleotide
auagguacccuaaugaua

SEQ ID NO: 56499 - RNA, 18 nt, Artificial Sequence
  Description of Artificial Sequence: Synthetic oligonucleotide
cuucaauagguacccuaa

SEQ ID NO: 56500 - RNA, 18 nt, Artificial Sequence
  Description of Artificial Sequence: Synthetic oligonucleotide
caagacuucaauagguac

SEQ ID NO: 56501 - RNA, 18 nt, Artificial Sequence
  Description of Artificial Sequence: Synthetic oligonucleotide
gcagucaagacuucaaua

SEQ ID NO: 56502 - RNA, 18 nt, Artificial Sequence
  Description of Artificial Sequence: Synthetic oligonucleotide
uaugugcagucaagacuu

SEQ ID NO: 56503 - RNA, 18 nt, Artificial Sequence
  Description of Artificial Sequence: Synthetic oligonucleotide
cuaaauaugugcagucaa

SEQ ID NO: 56504 - RNA, 18 nt, Artificial Sequence
  Description of Artificial Sequence: Synthetic oligonucleotide
guaugcuaaauaugugca

SEQ ID NO: 56505 - RNA, 18 nt, Artificial Sequence
  Description of Artificial Sequence: Synthetic oligonucleotide
agggaguaugcuaaauau

SEQ ID NO: 56506 - RNA, 18 nt, Artificial Sequence
  Description of Artificial Sequence: Synthetic oligonucleotide
uucccagggaguaugcua

SEQ ID NO: 56507 - RNA, 18 nt, Artificial Sequence
  Description of Artificial Sequence: Synthetic oligonucleotide
uauaauucccagggagua

SEQ ID NO: 56508 - RNA, 18 nt, Artificial Sequence
  Description of Artificial Sequence: Synthetic oligonucleotide
uaaaauauaauucccagg

SEQ ID NO: 56509 - RNA, 18 nt, Artificial Sequence
  Description of Artificial Sequence: Synthetic oligonucleotide
guccuuaaaauauaauuc

SEQ ID NO: 56510 - RNA, 18 nt, Artificial Sequence
  Description of Artificial Sequence: Synthetic oligonucleotide
aaaauguccuuaaaauau

SEQ ID NO: 56511 - RNA, 18 nt, Artificial Sequence
  Description of Artificial Sequence: Synthetic oligonucleotide
auagaaaaauguccuuaa

SEQ ID NO: 56512 - RNA, 18 nt, Artificial Sequence
  Description of Artificial Sequence: Synthetic oligonucleotide
auuuaauagaaaaauguc

SEQ ID NO: 56513 - RNA, 18 nt, Artificial Sequence
  Description of Artificial Sequence: Synthetic oligonucleotide
caaugauuuaauagaaaa

SEQ ID NO: 56514 - RNA, 18 nt, Artificial Sequence
  Description of Artificial Sequence: Synthetic oligonucleotide
auaugcaaugauuuaaua

SEQ ID NO: 56515 - RNA, 18 nt, Artificial Sequence
  Description of Artificial Sequence: Synthetic oligonucleotide
cuuccauaugcaaugauu

SEQ ID NO: 56516 - RNA, 18 nt, Artificial Sequence
  Description of Artificial Sequence: Synthetic oligonucleotide
aguuucuuccauaugcaa

SEQ ID NO: 56517 - RNA, 18 nt, Artificial Sequence
  Description of Artificial Sequence: Synthetic oligonucleotide
uauugaguuucuuccaua

SEQ ID NO: 56518 - RNA, 18 nt, Artificial Sequence
  Description of Artificial Sequence: Synthetic oligonucleotide
uauuauauugaguuucuu

SEQ ID NO: 56519 - RNA, 18 nt, Artificial Sequence
  Description of Artificial Sequence: Synthetic oligonucleotide
ucagcuauuauauugagu

SEQ ID NO: 56520 - RNA, 18 nt, Artificial Sequence
  Description of Artificial Sequence: Synthetic oligonucleotide
aaauaucagcuauuauau

SEQ ID NO: 56521 - RNA, 18 nt, Artificial Sequence
  Description of Artificial Sequence: Synthetic oligonucleotide
caaguaaauaucagcuau

SEQ ID NO: 56522 - RNA, 18 nt, Artificial Sequence
  Description of Artificial Sequence: Synthetic oligonucleotide
gaacccaaguaaauauca

SEQ ID NO: 56523 - RNA, 18 nt, Artificial Sequence
  Description of Artificial Sequence: Synthetic oligonucleotide
auuaagaacccaaguaaa

SEQ ID NO: 56524 - RNA, 18 nt, Artificial Sequence
  Description of Artificial Sequence: Synthetic oligonucleotide
uucugauuaagaacccaa

SEQ ID NO: 56525 - RNA, 18 nt, Artificial Sequence
  Description of Artificial Sequence: Synthetic oligonucleotide
caauguucugauuaagaa

SEQ ID NO: 56526 - RNA, 18 nt, Artificial Sequence
  Description of Artificial Sequence: Synthetic oligonucleotide
acagccaauguucugauu

SEQ ID NO: 56527 - RNA, 18 nt, Artificial Sequence
  Description of Artificial Sequence: Synthetic oligonucleotide
aucacacagccaauguuc

SEQ ID NO: 56528 - RNA, 18 nt, Artificial Sequence
  Description of Artificial Sequence: Synthetic oligonucleotide
ugaaaaucacacagccaa

SEQ ID NO: 56529 - RNA, 18 nt, Artificial Sequence
  Description of Artificial Sequence: Synthetic oligonucleotide
aaucaugaaaaucacaca

SEQ ID NO: 56530 - RNA, 18 nt, Artificial Sequence
  Description of Artificial Sequence: Synthetic oligonucleotide
aucauaaucaugaaaauc

SEQ ID NO: 56531 - RNA, 18 nt, Artificial Sequence
  Description of Artificial Sequence: Synthetic oligonucleotide
ugaaaaucauaaucauga

SEQ ID NO: 56532 - RNA, 18 nt, Artificial Sequence
  Description of Artificial Sequence: Synthetic oligonucleotide
ugcaaugaaaaucauaau

SEQ ID NO: 56533 - RNA, 18 nt, Artificial Sequence
  Description of Artificial Sequence: Synthetic oligonucleotide
uuaauugcaaugaaaauc

SEQ ID NO: 56534 - RNA, 18 nt, Artificial Sequence
  Description of Artificial Sequence: Synthetic oligonucleotide
ucaacuuaauugcaauga

SEQ ID NO: 56535 - RNA, 18 nt, Artificial Sequence
  Description of Artificial Sequence: Synthetic oligonucleotide
aaacaucaacuuaauugc

SEQ ID NO: 56536 - RNA, 18 nt, Artificial Sequence
  Description of Artificial Sequence: Synthetic oligonucleotide
cuacaaaacaucaacuua

SEQ ID NO: 56537 - RNA, 18 nt, Artificial Sequence
  Description of Artificial Sequence: Synthetic oligonucleotide
acugucuacaaaacauca

SEQ ID NO: 56538 - RNA, 18 nt, Artificial Sequence
  Description of Artificial Sequence: Synthetic oligonucleotide
auuucacugucuacaaaa

SEQ ID NO: 56539 - RNA, 18 nt, Artificial Sequence
  Description of Artificial Sequence: Synthetic oligonucleotide
ugguaauuucacugucua

SEQ ID NO: 56540 - RNA, 18 nt, Artificial Sequence
  Description of Artificial Sequence: Synthetic oligonucleotide
guagaugguaauuucacu

SEQ ID NO: 56541 - RNA, 18 nt, Artificial Sequence
  Description of Artificial Sequence: Synthetic oligonucleotide
uuggaguagaugguaauu

SEQ ID NO: 56542 - RNA, 18 nt, Artificial Sequence
  Description of Artificial Sequence: Synthetic oligonucleotide
aucuuuuggaguagaugg

SEQ ID NO: 56543 - RNA, 18 nt, Artificial Sequence
  Description of Artificial Sequence: Synthetic oligonucleotide
uugcaaucuuuuggagua

SEQ ID NO: 56544 - RNA, 18 nt, Artificial Sequence
  Description of Artificial Sequence: Synthetic oligonucleotide
cuauuuugcaaucuuuug

SEQ ID NO: 56545 - RNA, 18 nt, Artificial Sequence
  Description of Artificial Sequence: Synthetic oligonucleotide
aaauucuauuuugcaauc

SEQ ID NO: 56546 - RNA, 18 nt, Artificial Sequence
  Description of Artificial Sequence: Synthetic oligonucleotide
agguuaaauucuauuuug

SEQ ID NO: 56547 - RNA, 18 nt, Artificial Sequence
  Description of Artificial Sequence: Synthetic oligonucleotide
cucuaagguuaaauucua

SEQ ID NO: 56548 - RNA, 18 nt, Artificial Sequence
  Description of Artificial Sequence: Synthetic oligonucleotide
auuggcucuaagguuaaa

SEQ ID NO: 56549 - RNA, 18 nt, Artificial Sequence
  Description of Artificial Sequence: Synthetic oligonucleotide
ccugcauuggcucuaagg

SEQ ID NO: 56550 - RNA, 18 nt, Artificial Sequence
  Description of Artificial Sequence: Synthetic oligonucleotide
uuuucccugcauuggcuc

SEQ ID NO: 56551 - RNA, 18 nt, Artificial Sequence
  Description of Artificial Sequence: Synthetic oligonucleotide
acaaguuuucccugcauu

SEQ ID NO: 56552 - RNA, 18 nt, Artificial Sequence
  Description of Artificial Sequence: Synthetic oligonucleotide
cagaaacaaguuuucccu

SEQ ID NO: 56553 - RNA, 18 nt, Artificial Sequence
  Description of Artificial Sequence: Synthetic oligonucleotide
accugcagaaacaaguuu

SEQ ID NO: 56554 - RNA, 18 nt, Artificial Sequence
  Description of Artificial Sequence: Synthetic oligonucleotide
aaugcaccugcagaaaca

SEQ ID NO: 56555 - RNA, 18 nt, Artificial Sequence
  Description of Artificial Sequence: Synthetic oligonucleotide
caaaaaaugcaccugcag

SEQ ID NO: 56556 - RNA, 18 nt, Artificial Sequence
  Description of Artificial Sequence: Synthetic oligonucleotide
aguuucaaaaaaugcacc

SEQ ID NO: 56557 - RNA, 18 nt, Artificial Sequence
  Description of Artificial Sequence: Synthetic oligonucleotide
guugaaguuucaaaaaau

SEQ ID NO: 56558 - RNA, 18 nt, Artificial Sequence
  Description of Artificial Sequence: Synthetic oligonucleotide
uaucuguugaaguuucaa

SEQ ID NO: 56559 - RNA, 18 nt, Artificial Sequence
  Description of Artificial Sequence: Synthetic oligonucleotide
ccugcuaucuguugaagu

SEQ ID NO: 56560 - RNA, 18 nt, Artificial Sequence
  Description of Artificial Sequence: Synthetic oligonucleotide
uucccccugcuaucuguu

SEQ ID NO: 56561 - RNA, 18 nt, Artificial Sequence
  Description of Artificial Sequence: Synthetic oligonucleotide
uuuuuuucccccugcuau

SEQ ID NO: 56562 - RNA, 18 nt, Artificial Sequence
  Description of Artificial Sequence: Synthetic oligonucleotide
ucacuuuuuuuucccccu

SEQ ID NO: 56563 - RNA, 18 nt, Artificial Sequence
  Description of Artificial Sequence: Synthetic oligonucleotide
uucugucacuuuuuuuuc

SEQ ID NO: 56564 - RNA, 18 nt, Artificial Sequence
  Description of Artificial Sequence: Synthetic oligonucleotide
gauccuucugucacuuuu

SEQ ID NO: 56565 - RNA, 18 nt, Artificial Sequence
  Description of Artificial Sequence: Synthetic oligonucleotide
acugugauccuucuguca

SEQ ID NO: 56566 - RNA, 18 nt, Artificial Sequence
  Description of Artificial Sequence: Synthetic oligonucleotide
gcugaacugugauccuuc

SEQ ID NO: 56567 - RNA, 18 nt, Artificial Sequence
  Description of Artificial Sequence: Synthetic oligonucleotide
auacugcugaacugugau

SEQ ID NO: 56568 - RNA, 18 nt, Artificial Sequence
  Description of Artificial Sequence: Synthetic oligonucleotide
aauucauacugcugaacu

SEQ ID NO: 56569 - RNA, 18 nt, Artificial Sequence
  Description of Artificial Sequence: Synthetic oligonucleotide
cagacaauucauacugcu

SEQ ID NO: 56570 - RNA, 18 nt, Artificial Sequence
  Description of Artificial Sequence: Synthetic oligonucleotide
gccagcagacaauucaua

SEQ ID NO: 56571 - RNA, 18 nt, Artificial Sequence
  Description of Artificial Sequence: Synthetic oligonucleotide
aggcugccagcagacaau

SEQ ID NO: 56572 - RNA, 18 nt, Artificial Sequence
  Description of Artificial Sequence: Synthetic oligonucleotide
uugcaaggcugccagcag

SEQ ID NO: 56573 - RNA, 18 nt, Artificial Sequence
  Description of Artificial Sequence: Synthetic oligonucleotide
ccagauugcaaggcugcc

SEQ ID NO: 56574 - RNA, 18 nt, Artificial Sequence
  Description of Artificial Sequence: Synthetic oligonucleotide
gcacaccagauugcaagg

SEQ ID NO: 56575 - RNA, 18 nt, Artificial Sequence
  Description of Artificial Sequence: Synthetic oligonucleotide
ugccugcacaccagauug

SEQ ID NO: 56576 - RNA, 18 nt, Artificial Sequence
  Description of Artificial Sequence: Synthetic oligonucleotide
cucacugccugcacacca

SEQ ID NO: 56577 - RNA, 18 nt, Artificial Sequence
  Description of Artificial Sequence: Synthetic oligonucleotide
acaaucucacugccugca

SEQ ID NO: 56578 - RNA, 18 nt, Artificial Sequence
  Description of Artificial Sequence: Synthetic oligonucleotide
acaccacaaucucacugc

SEQ ID NO: 56579 - RNA, 18 nt, Artificial Sequence
  Description of Artificial Sequence: Synthetic oligonucleotide
cauguacaccacaaucuc

SEQ ID NO: 56580 - RNA, 18 nt, Artificial Sequence
  Description of Artificial Sequence: Synthetic oligonucleotide
ggugacauguacaccaca

SEQ ID NO: 56581 - RNA, 18 nt, Artificial Sequence
  Description of Artificial Sequence: Synthetic oligonucleotide
aaucaggugacauguaca

SEQ ID NO: 56582 - RNA, 18 nt, Artificial Sequence
  Description of Artificial Sequence: Synthetic oligonucleotide
uguaguccugguggcaug

SEQ ID NO: 56583 - RNA, 18 nt, Artificial Sequence
  Description of Artificial Sequence: Synthetic oligonucleotide
gccccuguaguccuggug

SEQ ID NO: 56584 - RNA, 18 nt, Artificial Sequence
  Description of Artificial Sequence: Synthetic oligonucleotide
acucugccccuguagucc

SEQ ID NO: 56585 - RNA, 18 nt, Artificial Sequence
  Description of Artificial Sequence: Synthetic oligonucleotide
gagacacucugccccugu

SEQ ID NO: 56586 - RNA, 18 nt, Artificial Sequence
  Description of Artificial Sequence: Synthetic oligonucleotide
cagaggagacacucugcc

SEQ ID NO: 56587 - RNA, 18 nt, Artificial Sequence
  Description of Artificial Sequence: Synthetic oligonucleotide
gcugccagaggagacacu

SEQ ID NO: 56588 - RNA, 18 nt, Artificial Sequence
  Description of Artificial Sequence: Synthetic oligonucleotide
ucagagcugccagaggag

SEQ ID NO: 56589 - RNA, 18 nt, Artificial Sequence
  Description of Artificial Sequence: Synthetic oligonucleotide
ugaucucagagcugccag

SEQ ID NO: 56590 - RNA, 18 nt, Artificial Sequence
  Description of Artificial Sequence: Synthetic oligonucleotide
ggauuugaucucagagcu

SEQ ID NO: 56591 - RNA, 18 nt, Artificial Sequence
  Description of Artificial Sequence: Synthetic oligonucleotide
ucaucggauuugaucuca

SEQ ID NO: 56592 - RNA, 18 nt, Artificial Sequence
  Description of Artificial Sequence: Synthetic oligonucleotide
ccucgucaucggauuuga

SEQ ID NO: 56593 - RNA, 18 nt, Artificial Sequence
  Description of Artificial Sequence: Synthetic oligonucleotide
aucacccucgucaucgga

SEQ ID NO: 56594 - RNA, 18 nt, Artificial Sequence
  Description of Artificial Sequence: Synthetic oligonucleotide
uucucaucacccucguca

SEQ ID NO: 56595 - RNA, 18 nt, Artificial Sequence
  Description of Artificial Sequence: Synthetic oligonucleotide
gcagguucucaucacccu

SEQ ID NO: 56596 - RNA, 18 nt, Artificial Sequence
  Description of Artificial Sequence: Synthetic oligonucleotide
gucuugcagguucucauc

SEQ ID NO: 56597 - RNA, 18 nt, Artificial Sequence
  Description of Artificial Sequence: Synthetic oligonucleotide
uucgugucuugcagguuc

SEQ ID NO: 56598 - RNA, 18 nt, Artificial Sequence
  Description of Artificial Sequence: Synthetic oligonucleotide
aagauuucgugucuugca

SEQ ID NO: 56599 - RNA, 18 nt, Artificial Sequence
  Description of Artificial Sequence: Synthetic oligonucleotide
cuccgaagauuucguguc

SEQ ID NO: 56600 - RNA, 18 nt, Artificial Sequence
  Description of Artificial Sequence: Synthetic oligonucleotide
uuguccuccgaagauuuc

SEQ ID NO: 56601 - RNA, 18 nt, Artificial Sequence
  Description of Artificial Sequence: Synthetic oligonucleotide
auuucuuguccuccgaag

SEQ ID NO: 56602 - RNA, 18 nt, Artificial Sequence
  Description of Artificial Sequence: Synthetic oligonucleotide
aucuaauuucuuguccuc

SEQ ID NO: 56603 - RNA, 18 nt, Artificial Sequence
  Description of Artificial Sequence: Synthetic oligonucleotide
ucgucaucuaauuucuug

SEQ ID NO: 56604 - RNA, 18 nt, Artificial Sequence
  Description of Artificial Sequence: Synthetic oligonucleotide
ucuugucgucaucuaauu

SEQ ID NO: 56605 - RNA, 18 nt, Artificial Sequence
  Description of Artificial Sequence: Synthetic oligonucleotide
auccuucuugucgucauc

SEQ ID NO: 56606 - RNA, 18 nt, Artificial Sequence
  Description of Artificial Sequence: Synthetic oligonucleotide
uugauauccuucuugucg

SEQ ID NO: 56607 - RNA, 18 nt, Artificial Sequence
  Description of Artificial Sequence: Synthetic oligonucleotide
uugauuugauauccuucu

SEQ ID NO: 56608 - RNA, 18 nt, Artificial Sequence
  Description of Artificial Sequence: Synthetic oligonucleotide
aguaauugauuugauauc

SEQ ID NO: 56609 - RNA, 18 nt, Artificial Sequence
  Description of Artificial Sequence: Synthetic oligonucleotide
uucacgauggguccccac

SEQ ID NO: 56610 - RNA, 18 nt, Artificial Sequence
  Description of Artificial Sequence: Synthetic oligonucleotide
ccaucuucacgauggguc

SEQ ID NO: 56611 - RNA, 18 nt, Artificial Sequence
  Description of Artificial Sequence: Synthetic oligonucleotide
ccacgccaucuucacgau

SEQ ID NO: 56612 - RNA, 18 nt, Artificial Sequence
  Description of Artificial Sequence: Synthetic oligonucleotide
cagggccacgccaucuuc

SEQ ID NO: 56613 - RNA, 18 nt, Artificial Sequence
  Description of Artificial Sequence: Synthetic oligonucleotide
ccucucagggccacgcca

SEQ ID NO: 56614 - RNA, 18 nt, Artificial Sequence
  Description of Artificial Sequence: Synthetic oligonucleotide
ggcugccucucagggcca

SEQ ID NO: 56615 - RNA, 18 nt, Artificial Sequence
  Description of Artificial Sequence: Synthetic oligonucleotide
agaauggcugccucucag

SEQ ID NO: 56616 - RNA, 18 nt, Artificial Sequence
  Description of Artificial Sequence: Synthetic oligonucleotide
agaagagaauggcugccu

SEQ ID NO: 56617 - RNA, 18 nt, Artificial Sequence
  Description of Artificial Sequence: Synthetic oligonucleotide
uuggcagaagagaauggc

SEQ ID NO: 56618 - RNA, 18 nt, Artificial Sequence
  Description of Artificial Sequence: Synthetic oligonucleotide
cugguuuggcagaagaga

SEQ ID NO: 56619 - RNA, 18 nt, Artificial Sequence
  Description of Artificial Sequence: Synthetic oligonucleotide
ggaaccugguuuggcaga

SEQ ID NO: 56620 - RNA, 18 nt, Artificial Sequence
  Description of Artificial Sequence: Synthetic oligonucleotide
gaaccggaaccugguuug

SEQ ID NO: 56621 - RNA, 18 nt, Artificial Sequence
  Description of Artificial Sequence: Synthetic oligonucleotide
cuguggaaccggaaccug

SEQ ID NO: 56622 - RNA, 18 nt, Artificial Sequence
  Description of Artificial Sequence: Synthetic oligonucleotide
ggaagcuguggaaccgga

SEQ ID NO: 56623 - RNA, 18 nt, Artificial Sequence
  Description of Artificial Sequence: Synthetic oligonucleotide
ggacaggaagcuguggaa

SEQ ID NO: 56624 - RNA, 18 nt, Artificial Sequence
  Description of Artificial Sequence: Synthetic oligonucleotide
agacuggacaggaagcug

SEQ ID NO: 56625 - RNA, 18 nt, Artificial Sequence
  Description of Artificial Sequence: Synthetic oligonucleotide
gucgcagacuggacagga

SEQ ID NO: 56626 - RNA, 18 nt, Artificial Sequence
  Description of Artificial Sequence: Synthetic oligonucleotide
gggaagucgcagacugga

SEQ ID NO: 56627 - RNA, 18 nt, Artificial Sequence
  Description of Artificial Sequence: Synthetic oligonucleotide
gguggguucaggucaggg

SEQ ID NO: 56628 - RNA, 18 nt, Artificial Sequence
  Description of Artificial Sequence: Synthetic oligonucleotide
ggguggguucaggucagg

SEQ ID NO: 56629 - RNA, 18 nt, Artificial Sequence
  Description of Artificial Sequence: Synthetic oligonucleotide
cucuguaaggguccuggg

SEQ ID NO: 56630 - RNA, 18 nt, Artificial Sequence
  Description of Artificial Sequence: Synthetic oligonucleotide
gugcccuggugaggccaa

SEQ ID NO: 56631 - RNA, 18 nt, Artificial Sequence
  Description of Artificial Sequence: Synthetic oligonucleotide
cagaagugcccuggugag

SEQ ID NO: 56632 - RNA, 18 nt, Artificial Sequence
  Description of Artificial Sequence: Synthetic oligonucleotide
gaggucagaagugcccug

SEQ ID NO: 56633 - RNA, 18 nt, Artificial Sequence
  Description of Artificial Sequence: Synthetic oligonucleotide
aaagugaggucagaagug

SEQ ID NO: 56634 - RNA, 18 nt, Artificial Sequence
  Description of Artificial Sequence: Synthetic oligonucleotide
uugugaaagugaggucag

SEQ ID NO: 56635 - RNA, 18 nt, Artificial Sequence
  Description of Artificial Sequence: Synthetic oligonucleotide
uccuauugugaaagugag

SEQ ID NO: 56636 - RNA, 18 nt, Artificial Sequence
  Description of Artificial Sequence: Synthetic oligonucleotide
acugguccuauugugaaa

SEQ ID NO: 56637 - RNA, 18 nt, Artificial Sequence
  Description of Artificial Sequence: Synthetic oligonucleotide
ucaacacugguccuauug

SEQ ID NO: 56638 - RNA, 18 nt, Artificial Sequence
  Description of Artificial Sequence: Synthetic oligonucleotide
ggguaucaacacuggucc

SEQ ID NO: 56639 - RNA, 18 nt, Artificial Sequence
  Description of Artificial Sequence: Synthetic oligonucleotide
aggcuggguaucaacacu

SEQ ID NO: 56640 - RNA, 18 nt, Artificial Sequence
  Description of Artificial Sequence: Synthetic oligonucleotide
ccaagaggcuggguauca

SEQ ID NO: 56641 - RNA, 18 nt, Artificial Sequence
  Description of Artificial Sequence: Synthetic oligonucleotide
gaacaccaagaggcuggg

SEQ ID NO: 56642 - RNA, 18 nt, Artificial Sequence
  Description of Artificial Sequence: Synthetic oligonucleotide
gggaugaacaccaagagg

SEQ ID NO: 56643 - RNA, 18 nt, Artificial Sequence
  Description of Artificial Sequence: Synthetic oligonucleotide
cuugagggaugaacacca

SEQ ID NO: 56644 - RNA, 18 nt, Artificial Sequence
  Description of Artificial Sequence: Synthetic oligonucleotide
ugcuucuugagggaugaa

SEQ ID NO: 56645 - RNA, 18 nt, Artificial Sequence
  Description of Artificial Sequence: Synthetic oligonucleotide
gccagugcuucuugaggg

SEQ ID NO: 56646 - RNA, 18 nt, Artificial Sequence
  Description of Artificial Sequence: Synthetic oligonucleotide
uuucugccagugcuucuu

SEQ ID NO: 56647 - RNA, 18 nt, Artificial Sequence
  Description of Artificial Sequence: Synthetic oligonucleotide
cuggguuucugccagugc

SEQ ID NO: 56648 - RNA, 18 nt, Artificial Sequence
  Description of Artificial Sequence: Synthetic oligonucleotide
gauuccuggguuucugcc

SEQ ID NO: 56649 - RNA, 18 nt, Artificial Sequence
  Description of Artificial Sequence: Synthetic oligonucleotide
aauuugauuccuggguuu

SEQ ID NO: 56650 - RNA, 18 nt, Artificial Sequence
  Description of Artificial Sequence: Synthetic oligonucleotide
ugcccaauuugauuccug

SEQ ID NO: 56651 - RNA, 18 nt, Artificial Sequence
  Description of Artificial Sequence: Synthetic oligonucleotide
uuuugugcccaauuugau

SEQ ID NO: 56652 - RNA, 18 nt, Artificial Sequence
  Description of Artificial Sequence: Synthetic oligonucleotide
accauuuuugugcccaau

SEQ ID NO: 56653 - RNA, 18 nt, Artificial Sequence
  Description of Artificial Sequence: Synthetic oligonucleotide
uccuuaccauuuuugugc

SEQ ID NO: 56654 - RNA, 18 nt, Artificial Sequence
  Description of Artificial Sequence: Synthetic oligonucleotide
ccauuuccuuaccauuuu

SEQ ID NO: 56655 - RNA, 18 nt, Artificial Sequence
  Description of Artificial Sequence: Synthetic oligonucleotide
cuuugccauuuccuuacc

SEQ ID NO: 56656 - RNA, 18 nt, Artificial Sequence
  Description of Artificial Sequence: Synthetic oligonucleotide
aaauacuuugccauuucc

SEQ ID NO: 56657 - RNA, 18 nt, Artificial Sequence
  Description of Artificial Sequence: Synthetic oligonucleotide
guucuaaauacuuugcca

SEQ ID NO: 56658 - RNA, 18 nt, Artificial Sequence
  Description of Artificial Sequence: Synthetic oligonucleotide
gcgaaguucuaaauacuu

SEQ ID NO: 56659 - RNA, 18 nt, Artificial Sequence
  Description of Artificial Sequence: Synthetic oligonucleotide
agcgggcgaaguucuaaa

SEQ ID NO: 56660 - RNA, 18 nt, Artificial Sequence
  Description of Artificial Sequence: Synthetic oligonucleotide
caauuagcgggcgaaguu

SEQ ID NO: 56661 - RNA, 18 nt, Artificial Sequence
  Description of Artificial Sequence: Synthetic oligonucleotide
aaacacaauuagcgggcg

SEQ ID NO: 56662 - RNA, 18 nt, Artificial Sequence
  Description of Artificial Sequence: Synthetic oligonucleotide
uggagaaacacaauuagc

SEQ ID NO: 56663 - RNA, 18 nt, Artificial Sequence
  Description of Artificial Sequence: Synthetic oligonucleotide
gucccuggagaaacacaa

SEQ ID NO: 56664 - RNA, 18 nt, Artificial Sequence
  Description of Artificial Sequence: Synthetic oligonucleotide
aaacagucccuggagaaa

SEQ ID NO: 56665 - RNA, 18 nt, Artificial Sequence
  Description of Artificial Sequence: Synthetic oligonucleotide
gaggaaaacagucccugg

SEQ ID NO: 56666 - RNA, 18 nt, Artificial Sequence
  Description of Artificial Sequence: Synthetic oligonucleotide
uguuugaggaaaacaguc

SEQ ID NO: 56667 - RNA, 18 nt, Artificial Sequence
  Description of Artificial Sequence: Synthetic oligonucleotide
gaggauguuugaggaaaa

SEQ ID NO: 56668 - RNA, 18 nt, Artificial Sequence
  Description of Artificial Sequence: Synthetic oligonucleotide
uuucagaggauguuugag

SEQ ID NO: 56669 - RNA, 18 nt, Artificial Sequence
  Description of Artificial Sequence: Synthetic oligonucleotide
caggauuucagaggaugu

SEQ ID NO: 56670 - RNA, 18 nt, Artificial Sequence
  Description of Artificial Sequence: Synthetic oligonucleotide
aggaccaggauuucagag

SEQ ID NO: 56671 - RNA, 18 nt, Artificial Sequence
  Description of Artificial Sequence: Synthetic oligonucleotide
gauauaggaccaggauuu

SEQ ID NO: 56672 - RNA, 18 nt, Artificial Sequence
  Description of Artificial Sequence: Synthetic oligonucleotide
cugcugauauaggaccag

SEQ ID NO: 56673 - RNA, 18 nt, Artificial Sequence
  Description of Artificial Sequence: Synthetic oligonucleotide
auucccugcugauauagg

SEQ ID NO: 56674 - RNA, 18 nt, Artificial Sequence
  Description of Artificial Sequence: Synthetic oligonucleotide
gccucauucccugcugau

SEQ ID NO: 56675 - RNA, 18 nt, Artificial Sequence
  Description of Artificial Sequence: Synthetic oligonucleotide
cuguggccucauucccug

SEQ ID NO: 56676 - RNA, 18 nt, Artificial Sequence
  Description of Artificial Sequence: Synthetic oligonucleotide
ucagucuguggccucauu

SEQ ID NO: 56677 - RNA, 18 nt, Artificial Sequence
  Description of Artificial Sequence: Synthetic oligonucleotide
ucucaucagucuguggcc

SEQ ID NO: 56678 - RNA, 18 nt, Artificial Sequence
  Description of Artificial Sequence: Synthetic oligonucleotide
uuuccucucaucagucug

SEQ ID NO: 56679 - RNA, 18 nt, Artificial Sequence
  Description of Artificial Sequence: Synthetic oligonucleotide
uaaaauuuccucucauca

SEQ ID NO: 56680 - RNA, 18 nt, Artificial Sequence
  Description of Artificial Sequence: Synthetic oligonucleotide
uaaaauaaaauuuccucu

SEQ ID NO: 56681 - RNA, 18 nt, Artificial Sequence
  Description of Artificial Sequence: Synthetic oligonucleotide
auagcuaaaauaaaauuu

SEQ ID NO: 56682 - RNA, 18 nt, Artificial Sequence
  Description of Artificial Sequence: Synthetic oligonucleotide
uggaaauagcuaaaauaa

SEQ ID NO: 56683 - RNA, 18 nt, Artificial Sequence
  Description of Artificial Sequence: Synthetic oligonucleotide
aaauguggaaauagcuaa

SEQ ID NO: 56684 - RNA, 18 nt, Artificial Sequence
  Description of Artificial Sequence: Synthetic oligonucleotide
gagaaaaauguggaaaua

SEQ ID NO: 56685 - RNA, 18 nt, Artificial Sequence
  Description of Artificial Sequence: Synthetic oligonucleotide
ugaaugagaaaaaugugg

SEQ ID NO: 56686 - RNA, 18 nt, Artificial Sequence
  Description of Artificial Sequence: Synthetic oligonucleotide
ggaccugaaugagaaaaa

SEQ ID NO: 56687 - RNA, 18 nt, Artificial Sequence
  Description of Artificial Sequence: Synthetic oligonucleotide
uuagaggaccugaaugag

SEQ ID NO: 56688 - RNA, 18 nt, Artificial Sequence
  Description of Artificial Sequence: Synthetic oligonucleotide
ccacauuagaggaccuga

SEQ ID NO: 56689 - RNA, 18 nt, Artificial Sequence
  Description of Artificial Sequence: Synthetic oligonucleotide
acuaaccacauuagagga

SEQ ID NO: 56690 - RNA, 18 nt, Artificial Sequence
  Description of Artificial Sequence: Synthetic oligonucleotide
ccacaacuaaccacauua

SEQ ID NO: 56691 - RNA, 18 nt, Artificial Sequence
  Description of Artificial Sequence: Synthetic oligonucleotide
ucaggccacaacuaacca

SEQ ID NO: 56692 - RNA, 18 nt, Artificial Sequence
  Description of Artificial Sequence: Synthetic oligonucleotide
cauuuucaggccacaacu

SEQ ID NO: 56693 - RNA, 18 nt, Artificial Sequence
  Description of Artificial Sequence: Synthetic oligonucleotide
aauaucauuuucaggcca

SEQ ID NO: 56694 - RNA, 18 nt, Artificial Sequence
  Description of Artificial Sequence: Synthetic oligonucleotide
uuggaaauaucauuuuca

SEQ ID NO: 56695 - RNA, 18 nt, Artificial Sequence
  Description of Artificial Sequence: Synthetic oligonucleotide
uucauuuggaaauaucau

SEQ ID NO: 56696 - RNA, 18 nt, Artificial Sequence
  Description of Artificial Sequence: Synthetic oligonucleotide
uccuauucauuuggaaau

SEQ ID NO: 56697 - RNA, 18 nt, Artificial Sequence
  Description of Artificial Sequence: Synthetic oligonucleotide
uuccuuccuauucauuug

SEQ ID NO: 56698 - RNA, 18 nt, Artificial Sequence
  Description of Artificial Sequence: Synthetic oligonucleotide
uuuccuuccuuccuauuc

SEQ ID NO: 56699 - RNA, 18 nt, Artificial Sequence
  Description of Artificial Sequence: Synthetic oligonucleotide
aacaauuuccuuccuucc

SEQ ID NO: 56700 - RNA, 18 nt, Artificial Sequence
  Description of Artificial Sequence: Synthetic oligonucleotide
acaaaaacaauuuccuuc

SEQ ID NO: 56701 - RNA, 18 nt, Artificial Sequence
  Description of Artificial Sequence: Synthetic oligonucleotide
aaacaacaaaaacaauuu

SEQ ID NO: 56702 - RNA, 18 nt, Artificial Sequence
  Description of Artificial Sequence: Synthetic oligonucleotide
aucuuaaacaacaaaaac

SEQ ID NO: 56703 - RNA, 18 nt, Artificial Sequence
  Description of Artificial Sequence: Synthetic oligonucleotide
cuuccaucuuaaacaaca

SEQ ID NO: 56704 - RNA, 18 nt, Artificial Sequence
  Description of Artificial Sequence: Synthetic oligonucleotide
auuuccuuccaucuuaaa

SEQ ID NO: 56705 - RNA, 18 nt, Artificial Sequence
  Description of Artificial Sequence: Synthetic oligonucleotide
ccuauauuuccuuccauc

SEQ ID NO: 56706 - RNA, 18 nt, Artificial Sequence
  Description of Artificial Sequence: Synthetic oligonucleotide
augcaccuauauuuccuu

SEQ ID NO: 56707 - RNA, 18 nt, Artificial Sequence
  Description of Artificial Sequence: Synthetic oligonucleotide
uuuaaaugcaccuauauu

SEQ ID NO: 56708 - RNA, 18 nt, Artificial Sequence
  Description of Artificial Sequence: Synthetic oligonucleotide
cauuuuuuaaaugcaccu

SEQ ID NO: 56709 - RNA, 18 nt, Artificial Sequence
  Description of Artificial Sequence: Synthetic oligonucleotide
agcuccauuuuuuaaaug

SEQ ID NO: 56710 - RNA, 18 nt, Artificial Sequence
  Description of Artificial Sequence: Synthetic oligonucleotide
aaccaagcuccauuuuuu

SEQ ID NO: 56711 - RNA, 18 nt, Artificial Sequence
  Description of Artificial Sequence: Synthetic oligonucleotide
caugcaaccaagcuccau

SEQ ID NO: 56712 - RNA, 18 nt, Artificial Sequence
  Description of Artificial Sequence: Synthetic oligonucleotide
aaaaucaugcaaccaagc

SEQ ID NO: 56713 - RNA, 18 nt, Artificial Sequence
  Description of Artificial Sequence: Synthetic oligonucleotide
gagcgaaaaucaugcaac

SEQ ID NO: 56714 - RNA, 18 nt, Artificial Sequence
  Description of Artificial Sequence: Synthetic oligonucleotide
cucaagagcgaaaaucau

SEQ ID NO: 56715 - RNA, 18 nt, Artificial Sequence
  Description of Artificial Sequence: Synthetic oligonucleotide
gaugacucaagagcgaaa

SEQ ID NO: 56716 - RNA, 18 nt, Artificial Sequence
  Description of Artificial Sequence: Synthetic oligonucleotide
ggcuagaugacucaagag

SEQ ID NO: 56717 - RNA, 18 nt, Artificial Sequence
  Description of Artificial Sequence: Synthetic oligonucleotide
uagagggcuagaugacuc

SEQ ID NO: 56718 - RNA, 18 nt, Artificial Sequence
  Description of Artificial Sequence: Synthetic oligonucleotide
aucauuagagggcuagau

SEQ ID NO: 56719 - RNA, 18 nt, Artificial Sequence
  Description of Artificial Sequence: Synthetic oligonucleotide
aggcaaucauuagagggc

SEQ ID NO: 56720 - RNA, 18 nt, Artificial Sequence
  Description of Artificial Sequence: Synthetic oligonucleotide
guaugaggcaaucauuag

SEQ ID NO: 56721 - RNA, 18 nt, Artificial Sequence
  Description of Artificial Sequence: Synthetic oligonucleotide
caccgguaugaggcaauc

SEQ ID NO: 56722 - RNA, 18 nt, Artificial Sequence
  Description of Artificial Sequence: Synthetic oligonucleotide
guaaucaccgguaugagg

SEQ ID NO: 56723 - RNA, 18 nt, Artificial Sequence
  Description of Artificial Sequence: Synthetic oligonucleotide
cgcucguaaucaccggua

SEQ ID NO: 56724 - RNA, 18 nt, Artificial Sequence
  Description of Artificial Sequence: Synthetic oligonucleotide
aaagccgcucguaaucac

SEQ ID NO: 56725 - RNA, 18 nt, Artificial Sequence
  Description of Artificial Sequence: Synthetic oligonucleotide
caugaaaagccgcucgua

SEQ ID NO: 56726 - RNA, 18 nt, Artificial Sequence
  Description of Artificial Sequence: Synthetic oligonucleotide
gggucaugaaaagccgcu

SEQ ID NO: 56727 - RNA, 18 nt, Artificial Sequence
  Description of Artificial Sequence: Synthetic oligonucleotide
aaaugguacauauggaag

SEQ ID NO: 56728 - RNA, 18 nt, Artificial Sequence
  Description of Artificial Sequence: Synthetic oligonucleotide
uuuuaaaaugguacauau

SEQ ID NO: 56729 - RNA, 18 nt, Artificial Sequence
  Description of Artificial Sequence: Synthetic oligonucleotide
cagcauuuuaaaauggua

SEQ ID NO: 56730 - RNA, 18 nt, Artificial Sequence
  Description of Artificial Sequence: Synthetic oligonucleotide
guaaucagcauuuuaaaa

SEQ ID NO: 56731 - RNA, 18 nt, Artificial Sequence
  Description of Artificial Sequence: Synthetic oligonucleotide
aagaaguaaucagcauuu

SEQ ID NO: 56732 - RNA, 18 nt, Artificial Sequence
  Description of Artificial Sequence: Synthetic oligonucleotide
uucucaagaaguaaucag

SEQ ID NO: 56733 - RNA, 18 nt, Artificial Sequence
  Description of Artificial Sequence: Synthetic oligonucleotide
ucuuauucucaagaagua

SEQ ID NO: 56734 - RNA, 18 nt, Artificial Sequence
  Description of Artificial Sequence: Synthetic oligonucleotide
gcuucucuuauucucaag

SEQ ID NO: 56735 - RNA, 18 nt, Artificial Sequence
  Description of Artificial Sequence: Synthetic oligonucleotide
auuaggcuucucuuauuc

SEQ ID NO: 56736 - RNA, 18 nt, Artificial Sequence
  Description of Artificial Sequence: Synthetic oligonucleotide
cugaaauuaggcuucucu

SEQ ID NO: 56737 - RNA, 18 nt, Artificial Sequence
  Description of Artificial Sequence: Synthetic oligonucleotide
auauucugaaauuaggcu

SEQ ID NO: 56738 - RNA, 18 nt, Artificial Sequence
  Description of Artificial Sequence: Synthetic oligonucleotide
uaaugauauucugaaauu

SEQ ID NO: 56739 - RNA, 18 nt, Artificial Sequence
  Description of Artificial Sequence: Synthetic oligonucleotide
uacccuaaugauauucug

SEQ ID NO: 56740 - RNA, 18 nt, Artificial Sequence
  Description of Artificial Sequence: Synthetic oligonucleotide
auagguacccuaaugaua

SEQ ID NO: 56741 - RNA, 18 nt, Artificial Sequence
  Description of Artificial Sequence: Synthetic oligonucleotide
cuucaauagguacccuaa

SEQ ID NO: 56742 - RNA, 18 nt, Artificial Sequence
  Description of Artificial Sequence: Synthetic oligonucleotide
caagacuucaauagguac

SEQ ID NO: 56743 - RNA, 18 nt, Artificial Sequence
  Description of Artificial Sequence: Synthetic oligonucleotide
gcagucaagacuucaaua

SEQ ID NO: 56744 - RNA, 18 nt, Artificial Sequence
  Description of Artificial Sequence: Synthetic oligonucleotide
uaugugcagucaagacuu

SEQ ID NO: 56745 - RNA, 18 nt, Artificial Sequence
  Description of Artificial Sequence: Synthetic oligonucleotide
cuaaauaugugcagucaa

SEQ ID NO: 56746 - RNA, 18 nt, Artificial Sequence
  Description of Artificial Sequence: Synthetic oligonucleotide
guaugcuaaauaugugca

SEQ ID NO: 56747 - RNA, 18 nt, Artificial Sequence
  Description of Artificial Sequence: Synthetic oligonucleotide
agggaguaugcuaaauau

SEQ ID NO: 56748 - RNA, 18 nt, Artificial Sequence
  Description of Artificial Sequence: Synthetic oligonucleotide
uucccagggaguaugcua

SEQ ID NO: 56749 - RNA, 18 nt, Artificial Sequence
  Description of Artificial Sequence: Synthetic oligonucleotide
uauaauucccagggagua

SEQ ID NO: 56750 - RNA, 18 nt, Artificial Sequence
  Description of Artificial Sequence: Synthetic oligonucleotide
uaaaauauaauucccagg

SEQ ID NO: 56751 - RNA, 18 nt, Artificial Sequence
  Description of Artificial Sequence: Synthetic oligonucleotide
guccuuaaaauauaauuc

SEQ ID NO: 56752 - RNA, 18 nt, Artificial Sequence
  Description of Artificial Sequence: Synthetic oligonucleotide
aaaauguccuuaaaauau

SEQ ID NO: 56753 - RNA, 18 nt, Artificial Sequence
  Description of Artificial Sequence: Synthetic oligonucleotide
auagaaaaauguccuuaa

SEQ ID NO: 56754 - RNA, 18 nt, Artificial Sequence
  Description of Artificial Sequence: Synthetic oligonucleotide
auuuaauagaaaaauguc

SEQ ID NO: 56755 - RNA, 18 nt, Artificial Sequence
  Description of Artificial Sequence: Synthetic oligonucleotide
caaugauuuaauagaaaa

SEQ ID NO: 56756 - RNA, 18 nt, Artificial Sequence
  Description of Artificial Sequence: Synthetic oligonucleotide
auaugcaaugauuuaaua

SEQ ID NO: 56757 - RNA, 18 nt, Artificial Sequence
  Description of Artificial Sequence: Synthetic oligonucleotide
cuuccauaugcaaugauu

SEQ ID NO: 56758 - RNA, 18 nt, Artificial Sequence
  Description of Artificial Sequence: Synthetic oligonucleotide
aguuucuuccauaugcaa

SEQ ID NO: 56759 - RNA, 18 nt, Artificial Sequence
  Description of Artificial Sequence: Synthetic oligonucleotide
uauugaguuucuuccaua

SEQ ID NO: 56760 - RNA, 18 nt, Artificial Sequence
  Description of Artificial Sequence: Synthetic oligonucleotide
uauuauauugaguuucuu

SEQ ID NO: 56761 - RNA, 18 nt, Artificial Sequence
  Description of Artificial Sequence: Synthetic oligonucleotide
ucagcuauuauauugagu

SEQ ID NO: 56762 - RNA, 18 nt, Artificial Sequence
  Description of Artificial Sequence: Synthetic oligonucleotide
aaauaucagcuauuauau

SEQ ID NO: 56763 - RNA, 18 nt, Artificial Sequence
  Description of Artificial Sequence: Synthetic oligonucleotide
caaguaaauaucagcuau

SEQ ID NO: 56764 - RNA, 18 nt, Artificial Sequence
  Description of Artificial Sequence: Synthetic oligonucleotide
gaacccaaguaaauauca

SEQ ID NO: 56765 - RNA, 18 nt, Artificial Sequence
  Description of Artificial Sequence: Synthetic oligonucleotide
auuaagaacccaaguaaa

SEQ ID NO: 56766 - RNA, 18 nt, Artificial Sequence
  Description of Artificial Sequence: Synthetic oligonucleotide
uucugauuaagaacccaa

SEQ ID NO: 56767 - RNA, 18 nt, Artificial Sequence
  Description of Artificial Sequence: Synthetic oligonucleotide
caauguucugauuaagaa

SEQ ID NO: 56768 - RNA, 18 nt, Artificial Sequence
  Description of Artificial Sequence: Synthetic oligonucleotide
acagccaauguucugauu

SEQ ID NO: 56769 - RNA, 18 nt, Artificial Sequence
  Description of Artificial Sequence: Synthetic oligonucleotide
aucacacagccaauguuc

SEQ ID NO: 56770 - RNA, 18 nt, Artificial Sequence
  Description of Artificial Sequence: Synthetic oligonucleotide
ugaaaaucacacagccaa

SEQ ID NO: 56771 - RNA, 18 nt, Artificial Sequence
  Description of Artificial Sequence: Synthetic oligonucleotide
aaucaugaaaaucacaca

SEQ ID NO: 56772 - RNA, 18 nt, Artificial Sequence
  Description of Artificial Sequence: Synthetic oligonucleotide
aucauaaucaugaaaauc

SEQ ID NO: 56773 - RNA, 18 nt, Artificial Sequence
  Description of Artificial Sequence: Synthetic oligonucleotide
ugaaaaucauaaucauga

SEQ ID NO: 56774 - RNA, 18 nt, Artificial Sequence
  Description of Artificial Sequence: Synthetic oligonucleotide
ugcaaugaaaaucauaau

SEQ ID NO: 56775 - RNA, 18 nt, Artificial Sequence
  Description of Artificial Sequence: Synthetic oligonucleotide
uuaauugcaaugaaaauc

SEQ ID NO: 56776 - RNA, 18 nt, Artificial Sequence
  Description of Artificial Sequence: Synthetic oligonucleotide
ucaacuuaauugcaauga

SEQ ID NO: 56777 - RNA, 18 nt, Artificial Sequence
  Description of Artificial Sequence: Synthetic oligonucleotide
aaacaucaacuuaauugc

SEQ ID NO: 56778 - RNA, 18 nt, Artificial Sequence
  Description of Artificial Sequence: Synthetic oligonucleotide
cuacaaaacaucaacuua

SEQ ID NO: 56779 - RNA, 18 nt, Artificial Sequence
  Description of Artificial Sequence: Synthetic oligonucleotide
acugucuacaaaacauca

SEQ ID NO: 56780 - RNA, 18 nt, Artificial Sequence
  Description of Artificial Sequence: Synthetic oligonucleotide
auuucacugucuacaaaa

SEQ ID NO: 56781 - RNA, 18 nt, Artificial Sequence
  Description of Artificial Sequence: Synthetic oligonucleotide
ugguaauuucacugucua

SEQ ID NO: 56782 - RNA, 18 nt, Artificial Sequence
  Description of Artificial Sequence: Synthetic oligonucleotide
guagaugguaauuucacu

SEQ ID NO: 56783 - RNA, 18 nt, Artificial Sequence
  Description of Artificial Sequence: Synthetic oligonucleotide
uuggaguagaugguaauu

SEQ ID NO: 56784 - RNA, 18 nt, Artificial Sequence
  Description of Artificial Sequence: Synthetic oligonucleotide
aucuuuuggaguagaugg

SEQ ID NO: 56785 - RNA, 18 nt, Artificial Sequence
  Description of Artificial Sequence: Synthetic oligonucleotide
uugcaaucuuuuggagua

SEQ ID NO: 56786 - RNA, 18 nt, Artificial Sequence
  Description of Artificial Sequence: Synthetic oligonucleotide
cuauuuugcaaucuuuug

SEQ ID NO: 56787 - RNA, 18 nt, Artificial Sequence
  Description of Artificial Sequence: Synthetic oligonucleotide
aaauucuauuuugcaauc

SEQ ID NO: 56788 - RNA, 18 nt, Artificial Sequence
  Description of Artificial Sequence: Synthetic oligonucleotide
agguuaaauucuauuuug

SEQ ID NO: 56789 - RNA, 18 nt, Artificial Sequence
  Description of Artificial Sequence: Synthetic oligonucleotide
cucuaagguuaaauucua

SEQ ID NO: 56790 - RNA, 18 nt, Artificial Sequence
  Description of Artificial Sequence: Synthetic oligonucleotide
auuggcucuaagguuaaa

SEQ ID NO: 56791 - RNA, 18 nt, Artificial Sequence
  Description of Artificial Sequence: Synthetic oligonucleotide
ccugcauuggcucuaagg

SEQ ID NO: 56792 - RNA, 18 nt, Artificial Sequence
  Description of Artificial Sequence: Synthetic oligonucleotide
uuuucccugcauuggcuc

SEQ ID NO: 56793 - RNA, 18 nt, Artificial Sequence
  Description of Artificial Sequence: Synthetic oligonucleotide
acaaguuuucccugcauu

SEQ ID NO: 56794 - RNA, 18 nt, Artificial Sequence
  Description of Artificial Sequence: Synthetic oligonucleotide
cagaaacaaguuuucccu

SEQ ID NO: 56795 - RNA, 18 nt, Artificial Sequence
  Description of Artificial Sequence: Synthetic oligonucleotide
accugcagaaacaaguuu

SEQ ID NO: 56796 - RNA, 18 nt, Artificial Sequence
  Description of Artificial Sequence: Synthetic oligonucleotide
aaugcaccugcagaaaca

SEQ ID NO: 56797 - RNA, 18 nt, Artificial Sequence
  Description of Artificial Sequence: Synthetic oligonucleotide
caaaaaaugcaccugcag

SEQ ID NO: 56798 - RNA, 18 nt, Artificial Sequence
  Description of Artificial Sequence: Synthetic oligonucleotide
aguuucaaaaaaugcacc

SEQ ID NO: 56799 - RNA, 18 nt, Artificial Sequence
  Description of Artificial Sequence: Synthetic oligonucleotide
guugaaguuucaaaaaau

SEQ ID NO: 56800 - RNA, 18 nt, Artificial Sequence
  Description of Artificial Sequence: Synthetic oligonucleotide
uaucuguugaaguuucaa

SEQ ID NO: 56801 - RNA, 18 nt, Artificial Sequence
  Description of Artificial Sequence: Synthetic oligonucleotide
ccugcuaucuguugaagu

SEQ ID NO: 56802 - RNA, 18 nt, Artificial Sequence
  Description of Artificial Sequence: Synthetic oligonucleotide
uucccccugcuaucuguu

SEQ ID NO: 56803 - RNA, 18 nt, Artificial Sequence
  Description of Artificial Sequence: Synthetic oligonucleotide
uuuuuuucccccugcuau

SEQ ID NO: 56804 - RNA, 18 nt, Artificial Sequence
  Description of Artificial Sequence: Synthetic oligonucleotide
ucacuuuuuuuucccccu

SEQ ID NO: 56805 - RNA, 18 nt, Artificial Sequence
  Description of Artificial Sequence: Synthetic oligonucleotide
uucugucacuuuuuuuuc

SEQ ID NO: 56806 - RNA, 18 nt, Artificial Sequence
  Description of Artificial Sequence: Synthetic oligonucleotide
gauccuucugucacuuuu

SEQ ID NO: 56807 - RNA, 18 nt, Artificial Sequence
  Description of Artificial Sequence: Synthetic oligonucleotide
acugugauccuucuguca

SEQ ID NO: 56808 - RNA, 18 nt, Artificial Sequence
  Description of Artificial Sequence: Synthetic oligonucleotide
gcugaacugugauccuuc

SEQ ID NO: 56809 - RNA, 18 nt, Artificial Sequence
  Description of Artificial Sequence: Synthetic oligonucleotide
auacugcugaacugugau

SEQ ID NO: 56810 - RNA, 18 nt, Artificial Sequence
  Description of Artificial Sequence: Synthetic oligonucleotide
aauucauacugcugaacu

SEQ ID NO: 56811 - RNA, 18 nt, Artificial Sequence
  Description of Artificial Sequence: Synthetic oligonucleotide
cagacaauucauacugcu

SEQ ID NO: 56812 - RNA, 18 nt, Artificial Sequence
  Description of Artificial Sequence: Synthetic oligonucleotide
gccagcagacaauucaua

SEQ ID NO: 56813 - RNA, 18 nt, Artificial Sequence
  Description of Artificial Sequence: Synthetic oligonucleotide
aggcugccagcagacaau

SEQ ID NO: 56814 - RNA, 18 nt, Artificial Sequence
  Description of Artificial Sequence: Synthetic oligonucleotide
uugcaaggcugccagcag

SEQ ID NO: 56815 - RNA, 18 nt, Artificial Sequence
  Description of Artificial Sequence: Synthetic oligonucleotide
ccagauugcaaggcugcc

SEQ ID NO: 56816 - RNA, 18 nt, Artificial Sequence
  Description of Artificial Sequence: Synthetic oligonucleotide
gcacaccagauugcaagg

SEQ ID NO: 56817 - RNA, 18 nt, Artificial Sequence
  Description of Artificial Sequence: Synthetic oligonucleotide
ugccugcacaccagauug

SEQ ID NO: 56818 - RNA, 18 nt, Artificial Sequence
  Description of Artificial Sequence: Synthetic oligonucleotide
cucacugccugcacacca

SEQ ID NO: 56819 - RNA, 18 nt, Artificial Sequence
  Description of Artificial Sequence: Synthetic oligonucleotide
acaaucucacugccugca

SEQ ID NO: 56820 - RNA, 18 nt, Artificial Sequence
  Description of Artificial Sequence: Synthetic oligonucleotide
acaccacaaucucacugc

SEQ ID NO: 56821 - RNA, 18 nt, Artificial Sequence
  Description of Artificial Sequence: Synthetic oligonucleotide
cauguacaccacaaucuc

SEQ ID NO: 56822 - RNA, 18 nt, Artificial Sequence
  Description of Artificial Sequence: Synthetic oligonucleotide
ggugacauguacaccaca

SEQ ID NO: 56823 - RNA, 18 nt, Artificial Sequence
  Description of Artificial Sequence: Synthetic oligonucleotide
aaucaggugacauguaca

SEQ ID NO: 56824 - RNA, 18 nt, Artificial Sequence
  Description of Artificial Sequence: Synthetic oligonucleotide
uguaguccugguggcaug

SEQ ID NO: 56825 - RNA, 18 nt, Artificial Sequence
  Description of Artificial Sequence: Synthetic oligonucleotide
gccccuguaguccuggug

SEQ ID NO: 56826 - RNA, 18 nt, Artificial Sequence
  Description of Artificial Sequence: Synthetic oligonucleotide
acucugccccuguagucc

SEQ ID NO: 56827 - RNA, 18 nt, Artificial Sequence
  Description of Artificial Sequence: Synthetic oligonucleotide
gagacacucugccccugu

SEQ ID NO: 56828 - RNA, 18 nt, Artificial Sequence
  Description of Artificial Sequence: Synthetic oligonucleotide
cagaggagacacucugcc

SEQ ID NO: 56829 - RNA, 18 nt, Artificial Sequence
  Description of Artificial Sequence: Synthetic oligonucleotide
gcugccagaggagacacu

SEQ ID NO: 56830 - RNA, 18 nt, Artificial Sequence
  Description of Artificial Sequence: Synthetic oligonucleotide
ucagagcugccagaggag

SEQ ID NO: 56831 - RNA, 18 nt, Artificial Sequence
  Description of Artificial Sequence: Synthetic oligonucleotide
ugaucucagagcugccag

SEQ ID NO: 56832 - RNA, 18 nt, Artificial Sequence
  Description of Artificial Sequence: Synthetic oligonucleotide
ggauuugaucucagagcu

SEQ ID NO: 56833 - RNA, 18 nt, Artificial Sequence
  Description of Artificial Sequence: Synthetic oligonucleotide
ucaucggauuugaucuca

SEQ ID NO: 56834 - RNA, 18 nt, Artificial Sequence
  Description of Artificial Sequence: Synthetic oligonucleotide
ccucgucaucggauuuga

SEQ ID NO: 56835 - RNA, 18 nt, Artificial Sequence
  Description of Artificial Sequence: Synthetic oligonucleotide
aucacccucgucaucgga

SEQ ID NO: 56836 - RNA, 18 nt, Artificial Sequence
  Description of Artificial Sequence: Synthetic oligonucleotide
uucucaucacccucguca

SEQ ID NO: 56837 - RNA, 18 nt, Artificial Sequence
  Description of Artificial Sequence: Synthetic oligonucleotide
gcagguucucaucacccu

SEQ ID NO: 56838 - RNA, 18 nt, Artificial Sequence
  Description of Artificial Sequence: Synthetic oligonucleotide
gucuugcagguucucauc

SEQ ID NO: 56839 - RNA, 18 nt, Artificial Sequence
  Description of Artificial Sequence: Synthetic oligonucleotide
uucgugucuugcagguuc

SEQ ID NO: 56840 - RNA, 18 nt, Artificial Sequence
  Description of Artificial Sequence: Synthetic oligonucleotide
aagauuucgugucuugca

SEQ ID NO: 56841 - RNA, 18 nt, Artificial Sequence
  Description of Artificial Sequence: Synthetic oligonucleotide
cuccgaagauuucguguc

SEQ ID NO: 56842 - RNA, 18 nt, Artificial Sequence
  Description of Artificial Sequence: Synthetic oligonucleotide
uuguccuccgaagauuuc

SEQ ID NO: 56843 - RNA, 18 nt, Artificial Sequence
  Description of Artificial Sequence: Synthetic oligonucleotide
auuucuuguccuccgaag

SEQ ID NO: 56844 - RNA, 18 nt, Artificial Sequence
  Description of Artificial Sequence: Synthetic oligonucleotide
aucuaauuucuuguccuc

SEQ ID NO: 56845 - RNA, 18 nt, Artificial Sequence
  Description of Artificial Sequence: Synthetic oligonucleotide
ucgucaucuaauuucuug

SEQ ID NO: 56846 - RNA, 18 nt, Artificial Sequence
  Description of Artificial Sequence: Synthetic oligonucleotide
ucuugucgucaucuaauu

SEQ ID NO: 56847 - RNA, 18 nt, Artificial Sequence
  Description of Artificial Sequence: Synthetic oligonucleotide
auccuucuugucgucauc

SEQ ID NO: 56848 - RNA, 18 nt, Artificial Sequence
  Description of Artificial Sequence: Synthetic oligonucleotide
uugauauccuucuugucg

SEQ ID NO: 56849 - RNA, 18 nt, Artificial Sequence
  Description of Artificial Sequence: Synthetic oligonucleotide
uugauuugauauccuucu

SEQ ID NO: 56850 - RNA, 18 nt, Artificial Sequence
  Description of Artificial Sequence: Synthetic oligonucleotide
aguaauugauuugauauc

SEQ ID NO: 56851 - RNA, 18 nt, Artificial Sequence
  Description of Artificial Sequence: Synthetic oligonucleotide
gaccuaguaauugauuug

SEQ ID NO: 56852 - RNA, 18 nt, Artificial Sequence
  Description of Artificial Sequence: Synthetic oligonucleotide
aucuugaccuaguaauug

SEQ ID NO: 56853 - RNA, 18 nt, Artificial Sequence
  Description of Artificial Sequence: Synthetic oligonucleotide
uucacgauggguccccac

SEQ ID NO: 56854 - RNA, 18 nt, Artificial Sequence
  Description of Artificial Sequence: Synthetic oligonucleotide
ccaucuucacgauggguc

SEQ ID NO: 56855 - RNA, 18 nt, Artificial Sequence
  Description of Artificial Sequence: Synthetic oligonucleotide
ccacgccaucuucacgau

SEQ ID NO: 56856 - RNA, 18 nt, Artificial Sequence
  Description of Artificial Sequence: Synthetic oligonucleotide
cagggccacgccaucuuc

SEQ ID NO: 56857 - RNA, 18 nt, Artificial Sequence
  Description of Artificial Sequence: Synthetic oligonucleotide
ccucucagggccacgcca

SEQ ID NO: 56858 - RNA, 18 nt, Artificial Sequence
  Description of Artificial Sequence: Synthetic oligonucleotide
ggcugccucucagggcca

SEQ ID NO: 56859 - RNA, 18 nt, Artificial Sequence
  Description of Artificial Sequence: Synthetic oligonucleotide
agaauggcugccucucag

SEQ ID NO: 56860 - RNA, 18 nt, Artificial Sequence
  Description of Artificial Sequence: Synthetic oligonucleotide
agaagagaauggcugccu

SEQ ID NO: 56861 - RNA, 18 nt, Artificial Sequence
  Description of Artificial Sequence: Synthetic oligonucleotide
uuggcagaagagaauggc

SEQ ID NO: 56862 - RNA, 18 nt, Artificial Sequence
  Description of Artificial Sequence: Synthetic oligonucleotide
cugguuuggcagaagaga

SEQ ID NO: 56863 - RNA, 18 nt, Artificial Sequence
  Description of Artificial Sequence: Synthetic oligonucleotide
ggaaccugguuuggcaga

SEQ ID NO: 56864 - RNA, 18 nt, Artificial Sequence
  Description of Artificial Sequence: Synthetic oligonucleotide
gaaccggaaccugguuug

SEQ ID NO: 56865 - RNA, 18 nt, Artificial Sequence
  Description of Artificial Sequence: Synthetic oligonucleotide
cuguggaaccggaaccug

SEQ ID NO: 56866 - RNA, 18 nt, Artificial Sequence
  Description of Artificial Sequence: Synthetic oligonucleotide
ggaagcuguggaaccgga

SEQ ID NO: 56867 - RNA, 18 nt, Artificial Sequence
  Description of Artificial Sequence: Synthetic oligonucleotide
ggacaggaagcuguggaa

SEQ ID NO: 56868 - RNA, 18 nt, Artificial Sequence
  Description of Artificial Sequence: Synthetic oligonucleotide
agacuggacaggaagcug

SEQ ID NO: 56869 - RNA, 18 nt, Artificial Sequence
  Description of Artificial Sequence: Synthetic oligonucleotide
gucgcagacuggacagga

SEQ ID NO: 56870 - RNA, 18 nt, Artificial Sequence
  Description of Artificial Sequence: Synthetic oligonucleotide
gggaagucgcagacugga

SEQ ID NO: 56871 - RNA, 18 nt, Artificial Sequence
  Description of Artificial Sequence: Synthetic oligonucleotide
gguggguucaggucaggg

SEQ ID NO: 56872 - RNA, 18 nt, Artificial Sequence
  Description of Artificial Sequence: Synthetic oligonucleotide
ggguggguucaggucagg

SEQ ID NO: 56873 - RNA, 18 nt, Artificial Sequence
  Description of Artificial Sequence: Synthetic oligonucleotide
cucuguaaggguccuggg

SEQ ID NO: 56874 - RNA, 18 nt, Artificial Sequence
  Description of Artificial Sequence: Synthetic oligonucleotide
gugcccuggugaggccaa

SEQ ID NO: 56875 - RNA, 18 nt, Artificial Sequence
  Description of Artificial Sequence: Synthetic oligonucleotide
cagaagugcccuggugag

SEQ ID NO: 56876 - RNA, 18 nt, Artificial Sequence
  Description of Artificial Sequence: Synthetic oligonucleotide
gaggucagaagugcccug

SEQ ID NO: 56877 - RNA, 18 nt, Artificial Sequence
  Description of Artificial Sequence: Synthetic oligonucleotide
aaagugaggucagaagug

SEQ ID NO: 56878 - RNA, 18 nt, Artificial Sequence
  Description of Artificial Sequence: Synthetic oligonucleotide
uugugaaagugaggucag

SEQ ID NO: 56879 - RNA, 18 nt, Artificial Sequence
  Description of Artificial Sequence: Synthetic oligonucleotide
uccuauugugaaagugag

SEQ ID NO: 56880 - RNA, 18 nt, Artificial Sequence
  Description of Artificial Sequence: Synthetic oligonucleotide
acugguccuauugugaaa

SEQ ID NO: 56881 - RNA, 18 nt, Artificial Sequence
  Description of Artificial Sequence: Synthetic oligonucleotide
ucaacacugguccuauug

SEQ ID NO: 56882 - RNA, 18 nt, Artificial Sequence
  Description of Artificial Sequence: Synthetic oligonucleotide
ggguaucaacacuggucc

SEQ ID NO: 56883 - RNA, 18 nt, Artificial Sequence
  Description of Artificial Sequence: Synthetic oligonucleotide
aggcuggguaucaacacu

SEQ ID NO: 56884 - RNA, 18 nt, Artificial Sequence
  Description of Artificial Sequence: Synthetic oligonucleotide
ccaagaggcuggguauca

SEQ ID NO: 56885 - RNA, 18 nt, Artificial Sequence
  Description of Artificial Sequence: Synthetic oligonucleotide
gaacaccaagaggcuggg

SEQ ID NO: 56886 - RNA, 18 nt, Artificial Sequence
  Description of Artificial Sequence: Synthetic oligonucleotide
gggaugaacaccaagagg

SEQ ID NO: 56887 - RNA, 18 nt, Artificial Sequence
  Description of Artificial Sequence: Synthetic oligonucleotide
cuugagggaugaacacca

SEQ ID NO: 56888 - RNA, 18 nt, Artificial Sequence
  Description of Artificial Sequence: Synthetic oligonucleotide
ugcuucuugagggaugaa

SEQ ID NO: 56889 - RNA, 18 nt, Artificial Sequence
  Description of Artificial Sequence: Synthetic oligonucleotide
gccagugcuucuugaggg

SEQ ID NO: 56890 - RNA, 18 nt, Artificial Sequence
  Description of Artificial Sequence: Synthetic oligonucleotide
uuucugccagugcuucuu

SEQ ID NO: 56891 - RNA, 18 nt, Artificial Sequence
  Description of Artificial Sequence: Synthetic oligonucleotide
cuggguuucugccagugc

SEQ ID NO: 56892 - RNA, 18 nt, Artificial Sequence
  Description of Artificial Sequence: Synthetic oligonucleotide
gauuccuggguuucugcc

SEQ ID NO: 56893 - RNA, 18 nt, Artificial Sequence
  Description of Artificial Sequence: Synthetic oligonucleotide
aauuugauuccuggguuu

SEQ ID NO: 56894 - RNA, 18 nt, Artificial Sequence
  Description of Artificial Sequence: Synthetic oligonucleotide
ugcccaauuugauuccug

SEQ ID NO: 56895 - RNA, 18 nt, Artificial Sequence
  Description of Artificial Sequence: Synthetic oligonucleotide
uuuugugcccaauuugau

SEQ ID NO: 56896 - RNA, 18 nt, Artificial Sequence
  Description of Artificial Sequence: Synthetic oligonucleotide
accauuuuugugcccaau

SEQ ID NO: 56897 - RNA, 18 nt, Artificial Sequence
  Description of Artificial Sequence: Synthetic oligonucleotide
uccuuaccauuuuugugc

SEQ ID NO: 56898 - RNA, 18 nt, Artificial Sequence
  Description of Artificial Sequence: Synthetic oligonucleotide
ccauuuccuuaccauuuu

SEQ ID NO: 56899 - RNA, 18 nt, Artificial Sequence
  Description of Artificial Sequence: Synthetic oligonucleotide
cuuugccauuuccuuacc

SEQ ID NO: 56900 - RNA, 18 nt, Artificial Sequence
  Description of Artificial Sequence: Synthetic oligonucleotide
aaauacuuugccauuucc

SEQ ID NO: 56901 - RNA, 18 nt, Artificial Sequence
  Description of Artificial Sequence: Synthetic oligonucleotide
guucuaaauacuuugcca

SEQ ID NO: 56902 - RNA, 18 nt, Artificial Sequence
  Description of Artificial Sequence: Synthetic oligonucleotide
gcgaaguucuaaauacuu

SEQ ID NO: 56903 - RNA, 18 nt, Artificial Sequence
  Description of Artificial Sequence: Synthetic oligonucleotide
agcgggcgaaguucuaaa

SEQ ID NO: 56904 - RNA, 18 nt, Artificial Sequence
  Description of Artificial Sequence: Synthetic oligonucleotide
caauuagcgggcgaaguu

SEQ ID NO: 56905 - RNA, 18 nt, Artificial Sequence
  Description of Artificial Sequence: Synthetic oligonucleotide
aaacacaauuagcgggcg

SEQ ID NO: 56906 - RNA, 18 nt, Artificial Sequence
  Description of Artificial Sequence: Synthetic oligonucleotide
uggagaaacacaauuagc

SEQ ID NO: 56907 - RNA, 18 nt, Artificial Sequence
  Description of Artificial Sequence: Synthetic oligonucleotide
gucccuggagaaacacaa

SEQ ID NO: 56908 - RNA, 18 nt, Artificial Sequence
  Description of Artificial Sequence: Synthetic oligonucleotide
aaacagucccuggagaaa

SEQ ID NO: 56909 - RNA, 18 nt, Artificial Sequence
  Description of Artificial Sequence: Synthetic oligonucleotide
gaggaaaacagucccugg

SEQ ID NO: 56910 - RNA, 18 nt, Artificial Sequence
  Description of Artificial Sequence: Synthetic oligonucleotide
uguuugaggaaaacaguc

SEQ ID NO: 56911 - RNA, 18 nt, Artificial Sequence
  Description of Artificial Sequence: Synthetic oligonucleotide
gaggauguuugaggaaaa

SEQ ID NO: 56912 - RNA, 18 nt, Artificial Sequence
  Description of Artificial Sequence: Synthetic oligonucleotide
uuucagaggauguuugag

SEQ ID NO: 56913 - RNA, 18 nt, Artificial Sequence
  Description of Artificial Sequence: Synthetic oligonucleotide
caggauuucagaggaugu

SEQ ID NO: 56914 - RNA, 18 nt, Artificial Sequence
  Description of Artificial Sequence: Synthetic oligonucleotide
aggaccaggauuucagag

SEQ ID NO: 56915 - RNA, 18 nt, Artificial Sequence
  Description of Artificial Sequence: Synthetic oligonucleotide
gauauaggaccaggauuu

SEQ ID NO: 56916 - RNA, 18 nt, Artificial Sequence
  Description of Artificial Sequence: Synthetic oligonucleotide
cugcugauauaggaccag

SEQ ID NO: 56917 - RNA, 18 nt, Artificial Sequence
  Description of Artificial Sequence: Synthetic oligonucleotide
auucccugcugauauagg

SEQ ID NO: 56918 - RNA, 18 nt, Artificial Sequence
  Description of Artificial Sequence: Synthetic oligonucleotide
gccucauucccugcugau

SEQ ID NO: 56919 - RNA, 18 nt, Artificial Sequence
  Description of Artificial Sequence: Synthetic oligonucleotide
cuguggccucauucccug

SEQ ID NO: 56920 - RNA, 18 nt, Artificial Sequence
  Description of Artificial Sequence: Synthetic oligonucleotide
ucagucuguggccucauu

SEQ ID NO: 56921 - RNA, 18 nt, Artificial Sequence
  Description of Artificial Sequence: Synthetic oligonucleotide
ucucaucagucuguggcc

SEQ ID NO: 56922 - RNA, 18 nt, Artificial Sequence
  Description of Artificial Sequence: Synthetic oligonucleotide
uuuccucucaucagucug

SEQ ID NO: 56923 - RNA, 18 nt, Artificial Sequence
  Description of Artificial Sequence: Synthetic oligonucleotide
uaaaauuuccucucauca

SEQ ID NO: 56924 - RNA, 18 nt, Artificial Sequence
  Description of Artificial Sequence: Synthetic oligonucleotide
uaaaauaaaauuuccucu

SEQ ID NO: 56925 - RNA, 18 nt, Artificial Sequence
  Description of Artificial Sequence: Synthetic oligonucleotide
auagcuaaaauaaaauuu

SEQ ID NO: 56926 - RNA, 18 nt, Artificial Sequence
  Description of Artificial Sequence: Synthetic oligonucleotide
uggaaauagcuaaaauaa

SEQ ID NO: 56927 - RNA, 18 nt, Artificial Sequence
  Description of Artificial Sequence: Synthetic oligonucleotide
aaauguggaaauagcuaa

SEQ ID NO: 56928 - RNA, 18 nt, Artificial Sequence
  Description of Artificial Sequence: Synthetic oligonucleotide
gagaaaaauguggaaaua

SEQ ID NO: 56929 - RNA, 18 nt, Artificial Sequence
  Description of Artificial Sequence: Synthetic oligonucleotide
ugaaugagaaaaaugugg

SEQ ID NO: 56930 - RNA, 18 nt, Artificial Sequence
  Description of Artificial Sequence: Synthetic oligonucleotide
ggaccugaaugagaaaaa

SEQ ID NO: 56931 - RNA, 18 nt, Artificial Sequence
  Description of Artificial Sequence: Synthetic oligonucleotide
uuagaggaccugaaugag

SEQ ID NO: 56932 - RNA, 18 nt, Artificial Sequence
  Description of Artificial Sequence: Synthetic oligonucleotide
ccacauuagaggaccuga

SEQ ID NO: 56933 - RNA, 18 nt, Artificial Sequence
  Description of Artificial Sequence: Synthetic oligonucleotide
acuaaccacauuagagga

SEQ ID NO: 56934 - RNA, 18 nt, Artificial Sequence
  Description of Artificial Sequence: Synthetic oligonucleotide
ccacaacuaaccacauua

SEQ ID NO: 56935 - RNA, 18 nt, Artificial Sequence
  Description of Artificial Sequence: Synthetic oligonucleotide
ucaggccacaacuaacca

SEQ ID NO: 56936 - RNA, 18 nt, Artificial Sequence
  Description of Artificial Sequence: Synthetic oligonucleotide
cauuuucaggccacaacu

SEQ ID NO: 56937 - RNA, 18 nt, Artificial Sequence
  Description of Artificial Sequence: Synthetic oligonucleotide
aauaucauuuucaggcca

SEQ ID NO: 56938 - RNA, 18 nt, Artificial Sequence
  Description of Artificial Sequence: Synthetic oligonucleotide
uuggaaauaucauuuuca

SEQ ID NO: 56939 - RNA, 18 nt, Artificial Sequence
  Description of Artificial Sequence: Synthetic oligonucleotide
uucauuuggaaauaucau

SEQ ID NO: 56940 - RNA, 18 nt, Artificial Sequence
  Description of Artificial Sequence: Synthetic oligonucleotide
uccuauucauuuggaaau

SEQ ID NO: 56941 - RNA, 18 nt, Artificial Sequence
  Description of Artificial Sequence: Synthetic oligonucleotide
uuccuuccuauucauuug

SEQ ID NO: 56942 - RNA, 18 nt, Artificial Sequence
  Description of Artificial Sequence: Synthetic oligonucleotide
uuuccuuccuuccuauuc

SEQ ID NO: 56943 - RNA, 18 nt, Artificial Sequence
  Description of Artificial Sequence: Synthetic oligonucleotide
aacaauuuccuuccuucc

SEQ ID NO: 56944 - RNA, 18 nt, Artificial Sequence
  Description of Artificial Sequence: Synthetic oligonucleotide
acaaaaacaauuuccuuc

SEQ ID NO: 56945 - RNA, 18 nt, Artificial Sequence
  Description of Artificial Sequence: Synthetic oligonucleotide
aaacaacaaaaacaauuu

SEQ ID NO: 56946 - RNA, 18 nt, Artificial Sequence
  Description of Artificial Sequence: Synthetic oligonucleotide
aucuuaaacaacaaaaac

SEQ ID NO: 56947 - RNA, 18 nt, Artificial Sequence
  Description of Artificial Sequence: Synthetic oligonucleotide
cuuccaucuuaaacaaca

SEQ ID NO: 56948 - RNA, 18 nt, Artificial Sequence
  Description of Artificial Sequence: Synthetic oligonucleotide
auuuccuuccaucuuaaa

SEQ ID NO: 56949 - RNA, 18 nt, Artificial Sequence
  Description of Artificial Sequence: Synthetic oligonucleotide
ccuauauuuccuuccauc

SEQ ID NO: 56950 - RNA, 18 nt, Artificial Sequence
  Description of Artificial Sequence: Synthetic oligonucleotide
augcaccuauauuuccuu

SEQ ID NO: 56951 - RNA, 18 nt, Artificial Sequence
  Description of Artificial Sequence: Synthetic oligonucleotide
uuuaaaugcaccuauauu

SEQ ID NO: 56952 - RNA, 18 nt, Artificial Sequence
  Description of Artificial Sequence: Synthetic oligonucleotide
cauuuuuuaaaugcaccu

SEQ ID NO: 56953 - RNA, 18 nt, Artificial Sequence
  Description of Artificial Sequence: Synthetic oligonucleotide
agcuccauuuuuuaaaug

SEQ ID NO: 56954 - RNA, 18 nt, Artificial Sequence
  Description of Artificial Sequence: Synthetic oligonucleotide
aaccaagcuccauuuuuu

SEQ ID NO: 56955 - RNA, 18 nt, Artificial Sequence
  Description of Artificial Sequence: Synthetic oligonucleotide
caugcaaccaagcuccau

SEQ ID NO: 56956 - RNA, 18 nt, Artificial Sequence
  Description of Artificial Sequence: Synthetic oligonucleotide
aaaaucaugcaaccaagc

SEQ ID NO: 56957 - RNA, 18 nt, Artificial Sequence
  Description of Artificial Sequence: Synthetic oligonucleotide
gagcgaaaaucaugcaac

SEQ ID NO: 56958 - RNA, 18 nt, Artificial Sequence
  Description of Artificial Sequence: Synthetic oligonucleotide
cucaagagcgaaaaucau

SEQ ID NO: 56959 - RNA, 18 nt, Artificial Sequence
  Description of Artificial Sequence: Synthetic oligonucleotide
gaugacucaagagcgaaa

SEQ ID NO: 56960 - RNA, 18 nt, Artificial Sequence
  Description of Artificial Sequence: Synthetic oligonucleotide
ggcuagaugacucaagag

SEQ ID NO: 56961 - RNA, 18 nt, Artificial Sequence
  Description of Artificial Sequence: Synthetic oligonucleotide
uagagggcuagaugacuc

SEQ ID NO: 56962 - RNA, 18 nt, Artificial Sequence
  Description of Artificial Sequence: Synthetic oligonucleotide
aucauuagagggcuagau

SEQ ID NO: 56963 - RNA, 18 nt, Artificial Sequence
  Description of Artificial Sequence: Synthetic oligonucleotide
aggcaaucauuagagggc

SEQ ID NO: 56964 - RNA, 18 nt, Artificial Sequence
  Description of Artificial Sequence: Synthetic oligonucleotide
guaugaggcaaucauuag

SEQ ID NO: 56965 - RNA, 18 nt, Artificial Sequence
  Description of Artificial Sequence: Synthetic oligonucleotide
caccgguaugaggcaauc

SEQ ID NO: 56966 - RNA, 18 nt, Artificial Sequence
  Description of Artificial Sequence: Synthetic oligonucleotide
guaaucaccgguaugagg

SEQ ID NO: 56967 - RNA, 18 nt, Artificial Sequence
  Description of Artificial Sequence: Synthetic oligonucleotide
cgcucguaaucaccggua

SEQ ID NO: 56968 - RNA, 18 nt, Artificial Sequence
  Description of Artificial Sequence: Synthetic oligonucleotide
aaagccgcucguaaucac

SEQ ID NO: 56969 - RNA, 18 nt, Artificial Sequence
  Description of Artificial Sequence: Synthetic oligonucleotide
caugaaaagccgcucgua

SEQ ID NO: 56970 - RNA, 18 nt, Artificial Sequence
  Description of Artificial Sequence: Synthetic oligonucleotide
gggucaugaaaagccgcu

SEQ ID NO: 56971 - RNA, 18 nt, Artificial Sequence
  Description of Artificial Sequence: Synthetic oligonucleotide
aaaugguacauauggaag

SEQ ID NO: 56972 - RNA, 18 nt, Artificial Sequence
  Description of Artificial Sequence: Synthetic oligonucleotide
uuuuaaaaugguacauau

SEQ ID NO: 56973 - RNA, 18 nt, Artificial Sequence
  Description of Artificial Sequence: Synthetic oligonucleotide
cagcauuuuaaaauggua

SEQ ID NO: 56974 - RNA, 18 nt, Artificial Sequence
  Description of Artificial Sequence: Synthetic oligonucleotide
guaaucagcauuuuaaaa

SEQ ID NO: 56975 - RNA, 18 nt, Artificial Sequence
  Description of Artificial Sequence: Synthetic oligonucleotide
aagaaguaaucagcauuu

SEQ ID NO: 56976 - RNA, 18 nt, Artificial Sequence
  Description of Artificial Sequence: Synthetic oligonucleotide
uucucaagaaguaaucag

SEQ ID NO: 56977 - RNA, 18 nt, Artificial Sequence
  Description of Artificial Sequence: Synthetic oligonucleotide
ucuuauucucaagaagua

SEQ ID NO: 56978 - RNA, 18 nt, Artificial Sequence
  Description of Artificial Sequence: Synthetic oligonucleotide
gcuucucuuauucucaag

SEQ ID NO: 56979 - RNA, 18 nt, Artificial Sequence
  Description of Artificial Sequence: Synthetic oligonucleotide
auuaggcuucucuuauuc

SEQ ID NO: 56980 - RNA, 18 nt, Artificial Sequence
  Description of Artificial Sequence: Synthetic oligonucleotide
cugaaauuaggcuucucu

SEQ ID NO: 56981 - RNA, 18 nt, Artificial Sequence
  Description of Artificial Sequence: Synthetic oligonucleotide
auauucugaaauuaggcu

SEQ ID NO: 56982 - RNA, 18 nt, Artificial Sequence
  Description of Artificial Sequence: Synthetic oligonucleotide
uaaugauauucugaaauu

SEQ ID NO: 56983 - RNA, 18 nt, Artificial Sequence
  Description of Artificial Sequence: Synthetic oligonucleotide
uacccuaaugauauucug

SEQ ID NO: 56984 - RNA, 18 nt, Artificial Sequence
  Description of Artificial Sequence: Synthetic oligonucleotide
auagguacccuaaugaua

SEQ ID NO: 56985 - RNA, 18 nt, Artificial Sequence
  Description of Artificial Sequence: Synthetic oligonucleotide
cuucaauagguacccuaa

SEQ ID NO: 56986 - RNA, 18 nt, Artificial Sequence
  Description of Artificial Sequence: Synthetic oligonucleotide
caagacuucaauagguac

SEQ ID NO: 56987 - RNA, 18 nt, Artificial Sequence
  Description of Artificial Sequence: Synthetic oligonucleotide
gcagucaagacuucaaua

SEQ ID NO: 56988 - RNA, 18 nt, Artificial Sequence
  Description of Artificial Sequence: Synthetic oligonucleotide
uaugugcagucaagacuu

SEQ ID NO: 56989 - RNA, 18 nt, Artificial Sequence
  Description of Artificial Sequence: Synthetic oligonucleotide
cuaaauaugugcagucaa

SEQ ID NO: 56990 - RNA, 18 nt, Artificial Sequence
  Description of Artificial Sequence: Synthetic oligonucleotide
guaugcuaaauaugugca

SEQ ID NO: 56991 - RNA, 18 nt, Artificial Sequence
  Description of Artificial Sequence: Synthetic oligonucleotide
agggaguaugcuaaauau

SEQ ID NO: 56992 - RNA, 18 nt, Artificial Sequence
  Description of Artificial Sequence: Synthetic oligonucleotide
uucccagggaguaugcua

SEQ ID NO: 56993 - RNA, 18 nt, Artificial Sequence
  Description of Artificial Sequence: Synthetic oligonucleotide
uauaauucccagggagua

SEQ ID NO: 56994 - RNA, 18 nt, Artificial Sequence
  Description of Artificial Sequence: Synthetic oligonucleotide
uaaaauauaauucccagg

SEQ ID NO: 56995 - RNA, 18 nt, Artificial Sequence
  Description of Artificial Sequence: Synthetic oligonucleotide
guccuuaaaauauaauuc

SEQ ID NO: 56996 - RNA, 18 nt, Artificial Sequence
  Description of Artificial Sequence: Synthetic oligonucleotide
aaaauguccuuaaaauau

SEQ ID NO: 56997 - RNA, 18 nt, Artificial Sequence
  Description of Artificial Sequence: Synthetic oligonucleotide
auagaaaaauguccuuaa

SEQ ID NO: 56998 - RNA, 18 nt, Artificial Sequence
  Description of Artificial Sequence: Synthetic oligonucleotide
auuuaauagaaaaauguc

SEQ ID NO: 56999 - RNA, 18 nt, Artificial Sequence
  Description of Artificial Sequence: Synthetic oligonucleotide
caaugauuuaauagaaaa

SEQ ID NO: 57000 - RNA, 18 nt, Artificial Sequence
  Description of Artificial Sequence: Synthetic oligonucleotide
auaugcaaugauuuaaua

SEQ ID NO: 57001 - RNA, 18 nt, Artificial Sequence
  Description of Artificial Sequence: Synthetic oligonucleotide
cuuccauaugcaaugauu

SEQ ID NO: 57002 - RNA, 18 nt, Artificial Sequence
  Description of Artificial Sequence: Synthetic oligonucleotide
aguuucuuccauaugcaa

SEQ ID NO: 57003 - RNA, 18 nt, Artificial Sequence
  Description of Artificial Sequence: Synthetic oligonucleotide
uauugaguuucuuccaua

SEQ ID NO: 57004 - RNA, 18 nt, Artificial Sequence
  Description of Artificial Sequence: Synthetic oligonucleotide
uauuauauugaguuucuu

SEQ ID NO: 57005 - RNA, 18 nt, Artificial Sequence
  Description of Artificial Sequence: Synthetic oligonucleotide
ucagcuauuauauugagu

SEQ ID NO: 57006 - RNA, 18 nt, Artificial Sequence
  Description of Artificial Sequence: Synthetic oligonucleotide
aaauaucagcuauuauau

SEQ ID NO: 57007 - RNA, 18 nt, Artificial Sequence
  Description of Artificial Sequence: Synthetic oligonucleotide
caaguaaauaucagcuau

SEQ ID NO: 57008 - RNA, 18 nt, Artificial Sequence
  Description of Artificial Sequence: Synthetic oligonucleotide
gaacccaaguaaauauca

SEQ ID NO: 57009 - RNA, 18 nt, Artificial Sequence
  Description of Artificial Sequence: Synthetic oligonucleotide
auuaagaacccaaguaaa

SEQ ID NO: 57010 - RNA, 18 nt, Artificial Sequence
  Description of Artificial Sequence: Synthetic oligonucleotide
uucugauuaagaacccaa

SEQ ID NO: 57011 - RNA, 18 nt, Artificial Sequence
  Description of Artificial Sequence: Synthetic oligonucleotide
caauguucugauuaagaa

SEQ ID NO: 57012 - RNA, 18 nt, Artificial Sequence
  Description of Artificial Sequence: Synthetic oligonucleotide
acagccaauguucugauu

SEQ ID NO: 57013 - RNA, 18 nt, Artificial Sequence
  Description of Artificial Sequence: Synthetic oligonucleotide
aucacacagccaauguuc

SEQ ID NO: 57014 - RNA, 18 nt, Artificial Sequence
  Description of Artificial Sequence: Synthetic oligonucleotide
ugaaaaucacacagccaa

SEQ ID NO: 57015 - RNA, 18 nt, Artificial Sequence
  Description of Artificial Sequence: Synthetic oligonucleotide
aaucaugaaaaucacaca

SEQ ID NO: 57016 - RNA, 18 nt, Artificial Sequence
  Description of Artificial Sequence: Synthetic oligonucleotide
aucauaaucaugaaaauc

SEQ ID NO: 57017 - RNA, 18 nt, Artificial Sequence
  Description of Artificial Sequence: Synthetic oligonucleotide
ugaaaaucauaaucauga

SEQ ID NO: 57018 - RNA, 18 nt, Artificial Sequence
  Description of Artificial Sequence: Synthetic oligonucleotide
ugcaaugaaaaucauaau

SEQ ID NO: 57019 - RNA, 18 nt, Artificial Sequence
  Description of Artificial Sequence: Synthetic oligonucleotide
uuaauugcaaugaaaauc

SEQ ID NO: 57020 - RNA, 18 nt, Artificial Sequence
  Description of Artificial Sequence: Synthetic oligonucleotide
ucaacuuaauugcaauga

SEQ ID NO: 57021 - RNA, 18 nt, Artificial Sequence
  Description of Artificial Sequence: Synthetic oligonucleotide
aaacaucaacuuaauugc

SEQ ID NO: 57022 - RNA, 18 nt, Artificial Sequence
  Description of Artificial Sequence: Synthetic oligonucleotide
cuacaaaacaucaacuua

SEQ ID NO: 57023 - RNA, 18 nt, Artificial Sequence
  Description of Artificial Sequence: Synthetic oligonucleotide
acugucuacaaaacauca

SEQ ID NO: 57024 - RNA, 18 nt, Artificial Sequence
  Description of Artificial Sequence: Synthetic oligonucleotide
auuucacugucuacaaaa

SEQ ID NO: 57025 - RNA, 18 nt, Artificial Sequence
  Description of Artificial Sequence: Synthetic oligonucleotide
ugguaauuucacugucua

SEQ ID NO: 57026 - RNA, 18 nt, Artificial Sequence
  Description of Artificial Sequence: Synthetic oligonucleotide
guagaugguaauuucacu

SEQ ID NO: 57027 - RNA, 18 nt, Artificial Sequence
  Description of Artificial Sequence: Synthetic oligonucleotide
uuggaguagaugguaauu

SEQ ID NO: 57028 - RNA, 18 nt, Artificial Sequence
  Description of Artificial Sequence: Synthetic oligonucleotide
aucuuuuggaguagaugg

SEQ ID NO: 57029 - RNA, 18 nt, Artificial Sequence
  Description of Artificial Sequence: Synthetic oligonucleotide
uugcaaucuuuuggagua

SEQ ID NO: 57030 - RNA, 18 nt, Artificial Sequence
  Description of Artificial Sequence: Synthetic oligonucleotide
cuauuuugcaaucuuuug

SEQ ID NO: 57031 - RNA, 18 nt, Artificial Sequence
  Description of Artificial Sequence: Synthetic oligonucleotide
aaauucuauuuugcaauc

SEQ ID NO: 57032 - RNA, 18 nt, Artificial Sequence
  Description of Artificial Sequence: Synthetic oligonucleotide
agguuaaauucuauuuug

SEQ ID NO: 57033 - RNA, 18 nt, Artificial Sequence
  Description of Artificial Sequence: Synthetic oligonucleotide
cucuaagguuaaauucua

SEQ ID NO: 57034 - RNA, 18 nt, Artificial Sequence
  Description of Artificial Sequence: Synthetic oligonucleotide
auuggcucuaagguuaaa

SEQ ID NO: 57035 - RNA, 18 nt, Artificial Sequence
  Description of Artificial Sequence: Synthetic oligonucleotide
ccugcauuggcucuaagg

SEQ ID NO: 57036 - RNA, 18 nt, Artificial Sequence
  Description of Artificial Sequence: Synthetic oligonucleotide
uuuucccugcauuggcuc

SEQ ID NO: 57037 - RNA, 18 nt, Artificial Sequence
  Description of Artificial Sequence: Synthetic oligonucleotide
acaaguuuucccugcauu

SEQ ID NO: 57038 - RNA, 18 nt, Artificial Sequence
  Description of Artificial Sequence: Synthetic oligonucleotide
cagaaacaaguuuucccu

SEQ ID NO: 57039 - RNA, 18 nt, Artificial Sequence
  Description of Artificial Sequence: Synthetic oligonucleotide
accugcagaaacaaguuu

SEQ ID NO: 57040 - RNA, 18 nt, Artificial Sequence
  Description of Artificial Sequence: Synthetic oligonucleotide
aaugcaccugcagaaaca

SEQ ID NO: 57041 - RNA, 18 nt, Artificial Sequence
  Description of Artificial Sequence: Synthetic oligonucleotide
caaaaaaugcaccugcag

SEQ ID NO: 57042 - RNA, 18 nt, Artificial Sequence
  Description of Artificial Sequence: Synthetic oligonucleotide
aguuucaaaaaaugcacc

SEQ ID NO: 57043 - RNA, 18 nt, Artificial Sequence
  Description of Artificial Sequence: Synthetic oligonucleotide
guugaaguuucaaaaaau

SEQ ID NO: 57044 - RNA, 18 nt, Artificial Sequence
  Description of Artificial Sequence: Synthetic oligonucleotide
uaucuguugaaguuucaa

SEQ ID NO: 57045 - RNA, 18 nt, Artificial Sequence
  Description of Artificial Sequence: Synthetic oligonucleotide
ccugcuaucuguugaagu

SEQ ID NO: 57046 - RNA, 18 nt, Artificial Sequence
  Description of Artificial Sequence: Synthetic oligonucleotide
uucccccugcuaucuguu

SEQ ID NO: 57047 - RNA, 18 nt, Artificial Sequence
  Description of Artificial Sequence: Synthetic oligonucleotide
uuuuuuucccccugcuau

SEQ ID NO: 57048 - RNA, 18 nt, Artificial Sequence
  Description of Artificial Sequence: Synthetic oligonucleotide
ucacuuuuuuuucccccu

SEQ ID NO: 57049 - RNA, 18 nt, Artificial Sequence
  Description of Artificial Sequence: Synthetic oligonucleotide
uucugucacuuuuuuuuc

SEQ ID NO: 57050 - RNA, 18 nt, Artificial Sequence
  Description of Artificial Sequence: Synthetic oligonucleotide
gauccuucugucacuuuu

SEQ ID NO: 57051 - RNA, 18 nt, Artificial Sequence
  Description of Artificial Sequence: Synthetic oligonucleotide
acugugauccuucuguca

SEQ ID NO: 57052 - RNA, 18 nt, Artificial Sequence
  Description of Artificial Sequence: Synthetic oligonucleotide
gcugaacugugauccuuc

SEQ ID NO: 57053 - RNA, 18 nt, Artificial Sequence
  Description of Artificial Sequence: Synthetic oligonucleotide
auacugcugaacugugau

SEQ ID NO: 57054 - RNA, 18 nt, Artificial Sequence
  Description of Artificial Sequence: Synthetic oligonucleotide
aauucauacugcugaacu

SEQ ID NO: 57055 - RNA, 18 nt, Artificial Sequence
  Description of Artificial Sequence: Synthetic oligonucleotide
cagacaauucauacugcu

SEQ ID NO: 57056 - RNA, 18 nt, Artificial Sequence
  Description of Artificial Sequence: Synthetic oligonucleotide
gccagcagacaauucaua

SEQ ID NO: 57057 - RNA, 18 nt, Artificial Sequence
  Description of Artificial Sequence: Synthetic oligonucleotide
aggcugccagcagacaau

SEQ ID NO: 57058 - RNA, 18 nt, Artificial Sequence
  Description of Artificial Sequence: Synthetic oligonucleotide
uugcaaggcugccagcag

SEQ ID NO: 57059 - RNA, 18 nt, Artificial Sequence
  Description of Artificial Sequence: Synthetic oligonucleotide
ccagauugcaaggcugcc

SEQ ID NO: 57060 - RNA, 18 nt, Artificial Sequence
  Description of Artificial Sequence: Synthetic oligonucleotide
gcacaccagauugcaagg

SEQ ID NO: 57061 - RNA, 18 nt, Artificial Sequence
  Description of Artificial Sequence: Synthetic oligonucleotide
ugccugcacaccagauug

SEQ ID NO: 57062 - RNA, 18 nt, Artificial Sequence
  Description of Artificial Sequence: Synthetic oligonucleotide
cucacugccugcacacca

SEQ ID NO: 57063 - RNA, 18 nt, Artificial Sequence
  Description of Artificial Sequence: Synthetic oligonucleotide
acaaucucacugccugca

SEQ ID NO: 57064 - RNA, 18 nt, Artificial Sequence
  Description of Artificial Sequence: Synthetic oligonucleotide
acaccacaaucucacugc

SEQ ID NO: 57065 - RNA, 18 nt, Artificial Sequence
  Description of Artificial Sequence: Synthetic oligonucleotide
cauguacaccacaaucuc

SEQ ID NO: 57066 - RNA, 18 nt, Artificial Sequence
  Description of Artificial Sequence: Synthetic oligonucleotide
ggugacauguacaccaca

SEQ ID NO: 57067 - RNA, 18 nt, Artificial Sequence
  Description of Artificial Sequence: Synthetic oligonucleotide
aaucaggugacauguaca

SEQ ID NO: 57068 - RNA, 18 nt, Artificial Sequence
  Description of Artificial Sequence: Synthetic oligonucleotide
uguaguccugguggcaug

SEQ ID NO: 57069 - RNA, 18 nt, Artificial Sequence
  Description of Artificial Sequence: Synthetic oligonucleotide
gccccuguaguccuggug

SEQ ID NO: 57070 - RNA, 18 nt, Artificial Sequence
  Description of Artificial Sequence: Synthetic oligonucleotide
acucugccccuguagucc

SEQ ID NO: 57071 - RNA, 18 nt, Artificial Sequence
  Description of Artificial Sequence: Synthetic oligonucleotide
gagacacucugccccugu

SEQ ID NO: 57072 - RNA, 18 nt, Artificial Sequence
  Description of Artificial Sequence: Synthetic oligonucleotide
cagaggagacacucugcc

SEQ ID NO: 57073 - RNA, 18 nt, Artificial Sequence
  Description of Artificial Sequence: Synthetic oligonucleotide
gcugccagaggagacacu

SEQ ID NO: 57074 - RNA, 18 nt, Artificial Sequence
  Description of Artificial Sequence: Synthetic oligonucleotide
ucagagcugccagaggag

SEQ ID NO: 57075 - RNA, 18 nt, Artificial Sequence
  Description of Artificial Sequence: Synthetic oligonucleotide
ugaucucagagcugccag

SEQ ID NO: 57076 - RNA, 18 nt, Artificial Sequence
  Description of Artificial Sequence: Synthetic oligonucleotide
ggauuugaucucagagcu

SEQ ID NO: 57077 - RNA, 18 nt, Artificial Sequence
  Description of Artificial Sequence: Synthetic oligonucleotide
ucaucggauuugaucuca

SEQ ID NO: 57078 - RNA, 18 nt, Artificial Sequence
  Description of Artificial Sequence: Synthetic oligonucleotide
ccucgucaucggauuuga

SEQ ID NO: 57079 - RNA, 18 nt, Artificial Sequence
  Description of Artificial Sequence: Synthetic oligonucleotide
aucacccucgucaucgga

SEQ ID NO: 57080 - RNA, 18 nt, Artificial Sequence
  Description of Artificial Sequence: Synthetic oligonucleotide
uucucaucacccucguca

SEQ ID NO: 57081 - RNA, 18 nt, Artificial Sequence
  Description of Artificial Sequence: Synthetic oligonucleotide
gcagguucucaucacccu

SEQ ID NO: 57082 - RNA, 18 nt, Artificial Sequence
  Description of Artificial Sequence: Synthetic oligonucleotide
gucuugcagguucucauc

SEQ ID NO: 57083 - RNA, 18 nt, Artificial Sequence
  Description of Artificial Sequence: Synthetic oligonucleotide
uucgugucuugcagguuc

SEQ ID NO: 57084 - RNA, 18 nt, Artificial Sequence
  Description of Artificial Sequence: Synthetic oligonucleotide
aagauuucgugucuugca

SEQ ID NO: 57085 - RNA, 18 nt, Artificial Sequence
  Description of Artificial Sequence: Synthetic oligonucleotide
cuccgaagauuucguguc

SEQ ID NO: 57086 - RNA, 18 nt, Artificial Sequence
  Description of Artificial Sequence: Synthetic oligonucleotide
uuguccuccgaagauuuc

SEQ ID NO: 57087 - RNA, 18 nt, Artificial Sequence
  Description of Artificial Sequence: Synthetic oligonucleotide
auuucuuguccuccgaag

SEQ ID NO: 57088 - RNA, 18 nt, Artificial Sequence
  Description of Artificial Sequence: Synthetic oligonucleotide
aucuaauuucuuguccuc

SEQ ID NO: 57089 - RNA, 18 nt, Artificial Sequence
  Description of Artificial Sequence: Synthetic oligonucleotide
ucgucaucuaauuucuug

SEQ ID NO: 57090 - RNA, 18 nt, Artificial Sequence
  Description of Artificial Sequence: Synthetic oligonucleotide
ucuugucgucaucuaauu

SEQ ID NO: 57091 - RNA, 18 nt, Artificial Sequence
  Description of Artificial Sequence: Synthetic oligonucleotide
auccuucuugucgucauc

SEQ ID NO: 57092 - RNA, 18 nt, Artificial Sequence
  Description of Artificial Sequence: Synthetic oligonucleotide
uugauauccuucuugucg

SEQ ID NO: 57093 - RNA, 18 nt, Artificial Sequence
  Description of Artificial Sequence: Synthetic oligonucleotide
uugauuugauauccuucu

SEQ ID NO: 57094 - RNA, 18 nt, Artificial Sequence
  Description of Artificial Sequence: Synthetic oligonucleotide
aguaauugauuugauauc

SEQ ID NO: 57095 - RNA, 18 nt, Artificial Sequence
  Description of Artificial Sequence: Synthetic oligonucleotide
uucacgauggguccccac

SEQ ID NO: 57096 - RNA, 18 nt, Artificial Sequence
  Description of Artificial Sequence: Synthetic oligonucleotide
ccaucuucacgauggguc

SEQ ID NO: 57097 - RNA, 18 nt, Artificial Sequence
  Description of Artificial Sequence: Synthetic oligonucleotide
ccacgccaucuucacgau

SEQ ID NO: 57098 - RNA, 18 nt, Artificial Sequence
  Description of Artificial Sequence: Synthetic oligonucleotide
cagggccacgccaucuuc

SEQ ID NO: 57099 - RNA, 18 nt, Artificial Sequence
  Description of Artificial Sequence: Synthetic oligonucleotide
ccucucagggccacgcca

SEQ ID NO: 57100 - RNA, 18 nt, Artificial Sequence
  Description of Artificial Sequence: Synthetic oligonucleotide
ggcugccucucagggcca

SEQ ID NO: 57101 - RNA, 18 nt, Artificial Sequence
  Description of Artificial Sequence: Synthetic oligonucleotide
agaauggcugccucucag

SEQ ID NO: 57102 - RNA, 18 nt, Artificial Sequence
  Description of Artificial Sequence: Synthetic oligonucleotide
agaagagaauggcugccu

SEQ ID NO: 57103 - RNA, 18 nt, Artificial Sequence
  Description of Artificial Sequence: Synthetic oligonucleotide
uuggcagaagagaauggc

SEQ ID NO: 57104 - RNA, 18 nt, Artificial Sequence
  Description of Artificial Sequence: Synthetic oligonucleotide
cugguuuggcagaagaga

SEQ ID NO: 57105 - RNA, 18 nt, Artificial Sequence
  Description of Artificial Sequence: Synthetic oligonucleotide
ggaaccugguuuggcaga

SEQ ID NO: 57106 - RNA, 18 nt, Artificial Sequence
  Description of Artificial Sequence: Synthetic oligonucleotide
gaaccggaaccugguuug

SEQ ID NO: 57107 - RNA, 18 nt, Artificial Sequence
  Description of Artificial Sequence: Synthetic oligonucleotide
cuguggaaccggaaccug

SEQ ID NO: 57108 - RNA, 18 nt, Artificial Sequence
  Description of Artificial Sequence: Synthetic oligonucleotide
ggaagcuguggaaccgga

SEQ ID NO: 57109 - RNA, 18 nt, Artificial Sequence
  Description of Artificial Sequence: Synthetic oligonucleotide
ggacaggaagcuguggaa

SEQ ID NO: 57110 - RNA, 18 nt, Artificial Sequence
  Description of Artificial Sequence: Synthetic oligonucleotide
agacuggacaggaagcug

SEQ ID NO: 57111 - RNA, 18 nt, Artificial Sequence
  Description of Artificial Sequence: Synthetic oligonucleotide
gucgcagacuggacagga

SEQ ID NO: 57112 - RNA, 18 nt, Artificial Sequence
  Description of Artificial Sequence: Synthetic oligonucleotide
gggaagucgcagacugga

SEQ ID NO: 57113 - RNA, 18 nt, Artificial Sequence
  Description of Artificial Sequence: Synthetic oligonucleotide
gguggguucaggucaggg

SEQ ID NO: 57114 - RNA, 18 nt, Artificial Sequence
  Description of Artificial Sequence: Synthetic oligonucleotide
ggguggguucaggucagg

SEQ ID NO: 57115 - RNA, 18 nt, Artificial Sequence
  Description of Artificial Sequence: Synthetic oligonucleotide
cucuguaaggguccuggg

SEQ ID NO: 57116 - RNA, 18 nt, Artificial Sequence
  Description of Artificial Sequence: Synthetic oligonucleotide
gugcccuggugaggccaa

SEQ ID NO: 57117 - RNA, 18 nt, Artificial Sequence
  Description of Artificial Sequence: Synthetic oligonucleotide
cagaagugcccuggugag

SEQ ID NO: 57118 - RNA, 18 nt, Artificial Sequence
  Description of Artificial Sequence: Synthetic oligonucleotide
gaggucagaagugcccug

SEQ ID NO: 57119 - RNA, 18 nt, Artificial Sequence
  Description of Artificial Sequence: Synthetic oligonucleotide
aaagugaggucagaagug

SEQ ID NO: 57120 - RNA, 18 nt, Artificial Sequence
  Description of Artificial Sequence: Synthetic oligonucleotide
uugugaaagugaggucag

SEQ ID NO: 57121 - RNA, 18 nt, Artificial Sequence
  Description of Artificial Sequence: Synthetic oligonucleotide
uccuauugugaaagugag

SEQ ID NO: 57122 - RNA, 18 nt, Artificial Sequence
  Description of Artificial Sequence: Synthetic oligonucleotide
acugguccuauugugaaa

SEQ ID NO: 57123 - RNA, 18 nt, Artificial Sequence
  Description of Artificial Sequence: Synthetic oligonucleotide
ucaacacugguccuauug

SEQ ID NO: 57124 - RNA, 18 nt, Artificial Sequence
  Description of Artificial Sequence: Synthetic oligonucleotide
ggguaucaacacuggucc

SEQ ID NO: 57125 - RNA, 18 nt, Artificial Sequence
  Description of Artificial Sequence: Synthetic oligonucleotide
aggcuggguaucaacacu

SEQ ID NO: 57126 - RNA, 18 nt, Artificial Sequence
  Description of Artificial Sequence: Synthetic oligonucleotide
ccaagaggcuggguauca

SEQ ID NO: 57127 - RNA, 18 nt, Artificial Sequence
  Description of Artificial Sequence: Synthetic oligonucleotide
gaacaccaagaggcuggg

SEQ ID NO: 57128 - RNA, 18 nt, Artificial Sequence
  Description of Artificial Sequence: Synthetic oligonucleotide
gggaugaacaccaagagg

SEQ ID NO: 57129 - RNA, 18 nt, Artificial Sequence
  Description of Artificial Sequence: Synthetic oligonucleotide
cuugagggaugaacacca

SEQ ID NO: 57130 - RNA, 18 nt, Artificial Sequence
  Description of Artificial Sequence: Synthetic oligonucleotide
ugcuucuugagggaugaa

SEQ ID NO: 57131 - RNA, 18 nt, Artificial Sequence
  Description of Artificial Sequence: Synthetic oligonucleotide
gccagugcuucuugaggg

SEQ ID NO: 57132 - RNA, 18 nt, Artificial Sequence
  Description of Artificial Sequence: Synthetic oligonucleotide
uuucugccagugcuucuu

SEQ ID NO: 57133 - RNA, 18 nt, Artificial Sequence
  Description of Artificial Sequence: Synthetic oligonucleotide
cuggguuucugccagugc

SEQ ID NO: 57134 - RNA, 18 nt, Artificial Sequence
  Description of Artificial Sequence: Synthetic oligonucleotide
gauuccuggguuucugcc

SEQ ID NO: 57135 - RNA, 18 nt, Artificial Sequence
  Description of Artificial Sequence: Synthetic oligonucleotide
aauuugauuccuggguuu

SEQ ID NO: 57136 - RNA, 18 nt, Artificial Sequence
  Description of Artificial Sequence: Synthetic oligonucleotide
ugcccaauuugauuccug

SEQ ID NO: 57137 - RNA, 18 nt, Artificial Sequence
  Description of Artificial Sequence: Synthetic oligonucleotide
uuuugugcccaauuugau

SEQ ID NO: 57138 - RNA, 18 nt, Artificial Sequence
  Description of Artificial Sequence: Synthetic oligonucleotide
accauuuuugugcccaau

SEQ ID NO: 57139 - RNA, 18 nt, Artificial Sequence
  Description of Artificial Sequence: Synthetic oligonucleotide
uccuuaccauuuuugugc

SEQ ID NO: 57140 - RNA, 18 nt, Artificial Sequence
  Description of Artificial Sequence: Synthetic oligonucleotide
ccauuuccuuaccauuuu

SEQ ID NO: 57141 - RNA, 18 nt, Artificial Sequence
  Description of Artificial Sequence: Synthetic oligonucleotide
cuuugccauuuccuuacc

SEQ ID NO: 57142 - RNA, 18 nt, Artificial Sequence
  Description of Artificial Sequence: Synthetic oligonucleotide
aaauacuuugccauuucc

SEQ ID NO: 57143 - RNA, 18 nt, Artificial Sequence
  Description of Artificial Sequence: Synthetic oligonucleotide
guucuaaauacuuugcca

SEQ ID NO: 57144 - RNA, 18 nt, Artificial Sequence
  Description of Artificial Sequence: Synthetic oligonucleotide
gcgaaguucuaaauacuu

SEQ ID NO: 57145 - RNA, 18 nt, Artificial Sequence
  Description of Artificial Sequence: Synthetic oligonucleotide
agcgggcgaaguucuaaa

SEQ ID NO: 57146 - RNA, 18 nt, Artificial Sequence
  Description of Artificial Sequence: Synthetic oligonucleotide
caauuagcgggcgaaguu

SEQ ID NO: 57147 - RNA, 18 nt, Artificial Sequence
  Description of Artificial Sequence: Synthetic oligonucleotide
aaacacaauuagcgggcg

SEQ ID NO: 57148 - RNA, 18 nt, Artificial Sequence
  Description of Artificial Sequence: Synthetic oligonucleotide
uggagaaacacaauuagc

SEQ ID NO: 57149 - RNA, 18 nt, Artificial Sequence
  Description of Artificial Sequence: Synthetic oligonucleotide
gucccuggagaaacacaa

SEQ ID NO: 57150 - RNA, 18 nt, Artificial Sequence
  Description of Artificial Sequence: Synthetic oligonucleotide
aaacagucccuggagaaa

SEQ ID NO: 57151 - RNA, 18 nt, Artificial Sequence
  Description of Artificial Sequence: Synthetic oligonucleotide
gaggaaaacagucccugg

SEQ ID NO: 57152 - RNA, 18 nt, Artificial Sequence
  Description of Artificial Sequence: Synthetic oligonucleotide
uguuugaggaaaacaguc

SEQ ID NO: 57153 - RNA, 18 nt, Artificial Sequence
  Description of Artificial Sequence: Synthetic oligonucleotide
gaggauguuugaggaaaa

SEQ ID NO: 57154 - RNA, 18 nt, Artificial Sequence
  Description of Artificial Sequence: Synthetic oligonucleotide
uuucagaggauguuugag

SEQ ID NO: 57155 - RNA, 18 nt, Artificial Sequence
  Description of Artificial Sequence: Synthetic oligonucleotide
caggauuucagaggaugu

SEQ ID NO: 57156 - RNA, 18 nt, Artificial Sequence
  Description of Artificial Sequence: Synthetic oligonucleotide
aggaccaggauuucagag

SEQ ID NO: 57157 - RNA, 18 nt, Artificial Sequence
  Description of Artificial Sequence: Synthetic oligonucleotide
gauauaggaccaggauuu

SEQ ID NO: 57158 - RNA, 18 nt, Artificial Sequence
  Description of Artificial Sequence: Synthetic oligonucleotide
cugcugauauaggaccag

SEQ ID NO: 57159 - RNA, 18 nt, Artificial Sequence
  Description of Artificial Sequence: Synthetic oligonucleotide
auucccugcugauauagg

SEQ ID NO: 57160 - RNA, 18 nt, Artificial Sequence
  Description of Artificial Sequence: Synthetic oligonucleotide
gccucauucccugcugau

SEQ ID NO: 57161 - RNA, 18 nt, Artificial Sequence
  Description of Artificial Sequence: Synthetic oligonucleotide
cuguggccucauucccug

SEQ ID NO: 57162 - RNA, 18 nt, Artificial Sequence
  Description of Artificial Sequence: Synthetic oligonucleotide
ucagucuguggccucauu

SEQ ID NO: 57163 - RNA, 18 nt, Artificial Sequence
  Description of Artificial Sequence: Synthetic oligonucleotide
ucucaucagucuguggcc

SEQ ID NO: 57164 - RNA, 18 nt, Artificial Sequence
  Description of Artificial Sequence: Synthetic oligonucleotide
uuuccucucaucagucug

SEQ ID NO: 57165 - RNA, 18 nt, Artificial Sequence
  Description of Artificial Sequence: Synthetic oligonucleotide
uaaaauuuccucucauca

SEQ ID NO: 57166 - RNA, 18 nt, Artificial Sequence
  Description of Artificial Sequence: Synthetic oligonucleotide
uaaaauaaaauuuccucu

SEQ ID NO: 57167 - RNA, 18 nt, Artificial Sequence
  Description of Artificial Sequence: Synthetic oligonucleotide
auagcuaaaauaaaauuu

SEQ ID NO: 57168 - RNA, 18 nt, Artificial Sequence
  Description of Artificial Sequence: Synthetic oligonucleotide
uggaaauagcuaaaauaa

SEQ ID NO: 57169 - RNA, 18 nt, Artificial Sequence
  Description of Artificial Sequence: Synthetic oligonucleotide
aaauguggaaauagcuaa

SEQ ID NO: 57170 - RNA, 18 nt, Artificial Sequence
  Description of Artificial Sequence: Synthetic oligonucleotide
gagaaaaauguggaaaua

SEQ ID NO: 57171 - RNA, 18 nt, Artificial Sequence
  Description of Artificial Sequence: Synthetic oligonucleotide
ugaaugagaaaaaugugg

SEQ ID NO: 57172 - RNA, 18 nt, Artificial Sequence
  Description of Artificial Sequence: Synthetic oligonucleotide
ggaccugaaugagaaaaa

SEQ ID NO: 57173 - RNA, 18 nt, Artificial Sequence
  Description of Artificial Sequence: Synthetic oligonucleotide
uuagaggaccugaaugag

SEQ ID NO: 57174 - RNA, 18 nt, Artificial Sequence
  Description of Artificial Sequence: Synthetic oligonucleotide
ccacauuagaggaccuga

SEQ ID NO: 57175 - RNA, 18 nt, Artificial Sequence
  Description of Artificial Sequence: Synthetic oligonucleotide
acuaaccacauuagagga

SEQ ID NO: 57176 - RNA, 18 nt, Artificial Sequence
  Description of Artificial Sequence: Synthetic oligonucleotide
ccacaacuaaccacauua

SEQ ID NO: 57177 - RNA, 18 nt, Artificial Sequence
  Description of Artificial Sequence: Synthetic oligonucleotide
ucaggccacaacuaacca

SEQ ID NO: 57178 - RNA, 18 nt, Artificial Sequence
  Description of Artificial Sequence: Synthetic oligonucleotide
cauuuucaggccacaacu

SEQ ID NO: 57179 - RNA, 18 nt, Artificial Sequence
  Description of Artificial Sequence: Synthetic oligonucleotide
aauaucauuuucaggcca

SEQ ID NO: 57180 - RNA, 18 nt, Artificial Sequence
  Description of Artificial Sequence: Synthetic oligonucleotide
uuggaaauaucauuuuca

SEQ ID NO: 57181 - RNA, 18 nt, Artificial Sequence
  Description of Artificial Sequence: Synthetic oligonucleotide
uucauuuggaaauaucau

SEQ ID NO: 57182 - RNA, 18 nt, Artificial Sequence
  Description of Artificial Sequence: Synthetic oligonucleotide
uccuauucauuuggaaau

SEQ ID NO: 57183 - RNA, 18 nt, Artificial Sequence
  Description of Artificial Sequence: Synthetic oligonucleotide
uuccuuccuauucauuug

SEQ ID NO: 57184 - RNA, 18 nt, Artificial Sequence
  Description of Artificial Sequence: Synthetic oligonucleotide
uuuccuuccuuccuauuc

SEQ ID NO: 57185 - RNA, 18 nt, Artificial Sequence
  Description of Artificial Sequence: Synthetic oligonucleotide
aacaauuuccuuccuucc

SEQ ID NO: 57186 - RNA, 18 nt, Artificial Sequence
  Description of Artificial Sequence: Synthetic oligonucleotide
acaaaaacaauuuccuuc

SEQ ID NO: 57187 - RNA, 18 nt, Artificial Sequence
  Description of Artificial Sequence: Synthetic oligonucleotide
aaacaacaaaaacaauuu

SEQ ID NO: 57188 - RNA, 18 nt, Artificial Sequence
  Description of Artificial Sequence: Synthetic oligonucleotide
aucuuaaacaacaaaaac

SEQ ID NO: 57189 - RNA, 18 nt, Artificial Sequence
  Description of Artificial Sequence: Synthetic oligonucleotide
cuuccaucuuaaacaaca

SEQ ID NO: 57190 - RNA, 18 nt, Artificial Sequence
  Description of Artificial Sequence: Synthetic oligonucleotide
auuuccuuccaucuuaaa

SEQ ID NO: 57191 - RNA, 18 nt, Artificial Sequence
  Description of Artificial Sequence: Synthetic oligonucleotide
ccuauauuuccuuccauc

SEQ ID NO: 57192 - RNA, 18 nt, Artificial Sequence
  Description of Artificial Sequence: Synthetic oligonucleotide
augcaccuauauuuccuu

SEQ ID NO: 57193 - RNA, 18 nt, Artificial Sequence
  Description of Artificial Sequence: Synthetic oligonucleotide
uuuaaaugcaccuauauu

SEQ ID NO: 57194 - RNA, 18 nt, Artificial Sequence
  Description of Artificial Sequence: Synthetic oligonucleotide
cauuuuuuaaaugcaccu

SEQ ID NO: 57195 - RNA, 18 nt, Artificial Sequence
  Description of Artificial Sequence: Synthetic oligonucleotide
agcuccauuuuuuaaaug

SEQ ID NO: 57196 - RNA, 18 nt, Artificial Sequence
  Description of Artificial Sequence: Synthetic oligonucleotide
aaccaagcuccauuuuuu

SEQ ID NO: 57197 - RNA, 18 nt, Artificial Sequence
  Description of Artificial Sequence: Synthetic oligonucleotide
caugcaaccaagcuccau

SEQ ID NO: 57198 - RNA, 18 nt, Artificial Sequence
  Description of Artificial Sequence: Synthetic oligonucleotide
aaaaucaugcaaccaagc

SEQ ID NO: 57199 - RNA, 18 nt, Artificial Sequence
  Description of Artificial Sequence: Synthetic oligonucleotide
gagcgaaaaucaugcaac

SEQ ID NO: 57200 - RNA, 18 nt, Artificial Sequence
  Description of Artificial Sequence: Synthetic oligonucleotide
cucaagagcgaaaaucau

SEQ ID NO: 57201 - RNA, 18 nt, Artificial Sequence
  Description of Artificial Sequence: Synthetic oligonucleotide
gaugacucaagagcgaaa

SEQ ID NO: 57202 - RNA, 18 nt, Artificial Sequence
  Description of Artificial Sequence: Synthetic oligonucleotide
ggcuagaugacucaagag

SEQ ID NO: 57203 - RNA, 18 nt, Artificial Sequence
  Description of Artificial Sequence: Synthetic oligonucleotide
uagagggcuagaugacuc

SEQ ID NO: 57204 - RNA, 18 nt, Artificial Sequence
  Description of Artificial Sequence: Synthetic oligonucleotide
aucauuagagggcuagau

SEQ ID NO: 57205 - RNA, 18 nt, Artificial Sequence
  Description of Artificial Sequence: Synthetic oligonucleotide
aggcaaucauuagagggc

SEQ ID NO: 57206 - RNA, 18 nt, Artificial Sequence
  Description of Artificial Sequence: Synthetic oligonucleotide
guaugaggcaaucauuag

SEQ ID NO: 57207 - RNA, 18 nt, Artificial Sequence
  Description of Artificial Sequence: Synthetic oligonucleotide
caccgguaugaggcaauc

SEQ ID NO: 57208 - RNA, 18 nt, Artificial Sequence
  Description of Artificial Sequence: Synthetic oligonucleotide
guaaucaccgguaugagg

SEQ ID NO: 57209 - RNA, 18 nt, Artificial Sequence
  Description of Artificial Sequence: Synthetic oligonucleotide
cgcucguaaucaccggua

SEQ ID NO: 57210 - RNA, 18 nt, Artificial Sequence
  Description of Artificial Sequence: Synthetic oligonucleotide
aaagccgcucguaaucac

SEQ ID NO: 57211 - RNA, 18 nt, Artificial Sequence
  Description of Artificial Sequence: Synthetic oligonucleotide
caugaaaagccgcucgua

SEQ ID NO: 57212 - RNA, 18 nt, Artificial Sequence
  Description of Artificial Sequence: Synthetic oligonucleotide
gggucaugaaaagccgcu

SEQ ID NO: 57213 - RNA, 18 nt, Artificial Sequence
  Description of Artificial Sequence: Synthetic oligonucleotide
aaaugguacauauggaag

SEQ ID NO: 57214 - RNA, 18 nt, Artificial Sequence
  Description of Artificial Sequence: Synthetic oligonucleotide
uuuuaaaaugguacauau

SEQ ID NO: 57215 - RNA, 18 nt, Artificial Sequence
  Description of Artificial Sequence: Synthetic oligonucleotide
cagcauuuuaaaauggua

SEQ ID NO: 57216 - RNA, 18 nt, Artificial Sequence
  Description of Artificial Sequence: Synthetic oligonucleotide
guaaucagcauuuuaaaa

SEQ ID NO: 57217 - RNA, 18 nt, Artificial Sequence
  Description of Artificial Sequence: Synthetic oligonucleotide
aagaaguaaucagcauuu

SEQ ID NO: 57218 - RNA, 18 nt, Artificial Sequence
  Description of Artificial Sequence: Synthetic oligonucleotide
uucucaagaaguaaucag

SEQ ID NO: 57219 - RNA, 18 nt, Artificial Sequence
  Description of Artificial Sequence: Synthetic oligonucleotide
ucuuauucucaagaagua

SEQ ID NO: 57220 - RNA, 18 nt, Artificial Sequence
  Description of Artificial Sequence: Synthetic oligonucleotide
gcuucucuuauucucaag

SEQ ID NO: 57221 - RNA, 18 nt, Artificial Sequence
  Description of Artificial Sequence: Synthetic oligonucleotide
auuaggcuucucuuauuc

SEQ ID NO: 57222 - RNA, 18 nt, Artificial Sequence
  Description of Artificial Sequence: Synthetic oligonucleotide
cugaaauuaggcuucucu

SEQ ID NO: 57223 - RNA, 18 nt, Artificial Sequence
  Description of Artificial Sequence: Synthetic oligonucleotide
auauucugaaauuaggcu

SEQ ID NO: 57224 - RNA, 18 nt, Artificial Sequence
  Description of Artificial Sequence: Synthetic oligonucleotide
uaaugauauucugaaauu

SEQ ID NO: 57225 - RNA, 18 nt, Artificial Sequence
  Description of Artificial Sequence: Synthetic oligonucleotide
uacccuaaugauauucug

SEQ ID NO: 57226 - RNA, 18 nt, Artificial Sequence
  Description of Artificial Sequence: Synthetic oligonucleotide
auagguacccuaaugaua

SEQ ID NO: 57227 - RNA, 18 nt, Artificial Sequence
  Description of Artificial Sequence: Synthetic oligonucleotide
cuucaauagguacccuaa

SEQ ID NO: 57228 - RNA, 18 nt, Artificial Sequence
  Description of Artificial Sequence: Synthetic oligonucleotide
caagacuucaauagguac

SEQ ID NO: 57229 - RNA, 18 nt, Artificial Sequence
  Description of Artificial Sequence: Synthetic oligonucleotide
gcagucaagacuucaaua

SEQ ID NO: 57230 - RNA, 18 nt, Artificial Sequence
  Description of Artificial Sequence: Synthetic oligonucleotide
uaugugcagucaagacuu

SEQ ID NO: 57231 - RNA, 18 nt, Artificial Sequence
  Description of Artificial Sequence: Synthetic oligonucleotide
cuaaauaugugcagucaa

SEQ ID NO: 57232 - RNA, 18 nt, Artificial Sequence
  Description of Artificial Sequence: Synthetic oligonucleotide
guaugcuaaauaugugca

SEQ ID NO: 57233 - RNA, 18 nt, Artificial Sequence
  Description of Artificial Sequence: Synthetic oligonucleotide
agggaguaugcuaaauau

SEQ ID NO: 57234 - RNA, 18 nt, Artificial Sequence
  Description of Artificial Sequence: Synthetic oligonucleotide
uucccagggaguaugcua

SEQ ID NO: 57235 - RNA, 18 nt, Artificial Sequence
  Description of Artificial Sequence: Synthetic oligonucleotide
uauaauucccagggagua

SEQ ID NO: 57236 - RNA, 18 nt, Artificial Sequence
  Description of Artificial Sequence: Synthetic oligonucleotide
uaaaauauaauucccagg

SEQ ID NO: 57237 - RNA, 18 nt, Artificial Sequence
  Description of Artificial Sequence: Synthetic oligonucleotide
guccuuaaaauauaauuc

SEQ ID NO: 57238 - RNA, 18 nt, Artificial Sequence
  Description of Artificial Sequence: Synthetic oligonucleotide
aaaauguccuuaaaauau

SEQ ID NO: 57239 - RNA, 18 nt, Artificial Sequence
  Description of Artificial Sequence: Synthetic oligonucleotide
auagaaaaauguccuuaa

SEQ ID NO: 57240 - RNA, 18 nt, Artificial Sequence
  Description of Artificial Sequence: Synthetic oligonucleotide
auuuaauagaaaaauguc

SEQ ID NO: 57241 - RNA, 18 nt, Artificial Sequence
  Description of Artificial Sequence: Synthetic oligonucleotide
caaugauuuaauagaaaa

SEQ ID NO: 57242 - RNA, 18 nt, Artificial Sequence
  Description of Artificial Sequence: Synthetic oligonucleotide
auaugcaaugauuuaaua

SEQ ID NO: 57243 - RNA, 18 nt, Artificial Sequence
  Description of Artificial Sequence: Synthetic oligonucleotide
cuuccauaugcaaugauu

SEQ ID NO: 57244 - RNA, 18 nt, Artificial Sequence
  Description of Artificial Sequence: Synthetic oligonucleotide
aguuucuuccauaugcaa

SEQ ID NO: 57245 - RNA, 18 nt, Artificial Sequence
  Description of Artificial Sequence: Synthetic oligonucleotide
uauugaguuucuuccaua

SEQ ID NO: 57246 - RNA, 18 nt, Artificial Sequence
  Description of Artificial Sequence: Synthetic oligonucleotide
uauuauauugaguuucuu

SEQ ID NO: 57247 - RNA, 18 nt, Artificial Sequence
  Description of Artificial Sequence: Synthetic oligonucleotide
ucagcuauuauauugagu

SEQ ID NO: 57248 - RNA, 18 nt, Artificial Sequence
  Description of Artificial Sequence: Synthetic oligonucleotide
aaauaucagcuauuauau

SEQ ID NO: 57249 - RNA, 18 nt, Artificial Sequence
  Description of Artificial Sequence: Synthetic oligonucleotide
caaguaaauaucagcuau

SEQ ID NO: 57250 - RNA, 18 nt, Artificial Sequence
  Description of Artificial Sequence: Synthetic oligonucleotide
gaacccaaguaaauauca

SEQ ID NO: 57251 - RNA, 18 nt, Artificial Sequence
  Description of Artificial Sequence: Synthetic oligonucleotide
auuaagaacccaaguaaa

SEQ ID NO: 57252 - RNA, 18 nt, Artificial Sequence
  Description of Artificial Sequence: Synthetic oligonucleotide
uucugauuaagaacccaa

SEQ ID NO: 57253 - RNA, 18 nt, Artificial Sequence
  Description of Artificial Sequence: Synthetic oligonucleotide
caauguucugauuaagaa

SEQ ID NO: 57254 - RNA, 18 nt, Artificial Sequence
  Description of Artificial Sequence: Synthetic oligonucleotide
acagccaauguucugauu

SEQ ID NO: 57255 - RNA, 18 nt, Artificial Sequence
  Description of Artificial Sequence: Synthetic oligonucleotide
aucacacagccaauguuc

SEQ ID NO: 57256 - RNA, 18 nt, Artificial Sequence
  Description of Artificial Sequence: Synthetic oligonucleotide
ugaaaaucacacagccaa

SEQ ID NO: 57257 - RNA, 18 nt, Artificial Sequence
  Description of Artificial Sequence: Synthetic oligonucleotide
aaucaugaaaaucacaca

SEQ ID NO: 57258 - RNA, 18 nt, Artificial Sequence
  Description of Artificial Sequence: Synthetic oligonucleotide
aucauaaucaugaaaauc

SEQ ID NO: 57259 - RNA, 18 nt, Artificial Sequence
  Description of Artificial Sequence: Synthetic oligonucleotide
ugaaaaucauaaucauga

SEQ ID NO: 57260 - RNA, 18 nt, Artificial Sequence
  Description of Artificial Sequence: Synthetic oligonucleotide
ugcaaugaaaaucauaau

SEQ ID NO: 57261 - RNA, 18 nt, Artificial Sequence
  Description of Artificial Sequence: Synthetic oligonucleotide
uuaauugcaaugaaaauc

SEQ ID NO: 57262 - RNA, 18 nt, Artificial Sequence
  Description of Artificial Sequence: Synthetic oligonucleotide
ucaacuuaauugcaauga

SEQ ID NO: 57263 - RNA, 18 nt, Artificial Sequence
  Description of Artificial Sequence: Synthetic oligonucleotide
aaacaucaacuuaauugc

SEQ ID NO: 57264 - RNA, 18 nt, Artificial Sequence
  Description of Artificial Sequence: Synthetic oligonucleotide
cuacaaaacaucaacuua

SEQ ID NO: 57265 - RNA, 18 nt, Artificial Sequence
  Description of Artificial Sequence: Synthetic oligonucleotide
acugucuacaaaacauca

SEQ ID NO: 57266 - RNA, 18 nt, Artificial Sequence
  Description of Artificial Sequence: Synthetic oligonucleotide
auuucacugucuacaaaa

SEQ ID NO: 57267 - RNA, 18 nt, Artificial Sequence
  Description of Artificial Sequence: Synthetic oligonucleotide
ugguaauuucacugucua

SEQ ID NO: 57268 - RNA, 18 nt, Artificial Sequence
  Description of Artificial Sequence: Synthetic oligonucleotide
guagaugguaauuucacu

SEQ ID NO: 57269 - RNA, 18 nt, Artificial Sequence
  Description of Artificial Sequence: Synthetic oligonucleotide
uuggaguagaugguaauu

SEQ ID NO: 57270 - RNA, 18 nt, Artificial Sequence
  Description of Artificial Sequence: Synthetic oligonucleotide
aucuuuuggaguagaugg

SEQ ID NO: 57271 - RNA, 18 nt, Artificial Sequence
  Description of Artificial Sequence: Synthetic oligonucleotide
uugcaaucuuuuggagua

SEQ ID NO: 57272 - RNA, 18 nt, Artificial Sequence
  Description of Artificial Sequence: Synthetic oligonucleotide
cuauuuugcaaucuuuug

SEQ ID NO: 57273 - RNA, 18 nt, Artificial Sequence
  Description of Artificial Sequence: Synthetic oligonucleotide
aaauucuauuuugcaauc

SEQ ID NO: 57274 - RNA, 18 nt, Artificial Sequence
  Description of Artificial Sequence: Synthetic oligonucleotide
agguuaaauucuauuuug

SEQ ID NO: 57275 - RNA, 18 nt, Artificial Sequence
  Description of Artificial Sequence: Synthetic oligonucleotide
cucuaagguuaaauucua

SEQ ID NO: 57276 - RNA, 18 nt, Artificial Sequence
  Description of Artificial Sequence: Synthetic oligonucleotide
auuggcucuaagguuaaa

SEQ ID NO: 57277 - RNA, 18 nt, Artificial Sequence
  Description of Artificial Sequence: Synthetic oligonucleotide
ccugcauuggcucuaagg

SEQ ID NO: 57278 - RNA, 18 nt, Artificial Sequence
  Description of Artificial Sequence: Synthetic oligonucleotide
uuuucccugcauuggcuc

SEQ ID NO: 57279 - RNA, 18 nt, Artificial Sequence
  Description of Artificial Sequence: Synthetic oligonucleotide
acaaguuuucccugcauu

SEQ ID NO: 57280 - RNA, 18 nt, Artificial Sequence
  Description of Artificial Sequence: Synthetic oligonucleotide
cagaaacaaguuuucccu

SEQ ID NO: 57281 - RNA, 18 nt, Artificial Sequence
  Description of Artificial Sequence: Synthetic oligonucleotide
accugcagaaacaaguuu

SEQ ID NO: 57282 - RNA, 18 nt, Artificial Sequence
  Description of Artificial Sequence: Synthetic oligonucleotide
aaugcaccugcagaaaca

SEQ ID NO: 57283 - RNA, 18 nt, Artificial Sequence
  Description of Artificial Sequence: Synthetic oligonucleotide
caaaaaaugcaccugcag

SEQ ID NO: 57284 - RNA, 18 nt, Artificial Sequence
  Description of Artificial Sequence: Synthetic oligonucleotide
aguuucaaaaaaugcacc

SEQ ID NO: 57285 - RNA, 18 nt, Artificial Sequence
  Description of Artificial Sequence: Synthetic oligonucleotide
guugaaguuucaaaaaau

SEQ ID NO: 57286 - RNA, 18 nt, Artificial Sequence
  Description of Artificial Sequence: Synthetic oligonucleotide
uaucuguugaaguuucaa

SEQ ID NO: 57287 - RNA, 18 nt, Artificial Sequence
  Description of Artificial Sequence: Synthetic oligonucleotide
ccugcuaucuguugaagu

SEQ ID NO: 57288 - RNA, 18 nt, Artificial Sequence
  Description of Artificial Sequence: Synthetic oligonucleotide
uucccccugcuaucuguu

SEQ ID NO: 57289 - RNA, 18 nt, Artificial Sequence
  Description of Artificial Sequence: Synthetic oligonucleotide
uuuuuuucccccugcuau

SEQ ID NO: 57290 - RNA, 18 nt, Artificial Sequence
  Description of Artificial Sequence: Synthetic oligonucleotide
ucacuuuuuuuucccccu

SEQ ID NO: 57291 - RNA, 18 nt, Artificial Sequence
  Description of Artificial Sequence: Synthetic oligonucleotide
uucugucacuuuuuuuuc

SEQ ID NO: 57292 - RNA, 18 nt, Artificial Sequence
  Description of Artificial Sequence: Synthetic oligonucleotide
gauccuucugucacuuuu

SEQ ID NO: 57293 - RNA, 18 nt, Artificial Sequence
  Description of Artificial Sequence: Synthetic oligonucleotide
acugugauccuucuguca

SEQ ID NO: 57294 - RNA, 18 nt, Artificial Sequence
  Description of Artificial Sequence: Synthetic oligonucleotide
gcugaacugugauccuuc

SEQ ID NO: 57295 - RNA, 18 nt, Artificial Sequence
  Description of Artificial Sequence: Synthetic oligonucleotide
auacugcugaacugugau

SEQ ID NO: 57296 - RNA, 18 nt, Artificial Sequence
  Description of Artificial Sequence: Synthetic oligonucleotide
aauucauacugcugaacu

SEQ ID NO: 57297 - RNA, 18 nt, Artificial Sequence
  Description of Artificial Sequence: Synthetic oligonucleotide
cagacaauucauacugcu

SEQ ID NO: 57298 - RNA, 18 nt, Artificial Sequence
  Description of Artificial Sequence: Synthetic oligonucleotide
gccagcagacaauucaua

SEQ ID NO: 57299 - RNA, 18 nt, Artificial Sequence
  Description of Artificial Sequence: Synthetic oligonucleotide
aggcugccagcagacaau

SEQ ID NO: 57300 - RNA, 18 nt, Artificial Sequence
  Description of Artificial Sequence: Synthetic oligonucleotide
uugcaaggcugccagcag

SEQ ID NO: 57301 - RNA, 18 nt, Artificial Sequence
  Description of Artificial Sequence: Synthetic oligonucleotide
ccagauugcaaggcugcc

SEQ ID NO: 57302 - RNA, 18 nt, Artificial Sequence
  Description of Artificial Sequence: Synthetic oligonucleotide
gcacaccagauugcaagg

SEQ ID NO: 57303 - RNA, 18 nt, Artificial Sequence
  Description of Artificial Sequence: Synthetic oligonucleotide
ugccugcacaccagauug

SEQ ID NO: 57304 - RNA, 18 nt, Artificial Sequence
  Description of Artificial Sequence: Synthetic oligonucleotide
cucacugccugcacacca

SEQ ID NO: 57305 - RNA, 18 nt, Artificial Sequence
  Description of Artificial Sequence: Synthetic oligonucleotide
acaaucucacugccugca

SEQ ID NO: 57306 - RNA, 18 nt, Artificial Sequence
  Description of Artificial Sequence: Synthetic oligonucleotide
acaccacaaucucacugc

SEQ ID NO: 57307 - RNA, 18 nt, Artificial Sequence
  Description of Artificial Sequence: Synthetic oligonucleotide
cauguacaccacaaucuc

SEQ ID NO: 57308 - RNA, 18 nt, Artificial Sequence
  Description of Artificial Sequence: Synthetic oligonucleotide
ggugacauguacaccaca

SEQ ID NO: 57309 - RNA, 18 nt, Artificial Sequence
  Description of Artificial Sequence: Synthetic oligonucleotide
aaucaggugacauguaca

SEQ ID NO: 57310 - RNA, 18 nt, Artificial Sequence
  Description of Artificial Sequence: Synthetic oligonucleotide
uguaguccugguggcaug

SEQ ID NO: 57311 - RNA, 18 nt, Artificial Sequence
  Description of Artificial Sequence: Synthetic oligonucleotide
gccccuguaguccuggug

SEQ ID NO: 57312 - RNA, 18 nt, Artificial Sequence
  Description of Artificial Sequence: Synthetic oligonucleotide
acucugccccuguagucc

SEQ ID NO: 57313 - RNA, 18 nt, Artificial Sequence
  Description of Artificial Sequence: Synthetic oligonucleotide
gagacacucugccccugu

SEQ ID NO: 57314 - RNA, 18 nt, Artificial Sequence
  Description of Artificial Sequence: Synthetic oligonucleotide
cagaggagacacucugcc

SEQ ID NO: 57315 - RNA, 18 nt, Artificial Sequence
  Description of Artificial Sequence: Synthetic oligonucleotide
gcugccagaggagacacu

SEQ ID NO: 57316 - RNA, 18 nt, Artificial Sequence
  Description of Artificial Sequence: Synthetic oligonucleotide
ucagagcugccagaggag

SEQ ID NO: 57317 - RNA, 18 nt, Artificial Sequence
  Description of Artificial Sequence: Synthetic oligonucleotide
ugaucucagagcugccag

SEQ ID NO: 57318 - RNA, 18 nt, Artificial Sequence
  Description of Artificial Sequence: Synthetic oligonucleotide
ggauuugaucucagagcu

SEQ ID NO: 57319 - RNA, 18 nt, Artificial Sequence
  Description of Artificial Sequence: Synthetic oligonucleotide
ucaucggauuugaucuca

SEQ ID NO: 57320 - RNA, 18 nt, Artificial Sequence
  Description of Artificial Sequence: Synthetic oligonucleotide
ccucgucaucggauuuga

SEQ ID NO: 57321 - RNA, 18 nt, Artificial Sequence
  Description of Artificial Sequence: Synthetic oligonucleotide
aucacccucgucaucgga

SEQ ID NO: 57322 - RNA, 18 nt, Artificial Sequence
  Description of Artificial Sequence: Synthetic oligonucleotide
uucucaucacccucguca

SEQ ID NO: 57323 - RNA, 18 nt, Artificial Sequence
  Description of Artificial Sequence: Synthetic oligonucleotide
gcagguucucaucacccu

SEQ ID NO: 57324 - RNA, 18 nt, Artificial Sequence
  Description of Artificial Sequence: Synthetic oligonucleotide
gucuugcagguucucauc

SEQ ID NO: 57325 - RNA, 18 nt, Artificial Sequence
  Description of Artificial Sequence: Synthetic oligonucleotide
uucgugucuugcagguuc

SEQ ID NO: 57326 - RNA, 18 nt, Artificial Sequence
  Description of Artificial Sequence: Synthetic oligonucleotide
aagauuucgugucuugca

SEQ ID NO: 57327 - RNA, 18 nt, Artificial Sequence
  Description of Artificial Sequence: Synthetic oligonucleotide
cuccgaagauuucguguc

SEQ ID NO: 57328 - RNA, 18 nt, Artificial Sequence
  Description of Artificial Sequence: Synthetic oligonucleotide
uuguccuccgaagauuuc

SEQ ID NO: 57329 - RNA, 18 nt, Artificial Sequence
  Description of Artificial Sequence: Synthetic oligonucleotide
auuucuuguccuccgaag

SEQ ID NO: 57330 - RNA, 18 nt, Artificial Sequence
  Description of Artificial Sequence: Synthetic oligonucleotide
aucuaauuucuuguccuc

SEQ ID NO: 57331 - RNA, 18 nt, Artificial Sequence
  Description of Artificial Sequence: Synthetic oligonucleotide
ucgucaucuaauuucuug

SEQ ID NO: 57332 - RNA, 18 nt, Artificial Sequence
  Description of Artificial Sequence: Synthetic oligonucleotide
ucuugucgucaucuaauu

SEQ ID NO: 57333 - RNA, 18 nt, Artificial Sequence
  Description of Artificial Sequence: Synthetic oligonucleotide
auccuucuugucgucauc

SEQ ID NO: 57334 - RNA, 18 nt, Artificial Sequence
  Description of Artificial Sequence: Synthetic oligonucleotide
uugauauccuucuugucg

SEQ ID NO: 57335 - RNA, 18 nt, Artificial Sequence
  Description of Artificial Sequence: Synthetic oligonucleotide
uugauuugauauccuucu

SEQ ID NO: 57336 - RNA, 18 nt, Artificial Sequence
  Description of Artificial Sequence: Synthetic oligonucleotide
aguaauugauuugauauc

SEQ ID NO: 57337 - RNA, 18 nt, Artificial Sequence
  Description of Artificial Sequence: Synthetic oligonucleotide
uucacgauggguccccac

SEQ ID NO: 57338 - RNA, 18 nt, Artificial Sequence
  Description of Artificial Sequence: Synthetic oligonucleotide
ccaucuucacgauggguc

SEQ ID NO: 57339 - RNA, 18 nt, Artificial Sequence
  Description of Artificial Sequence: Synthetic oligonucleotide
ccacgccaucuucacgau

SEQ ID NO: 57340 - RNA, 18 nt, Artificial Sequence
  Description of Artificial Sequence: Synthetic oligonucleotide
cagggccacgccaucuuc

SEQ ID NO: 57341 - RNA, 18 nt, Artificial Sequence
  Description of Artificial Sequence: Synthetic oligonucleotide
ccucucagggccacgcca

SEQ ID NO: 57342 - RNA, 18 nt, Artificial Sequence
  Description of Artificial Sequence: Synthetic oligonucleotide
ggcugccucucagggcca

SEQ ID NO: 57343 - RNA, 18 nt, Artificial Sequence
  Description of Artificial Sequence: Synthetic oligonucleotide
agaauggcugccucucag

SEQ ID NO: 57344 - RNA, 18 nt, Artificial Sequence
  Description of Artificial Sequence: Synthetic oligonucleotide
agaagagaauggcugccu

SEQ ID NO: 57345 - RNA, 18 nt, Artificial Sequence
  Description of Artificial Sequence: Synthetic oligonucleotide
uuggcagaagagaauggc

SEQ ID NO: 57346 - RNA, 18 nt, Artificial Sequence
  Description of Artificial Sequence: Synthetic oligonucleotide
cugguuuggcagaagaga

SEQ ID NO: 57347 - RNA, 18 nt, Artificial Sequence
  Description of Artificial Sequence: Synthetic oligonucleotide
ggaaccugguuuggcaga

SEQ ID NO: 57348 - RNA, 18 nt, Artificial Sequence
  Description of Artificial Sequence: Synthetic oligonucleotide
gaaccggaaccugguuug

SEQ ID NO: 57349 - RNA, 18 nt, Artificial Sequence
  Description of Artificial Sequence: Synthetic oligonucleotide
cuguggaaccggaaccug

SEQ ID NO: 57350 - RNA, 18 nt, Artificial Sequence
  Description of Artificial Sequence: Synthetic oligonucleotide
ggaagcuguggaaccgga

SEQ ID NO: 57351 - RNA, 18 nt, Artificial Sequence
  Description of Artificial Sequence: Synthetic oligonucleotide
ggacaggaagcuguggaa

SEQ ID NO: 57352 - RNA, 18 nt, Artificial Sequence
  Description of Artificial Sequence: Synthetic oligonucleotide
agacuggacaggaagcug

SEQ ID NO: 57353 - RNA, 18 nt, Artificial Sequence
  Description of Artificial Sequence: Synthetic oligonucleotide
gucgcagacuggacagga

SEQ ID NO: 57354 - RNA, 18 nt, Artificial Sequence
  Description of Artificial Sequence: Synthetic oligonucleotide
gggaagucgcagacugga

SEQ ID NO: 57355 - RNA, 18 nt, Artificial Sequence
  Description of Artificial Sequence: Synthetic oligonucleotide
gguggguucaggucaggg

SEQ ID NO: 57356 - RNA, 18 nt, Artificial Sequence
  Description of Artificial Sequence: Synthetic oligonucleotide
ggguggguucaggucagg

SEQ ID NO: 57357 - RNA, 18 nt, Artificial Sequence
  Description of Artificial Sequence: Synthetic oligonucleotide
cucuguaaggguccuggg

SEQ ID NO: 57358 - RNA, 18 nt, Artificial Sequence
  Description of Artificial Sequence: Synthetic oligonucleotide
gugcccuggugaggccaa

SEQ ID NO: 57359 - RNA, 18 nt, Artificial Sequence
  Description of Artificial Sequence: Synthetic oligonucleotide
cagaagugcccuggugag

SEQ ID NO: 57360 - RNA, 18 nt, Artificial Sequence
  Description of Artificial Sequence: Synthetic oligonucleotide
gaggucagaagugcccug

SEQ ID NO: 57361 - RNA, 18 nt, Artificial Sequence
  Description of Artificial Sequence: Synthetic oligonucleotide
aaagugaggucagaagug

SEQ ID NO: 57362 - RNA, 18 nt, Artificial Sequence
  Description of Artificial Sequence: Synthetic oligonucleotide
uugugaaagugaggucag

SEQ ID NO: 57363 - RNA, 18 nt, Artificial Sequence
  Description of Artificial Sequence: Synthetic oligonucleotide
uccuauugugaaagugag

SEQ ID NO: 57364 - RNA, 18 nt, Artificial Sequence
  Description of Artificial Sequence: Synthetic oligonucleotide
acugguccuauugugaaa

SEQ ID NO: 57365 - RNA, 18 nt, Artificial Sequence
  Description of Artificial Sequence: Synthetic oligonucleotide
ucaacacugguccuauug

SEQ ID NO: 57366 - RNA, 18 nt, Artificial Sequence
  Description of Artificial Sequence: Synthetic oligonucleotide
ggguaucaacacuggucc

SEQ ID NO: 57367 - RNA, 18 nt, Artificial Sequence
  Description of Artificial Sequence: Synthetic oligonucleotide
aggcuggguaucaacacu

SEQ ID NO: 57368 - RNA, 18 nt, Artificial Sequence
  Description of Artificial Sequence: Synthetic oligonucleotide
ccaagaggcuggguauca

SEQ ID NO: 57369 - RNA, 18 nt, Artificial Sequence
  Description of Artificial Sequence: Synthetic oligonucleotide
gaacaccaagaggcuggg

SEQ ID NO: 57370 - RNA, 18 nt, Artificial Sequence
  Description of Artificial Sequence: Synthetic oligonucleotide
gggaugaacaccaagagg

SEQ ID NO: 57371 - RNA, 18 nt, Artificial Sequence
  Description of Artificial Sequence: Synthetic oligonucleotide
cuugagggaugaacacca

SEQ ID NO: 57372 - RNA, 18 nt, Artificial Sequence
  Description of Artificial Sequence: Synthetic oligonucleotide
ugcuucuugagggaugaa

SEQ ID NO: 57373 - RNA, 18 nt, Artificial Sequence
  Description of Artificial Sequence: Synthetic oligonucleotide
gccagugcuucuugaggg

SEQ ID NO: 57374 - RNA, 18 nt, Artificial Sequence
  Description of Artificial Sequence: Synthetic oligonucleotide
uuucugccagugcuucuu

SEQ ID NO: 57375 - RNA, 18 nt, Artificial Sequence
  Description of Artificial Sequence: Synthetic oligonucleotide
cuggguuucugccagugc

SEQ ID NO: 57376 - RNA, 18 nt, Artificial Sequence
  Description of Artificial Sequence: Synthetic oligonucleotide
gauuccuggguuucugcc

SEQ ID NO: 57377 - RNA, 18 nt, Artificial Sequence
  Description of Artificial Sequence: Synthetic oligonucleotide
aauuugauuccuggguuu

SEQ ID NO: 57378 - RNA, 18 nt, Artificial Sequence
  Description of Artificial Sequence: Synthetic oligonucleotide
ugcccaauuugauuccug

SEQ ID NO: 57379 - RNA, 18 nt, Artificial Sequence
  Description of Artificial Sequence: Synthetic oligonucleotide
uuuugugcccaauuugau

SEQ ID NO: 57380 - RNA, 18 nt, Artificial Sequence
  Description of Artificial Sequence: Synthetic oligonucleotide
accauuuuugugcccaau

SEQ ID NO: 57381 - RNA, 18 nt, Artificial Sequence
  Description of Artificial Sequence: Synthetic oligonucleotide
uccuuaccauuuuugugc

SEQ ID NO: 57382 - RNA, 18 nt, Artificial Sequence
  Description of Artificial Sequence: Synthetic oligonucleotide
ccauuuccuuaccauuuu

SEQ ID NO: 57383 - RNA, 18 nt, Artificial Sequence
  Description of Artificial Sequence: Synthetic oligonucleotide
cuuugccauuuccuuacc

SEQ ID NO: 57384 - RNA, 18 nt, Artificial Sequence
  Description of Artificial Sequence: Synthetic oligonucleotide
aaauacuuugccauuucc

SEQ ID NO: 57385 - RNA, 18 nt, Artificial Sequence
  Description of Artificial Sequence: Synthetic oligonucleotide
guucuaaauacuuugcca

SEQ ID NO: 57386 - RNA, 18 nt, Artificial Sequence
  Description of Artificial Sequence: Synthetic oligonucleotide
gcgaaguucuaaauacuu

SEQ ID NO: 57387 - RNA, 18 nt, Artificial Sequence
  Description of Artificial Sequence: Synthetic oligonucleotide
agcgggcgaaguucuaaa

SEQ ID NO: 57388 - RNA, 18 nt, Artificial Sequence
  Description of Artificial Sequence: Synthetic oligonucleotide
caauuagcgggcgaaguu

SEQ ID NO: 57389 - RNA, 18 nt, Artificial Sequence
  Description of Artificial Sequence: Synthetic oligonucleotide
aaacacaauuagcgggcg

SEQ ID NO: 57390 - RNA, 18 nt, Artificial Sequence
  Description of Artificial Sequence: Synthetic oligonucleotide
uggagaaacacaauuagc

SEQ ID NO: 57391 - RNA, 18 nt, Artificial Sequence
  Description of Artificial Sequence: Synthetic oligonucleotide
gucccuggagaaacacaa

SEQ ID NO: 57392 - RNA, 18 nt, Artificial Sequence
  Description of Artificial Sequence: Synthetic oligonucleotide
aaacagucccuggagaaa

SEQ ID NO: 57393 - RNA, 18 nt, Artificial Sequence
  Description of Artificial Sequence: Synthetic oligonucleotide
gaggaaaacagucccugg

SEQ ID NO: 57394 - RNA, 18 nt, Artificial Sequence
  Description of Artificial Sequence: Synthetic oligonucleotide
uguuugaggaaaacaguc

SEQ ID NO: 57395 - RNA, 18 nt, Artificial Sequence
  Description of Artificial Sequence: Synthetic oligonucleotide
gaggauguuugaggaaaa

SEQ ID NO: 57396 - RNA, 18 nt, Artificial Sequence
  Description of Artificial Sequence: Synthetic oligonucleotide
uuucagaggauguuugag

SEQ ID NO: 57397 - RNA, 18 nt, Artificial Sequence
  Description of Artificial Sequence: Synthetic oligonucleotide
caggauuucagaggaugu

SEQ ID NO: 57398 - RNA, 18 nt, Artificial Sequence
  Description of Artificial Sequence: Synthetic oligonucleotide
aggaccaggauuucagag

SEQ ID NO: 57399 - RNA, 18 nt, Artificial Sequence
  Description of Artificial Sequence: Synthetic oligonucleotide
gauauaggaccaggauuu

SEQ ID NO: 57400 - RNA, 18 nt, Artificial Sequence
  Description of Artificial Sequence: Synthetic oligonucleotide
cugcugauauaggaccag

SEQ ID NO: 57401 - RNA, 18 nt, Artificial Sequence
  Description of Artificial Sequence: Synthetic oligonucleotide
auucccugcugauauagg

SEQ ID NO: 57402 - RNA, 18 nt, Artificial Sequence
  Description of Artificial Sequence: Synthetic oligonucleotide
gccucauucccugcugau

SEQ ID NO: 57403 - RNA, 18 nt, Artificial Sequence
  Description of Artificial Sequence: Synthetic oligonucleotide
cuguggccucauucccug

SEQ ID NO: 57404 - RNA, 18 nt, Artificial Sequence
  Description of Artificial Sequence: Synthetic oligonucleotide
ucagucuguggccucauu

SEQ ID NO: 57405 - RNA, 18 nt, Artificial Sequence
  Description of Artificial Sequence: Synthetic oligonucleotide
ucucaucagucuguggcc

SEQ ID NO: 57406 - RNA, 18 nt, Artificial Sequence
  Description of Artificial Sequence: Synthetic oligonucleotide
uuuccucucaucagucug

SEQ ID NO: 57407 - RNA, 18 nt, Artificial Sequence
  Description of Artificial Sequence: Synthetic oligonucleotide
uaaaauuuccucucauca

SEQ ID NO: 57408 - RNA, 18 nt, Artificial Sequence
  Description of Artificial Sequence: Synthetic oligonucleotide
uaaaauaaaauuuccucu

SEQ ID NO: 57409 - RNA, 18 nt, Artificial Sequence
  Description of Artificial Sequence: Synthetic oligonucleotide
auagcuaaaauaaaauuu

SEQ ID NO: 57410 - RNA, 18 nt, Artificial Sequence
  Description of Artificial Sequence: Synthetic oligonucleotide
uggaaauagcuaaaauaa

SEQ ID NO: 57411 - RNA, 18 nt, Artificial Sequence
  Description of Artificial Sequence: Synthetic oligonucleotide
aaauguggaaauagcuaa

SEQ ID NO: 57412 - RNA, 18 nt, Artificial Sequence
  Description of Artificial Sequence: Synthetic oligonucleotide
gagaaaaauguggaaaua

SEQ ID NO: 57413 - RNA, 18 nt, Artificial Sequence
  Description of Artificial Sequence: Synthetic oligonucleotide
ugaaugagaaaaaugugg

SEQ ID NO: 57414 - RNA, 18 nt, Artificial Sequence
  Description of Artificial Sequence: Synthetic oligonucleotide
ggaccugaaugagaaaaa

SEQ ID NO: 57415 - RNA, 18 nt, Artificial Sequence
  Description of Artificial Sequence: Synthetic oligonucleotide
uuagaggaccugaaugag

SEQ ID NO: 57416 - RNA, 18 nt, Artificial Sequence
  Description of Artificial Sequence: Synthetic oligonucleotide
ccacauuagaggaccuga

SEQ ID NO: 57417 - RNA, 18 nt, Artificial Sequence
  Description of Artificial Sequence: Synthetic oligonucleotide
acuaaccacauuagagga

SEQ ID NO: 57418 - RNA, 18 nt, Artificial Sequence
  Description of Artificial Sequence: Synthetic oligonucleotide
ccacaacuaaccacauua

SEQ ID NO: 57419 - RNA, 18 nt, Artificial Sequence
  Description of Artificial Sequence: Synthetic oligonucleotide
ucaggccacaacuaacca

SEQ ID NO: 57420 - RNA, 18 nt, Artificial Sequence
  Description of Artificial Sequence: Synthetic oligonucleotide
cauuuucaggccacaacu

SEQ ID NO: 57421 - RNA, 18 nt, Artificial Sequence
  Description of Artificial Sequence: Synthetic oligonucleotide
aauaucauuuucaggcca

SEQ ID NO: 57422 - RNA, 18 nt, Artificial Sequence
  Description of Artificial Sequence: Synthetic oligonucleotide
uuggaaauaucauuuuca

SEQ ID NO: 57423 - RNA, 18 nt, Artificial Sequence
  Description of Artificial Sequence: Synthetic oligonucleotide
uucauuuggaaauaucau

SEQ ID NO: 57424 - RNA, 18 nt, Artificial Sequence
  Description of Artificial Sequence: Synthetic oligonucleotide
uccuauucauuuggaaau

SEQ ID NO: 57425 - RNA, 18 nt, Artificial Sequence
  Description of Artificial Sequence: Synthetic oligonucleotide
uuccuuccuauucauuug

SEQ ID NO: 57426 - RNA, 18 nt, Artificial Sequence
  Description of Artificial Sequence: Synthetic oligonucleotide
uuuccuuccuuccuauuc

SEQ ID NO: 57427 - RNA, 18 nt, Artificial Sequence
  Description of Artificial Sequence: Synthetic oligonucleotide
aacaauuuccuuccuucc

SEQ ID NO: 57428 - RNA, 18 nt, Artificial Sequence
  Description of Artificial Sequence: Synthetic oligonucleotide
acaaaaacaauuuccuuc

SEQ ID NO: 57429 - RNA, 18 nt, Artificial Sequence
  Description of Artificial Sequence: Synthetic oligonucleotide
aaacaacaaaaacaauuu

SEQ ID NO: 57430 - RNA, 18 nt, Artificial Sequence
  Description of Artificial Sequence: Synthetic oligonucleotide
aucuuaaacaacaaaaac

SEQ ID NO: 57431 - RNA, 18 nt, Artificial Sequence
  Description of Artificial Sequence: Synthetic oligonucleotide
cuuccaucuuaaacaaca

SEQ ID NO: 57432 - RNA, 18 nt, Artificial Sequence
  Description of Artificial Sequence: Synthetic oligonucleotide
auuuccuuccaucuuaaa

SEQ ID NO: 57433 - RNA, 18 nt, Artificial Sequence
  Description of Artificial Sequence: Synthetic oligonucleotide
ccuauauuuccuuccauc

SEQ ID NO: 57434 - RNA, 18 nt, Artificial Sequence
  Description of Artificial Sequence: Synthetic oligonucleotide
augcaccuauauuuccuu

SEQ ID NO: 57435 - RNA, 18 nt, Artificial Sequence
  Description of Artificial Sequence: Synthetic oligonucleotide
uuuaaaugcaccuauauu

SEQ ID NO: 57436 - RNA, 18 nt, Artificial Sequence
  Description of Artificial Sequence: Synthetic oligonucleotide
cauuuuuuaaaugcaccu

SEQ ID NO: 57437 - RNA, 18 nt, Artificial Sequence
  Description of Artificial Sequence: Synthetic oligonucleotide
agcuccauuuuuuaaaug

SEQ ID NO: 57438 - RNA, 18 nt, Artificial Sequence
  Description of Artificial Sequence: Synthetic oligonucleotide
aaccaagcuccauuuuuu

SEQ ID NO: 57439 - RNA, 18 nt, Artificial Sequence
  Description of Artificial Sequence: Synthetic oligonucleotide
caugcaaccaagcuccau

SEQ ID NO: 57440 - RNA, 18 nt, Artificial Sequence
  Description of Artificial Sequence: Synthetic oligonucleotide
aaaaucaugcaaccaagc

SEQ ID NO: 57441 - RNA, 18 nt, Artificial Sequence
  Description of Artificial Sequence: Synthetic oligonucleotide
gagcgaaaaucaugcaac

SEQ ID NO: 57442 - RNA, 18 nt, Artificial Sequence
  Description of Artificial Sequence: Synthetic oligonucleotide
cucaagagcgaaaaucau

SEQ ID NO: 57443 - RNA, 18 nt, Artificial Sequence
  Description of Artificial Sequence: Synthetic oligonucleotide
gaugacucaagagcgaaa

SEQ ID NO: 57444 - RNA, 18 nt, Artificial Sequence
  Description of Artificial Sequence: Synthetic oligonucleotide
ggcuagaugacucaagag

SEQ ID NO: 57445 - RNA, 18 nt, Artificial Sequence
  Description of Artificial Sequence: Synthetic oligonucleotide
uagagggcuagaugacuc

SEQ ID NO: 57446 - RNA, 18 nt, Artificial Sequence
  Description of Artificial Sequence: Synthetic oligonucleotide
aucauuagagggcuagau

SEQ ID NO: 57447 - RNA, 18 nt, Artificial Sequence
  Description of Artificial Sequence: Synthetic oligonucleotide
aggcaaucauuagagggc

SEQ ID NO: 57448 - RNA, 18 nt, Artificial Sequence
  Description of Artificial Sequence: Synthetic oligonucleotide
guaugaggcaaucauuag

SEQ ID NO: 57449 - RNA, 18 nt, Artificial Sequence
  Description of Artificial Sequence: Synthetic oligonucleotide
caccgguaugaggcaauc

SEQ ID NO: 57450 - RNA, 18 nt, Artificial Sequence
  Description of Artificial Sequence: Synthetic oligonucleotide
guaaucaccgguaugagg

SEQ ID NO: 57451 - RNA, 18 nt, Artificial Sequence
  Description of Artificial Sequence: Synthetic oligonucleotide
cgcucguaaucaccggua

SEQ ID NO: 57452 - RNA, 18 nt, Artificial Sequence
  Description of Artificial Sequence: Synthetic oligonucleotide
aaagccgcucguaaucac

SEQ ID NO: 57453 - RNA, 18 nt, Artificial Sequence
  Description of Artificial Sequence: Synthetic oligonucleotide
caugaaaagccgcucgua

SEQ ID NO: 57454 - RNA, 18 nt, Artificial Sequence
  Description of Artificial Sequence: Synthetic oligonucleotide
gggucaugaaaagccgcu

SEQ ID NO: 57455 - RNA, 18 nt, Artificial Sequence
  Description of Artificial Sequence: Synthetic oligonucleotide
aaaugguacauauggaag

SEQ ID NO: 57456 - RNA, 18 nt, Artificial Sequence
  Description of Artificial Sequence: Synthetic oligonucleotide
uuuuaaaaugguacauau

SEQ ID NO: 57457 - RNA, 18 nt, Artificial Sequence
  Description of Artificial Sequence: Synthetic oligonucleotide
cagcauuuuaaaauggua

SEQ ID NO: 57458 - RNA, 18 nt, Artificial Sequence
  Description of Artificial Sequence: Synthetic oligonucleotide
guaaucagcauuuuaaaa

SEQ ID NO: 57459 - RNA, 18 nt, Artificial Sequence
  Description of Artificial Sequence: Synthetic oligonucleotide
aagaaguaaucagcauuu

SEQ ID NO: 57460 - RNA, 18 nt, Artificial Sequence
  Description of Artificial Sequence: Synthetic oligonucleotide
uucucaagaaguaaucag

SEQ ID NO: 57461 - RNA, 18 nt, Artificial Sequence
  Description of Artificial Sequence: Synthetic oligonucleotide
ucuuauucucaagaagua

SEQ ID NO: 57462 - RNA, 18 nt, Artificial Sequence
  Description of Artificial Sequence: Synthetic oligonucleotide
gcuucucuuauucucaag

SEQ ID NO: 57463 - RNA, 18 nt, Artificial Sequence
  Description of Artificial Sequence: Synthetic oligonucleotide
auuaggcuucucuuauuc

SEQ ID NO: 57464 - RNA, 18 nt, Artificial Sequence
  Description of Artificial Sequence: Synthetic oligonucleotide
cugaaauuaggcuucucu

SEQ ID NO: 57465 - RNA, 18 nt, Artificial Sequence
  Description of Artificial Sequence: Synthetic oligonucleotide
auauucugaaauuaggcu

SEQ ID NO: 57466 - RNA, 18 nt, Artificial Sequence
  Description of Artificial Sequence: Synthetic oligonucleotide
uaaugauauucugaaauu

SEQ ID NO: 57467 - RNA, 18 nt, Artificial Sequence
  Description of Artificial Sequence: Synthetic oligonucleotide
uacccuaaugauauucug

SEQ ID NO: 57468 - RNA, 18 nt, Artificial Sequence
  Description of Artificial Sequence: Synthetic oligonucleotide
auagguacccuaaugaua

SEQ ID NO: 57469 - RNA, 18 nt, Artificial Sequence
  Description of Artificial Sequence: Synthetic oligonucleotide
cuucaauagguacccuaa

SEQ ID NO: 57470 - RNA, 18 nt, Artificial Sequence
  Description of Artificial Sequence: Synthetic oligonucleotide
caagacuucaauagguac

SEQ ID NO: 57471 - RNA, 18 nt, Artificial Sequence
  Description of Artificial Sequence: Synthetic oligonucleotide
gcagucaagacuucaaua

SEQ ID NO: 57472 - RNA, 18 nt, Artificial Sequence
  Description of Artificial Sequence: Synthetic oligonucleotide
uaugugcagucaagacuu

SEQ ID NO: 57473 - RNA, 18 nt, Artificial Sequence
  Description of Artificial Sequence: Synthetic oligonucleotide
cuaaauaugugcagucaa

SEQ ID NO: 57474 - RNA, 18 nt, Artificial Sequence
  Description of Artificial Sequence: Synthetic oligonucleotide
guaugcuaaauaugugca

SEQ ID NO: 57475 - RNA, 18 nt, Artificial Sequence
  Description of Artificial Sequence: Synthetic oligonucleotide
agggaguaugcuaaauau

SEQ ID NO: 57476 - RNA, 18 nt, Artificial Sequence
  Description of Artificial Sequence: Synthetic oligonucleotide
uucccagggaguaugcua

SEQ ID NO: 57477 - RNA, 18 nt, Artificial Sequence
  Description of Artificial Sequence: Synthetic oligonucleotide
uauaauucccagggagua

SEQ ID NO: 57478 - RNA, 18 nt, Artificial Sequence
  Description of Artificial Sequence: Synthetic oligonucleotide
uaaaauauaauucccagg

SEQ ID NO: 57479 - RNA, 18 nt, Artificial Sequence
  Description of Artificial Sequence: Synthetic oligonucleotide
guccuuaaaauauaauuc

SEQ ID NO: 57480 - RNA, 18 nt, Artificial Sequence
  Description of Artificial Sequence: Synthetic oligonucleotide
aaaauguccuuaaaauau

SEQ ID NO: 57481 - RNA, 18 nt, Artificial Sequence
  Description of Artificial Sequence: Synthetic oligonucleotide
auagaaaaauguccuuaa

SEQ ID NO: 57482 - RNA, 18 nt, Artificial Sequence
  Description of Artificial Sequence: Synthetic oligonucleotide
auuuaauagaaaaauguc

SEQ ID NO: 57483 - RNA, 18 nt, Artificial Sequence
  Description of Artificial Sequence: Synthetic oligonucleotide
caaugauuuaauagaaaa

SEQ ID NO: 57484 - RNA, 18 nt, Artificial Sequence
  Description of Artificial Sequence: Synthetic oligonucleotide
auaugcaaugauuuaaua

SEQ ID NO: 57485 - RNA, 18 nt, Artificial Sequence
  Description of Artificial Sequence: Synthetic oligonucleotide
cuuccauaugcaaugauu

SEQ ID NO: 57486 - RNA, 18 nt, Artificial Sequence
  Description of Artificial Sequence: Synthetic oligonucleotide
aguuucuuccauaugcaa

SEQ ID NO: 57487 - RNA, 18 nt, Artificial Sequence
  Description of Artificial Sequence: Synthetic oligonucleotide
uauugaguuucuuccaua

SEQ ID NO: 57488 - RNA, 18 nt, Artificial Sequence
  Description of Artificial Sequence: Synthetic oligonucleotide
uauuauauugaguuucuu

SEQ ID NO: 57489 - RNA, 18 nt, Artificial Sequence
  Description of Artificial Sequence: Synthetic oligonucleotide
ucagcuauuauauugagu

SEQ ID NO: 57490 - RNA, 18 nt, Artificial Sequence
  Description of Artificial Sequence: Synthetic oligonucleotide
aaauaucagcuauuauau

SEQ ID NO: 57491 - RNA, 18 nt, Artificial Sequence
  Description of Artificial Sequence: Synthetic oligonucleotide
caaguaaauaucagcuau

SEQ ID NO: 57492 - RNA, 18 nt, Artificial Sequence
  Description of Artificial Sequence: Synthetic oligonucleotide
gaacccaaguaaauauca

SEQ ID NO: 57493 - RNA, 18 nt, Artificial Sequence
  Description of Artificial Sequence: Synthetic oligonucleotide
auuaagaacccaaguaaa

SEQ ID NO: 57494 - RNA, 18 nt, Artificial Sequence
  Description of Artificial Sequence: Synthetic oligonucleotide
uucugauuaagaacccaa

SEQ ID NO: 57495 - RNA, 18 nt, Artificial Sequence
  Description of Artificial Sequence: Synthetic oligonucleotide
caauguucugauuaagaa

SEQ ID NO: 57496 - RNA, 18 nt, Artificial Sequence
  Description of Artificial Sequence: Synthetic oligonucleotide
acagccaauguucugauu

SEQ ID NO: 57497 - RNA, 18 nt, Artificial Sequence
  Description of Artificial Sequence: Synthetic oligonucleotide
aucacacagccaauguuc

SEQ ID NO: 57498 - RNA, 18 nt, Artificial Sequence
  Description of Artificial Sequence: Synthetic oligonucleotide
ugaaaaucacacagccaa

SEQ ID NO: 57499 - RNA, 18 nt, Artificial Sequence
  Description of Artificial Sequence: Synthetic oligonucleotide
aaucaugaaaaucacaca

SEQ ID NO: 57500 - RNA, 18 nt, Artificial Sequence
  Description of Artificial Sequence: Synthetic oligonucleotide
aucauaaucaugaaaauc

SEQ ID NO: 57501 - RNA, 18 nt, Artificial Sequence
  Description of Artificial Sequence: Synthetic oligonucleotide
ugaaaaucauaaucauga

SEQ ID NO: 57502 - RNA, 18 nt, Artificial Sequence
  Description of Artificial Sequence: Synthetic oligonucleotide
ugcaaugaaaaucauaau

SEQ ID NO: 57503 - RNA, 18 nt, Artificial Sequence
  Description of Artificial Sequence: Synthetic oligonucleotide
uuaauugcaaugaaaauc

SEQ ID NO: 57504 - RNA, 18 nt, Artificial Sequence
  Description of Artificial Sequence: Synthetic oligonucleotide
ucaacuuaauugcaauga

SEQ ID NO: 57505 - RNA, 18 nt, Artificial Sequence
  Description of Artificial Sequence: Synthetic oligonucleotide
aaacaucaacuuaauugc

SEQ ID NO: 57506 - RNA, 18 nt, Artificial Sequence
  Description of Artificial Sequence: Synthetic oligonucleotide
cuacaaaacaucaacuua

SEQ ID NO: 57507 - RNA, 18 nt, Artificial Sequence
  Description of Artificial Sequence: Synthetic oligonucleotide
acugucuacaaaacauca

SEQ ID NO: 57508 - RNA, 18 nt, Artificial Sequence
  Description of Artificial Sequence: Synthetic oligonucleotide
auuucacugucuacaaaa

SEQ ID NO: 57509 - RNA, 18 nt, Artificial Sequence
  Description of Artificial Sequence: Synthetic oligonucleotide
ugguaauuucacugucua

SEQ ID NO: 57510 - RNA, 18 nt, Artificial Sequence
  Description of Artificial Sequence: Synthetic oligonucleotide
guagaugguaauuucacu

SEQ ID NO: 57511 - RNA, 18 nt, Artificial Sequence
  Description of Artificial Sequence: Synthetic oligonucleotide
uuggaguagaugguaauu

SEQ ID NO: 57512 - RNA, 18 nt, Artificial Sequence
  Description of Artificial Sequence: Synthetic oligonucleotide
aucuuuuggaguagaugg

SEQ ID NO: 57513 - RNA, 18 nt, Artificial Sequence
  Description of Artificial Sequence: Synthetic oligonucleotide
uugcaaucuuuuggagua

SEQ ID NO: 57514 - RNA, 18 nt, Artificial Sequence
  Description of Artificial Sequence: Synthetic oligonucleotide
cuauuuugcaaucuuuug

SEQ ID NO: 57515 - RNA, 18 nt, Artificial Sequence
  Description of Artificial Sequence: Synthetic oligonucleotide
aaauucuauuuugcaauc

SEQ ID NO: 57516 - RNA, 18 nt, Artificial Sequence
  Description of Artificial Sequence: Synthetic oligonucleotide
agguuaaauucuauuuug

SEQ ID NO: 57517 - RNA, 18 nt, Artificial Sequence
  Description of Artificial Sequence: Synthetic oligonucleotide
cucuaagguuaaauucua

SEQ ID NO: 57518 - RNA, 18 nt, Artificial Sequence
  Description of Artificial Sequence: Synthetic oligonucleotide
auuggcucuaagguuaaa

SEQ ID NO: 57519 - RNA, 18 nt, Artificial Sequence
  Description of Artificial Sequence: Synthetic oligonucleotide
ccugcauuggcucuaagg

SEQ ID NO: 57520 - RNA, 18 nt, Artificial Sequence
  Description of Artificial Sequence: Synthetic oligonucleotide
uuuucccugcauuggcuc

SEQ ID NO: 57521 - RNA, 18 nt, Artificial Sequence
  Description of Artificial Sequence: Synthetic oligonucleotide
acaaguuuucccugcauu

SEQ ID NO: 57522 - RNA, 18 nt, Artificial Sequence
  Description of Artificial Sequence: Synthetic oligonucleotide
cagaaacaaguuuucccu

SEQ ID NO: 57523 - RNA, 18 nt, Artificial Sequence
  Description of Artificial Sequence: Synthetic oligonucleotide
accugcagaaacaaguuu

SEQ ID NO: 57524 - RNA, 18 nt, Artificial Sequence
  Description of Artificial Sequence: Synthetic oligonucleotide
aaugcaccugcagaaaca

SEQ ID NO: 57525 - RNA, 18 nt, Artificial Sequence
  Description of Artificial Sequence: Synthetic oligonucleotide
caaaaaaugcaccugcag

SEQ ID NO: 57526 - RNA, 18 nt, Artificial Sequence
  Description of Artificial Sequence: Synthetic oligonucleotide
aguuucaaaaaaugcacc

SEQ ID NO: 57527 - RNA, 18 nt, Artificial Sequence
  Description of Artificial Sequence: Synthetic oligonucleotide
guugaaguuucaaaaaau

SEQ ID NO: 57528 - RNA, 18 nt, Artificial Sequence
  Description of Artificial Sequence: Synthetic oligonucleotide
uaucuguugaaguuucaa

SEQ ID NO: 57529 - RNA, 18 nt, Artificial Sequence
  Description of Artificial Sequence: Synthetic oligonucleotide
ccugcuaucuguugaagu

SEQ ID NO: 57530 - RNA, 18 nt, Artificial Sequence
  Description of Artificial Sequence: Synthetic oligonucleotide
uucccccugcuaucuguu

SEQ ID NO: 57531 - RNA, 18 nt, Artificial Sequence
  Description of Artificial Sequence: Synthetic oligonucleotide
uuuuuuucccccugcuau

SEQ ID NO: 57532 - RNA, 18 nt, Artificial Sequence
  Description of Artificial Sequence: Synthetic oligonucleotide
ucacuuuuuuuucccccu

SEQ ID NO: 57533 - RNA, 18 nt, Artificial Sequence
  Description of Artificial Sequence: Synthetic oligonucleotide
uucugucacuuuuuuuuc

SEQ ID NO: 57534 - RNA, 18 nt, Artificial Sequence
  Description of Artificial Sequence: Synthetic oligonucleotide
gauccuucugucacuuuu

SEQ ID NO: 57535 - RNA, 18 nt, Artificial Sequence
  Description of Artificial Sequence: Synthetic oligonucleotide
acugugauccuucuguca

SEQ ID NO: 57536 - RNA, 18 nt, Artificial Sequence
  Description of Artificial Sequence: Synthetic oligonucleotide
gcugaacugugauccuuc

SEQ ID NO: 57537 - RNA, 18 nt, Artificial Sequence
  Description of Artificial Sequence: Synthetic oligonucleotide
auacugcugaacugugau

SEQ ID NO: 57538 - RNA, 18 nt, Artificial Sequence
  Description of Artificial Sequence: Synthetic oligonucleotide
aauucauacugcugaacu

SEQ ID NO: 57539 - RNA, 18 nt, Artificial Sequence
  Description of Artificial Sequence: Synthetic oligonucleotide
cagacaauucauacugcu

SEQ ID NO: 57540 - RNA, 18 nt, Artificial Sequence
  Description of Artificial Sequence: Synthetic oligonucleotide
gccagcagacaauucaua

SEQ ID NO: 57541 - RNA, 18 nt, Artificial Sequence
  Description of Artificial Sequence: Synthetic oligonucleotide
aggcugccagcagacaau

SEQ ID NO: 57542 - RNA, 18 nt, Artificial Sequence
  Description of Artificial Sequence: Synthetic oligonucleotide
uugcaaggcugccagcag

SEQ ID NO: 57543 - RNA, 18 nt, Artificial Sequence
  Description of Artificial Sequence: Synthetic oligonucleotide
ccagauugcaaggcugcc

SEQ ID NO: 57544 - RNA, 18 nt, Artificial Sequence
  Description of Artificial Sequence: Synthetic oligonucleotide
gcacaccagauugcaagg

SEQ ID NO: 57545 - RNA, 18 nt, Artificial Sequence
  Description of Artificial Sequence: Synthetic oligonucleotide
ugccugcacaccagauug

SEQ ID NO: 57546 - RNA, 18 nt, Artificial Sequence
  Description of Artificial Sequence: Synthetic oligonucleotide
cucacugccugcacacca

SEQ ID NO: 57547 - RNA, 18 nt, Artificial Sequence
  Description of Artificial Sequence: Synthetic oligonucleotide
acaaucucacugccugca

SEQ ID NO: 57548 - RNA, 18 nt, Artificial Sequence
  Description of Artificial Sequence: Synthetic oligonucleotide
acaccacaaucucacugc

SEQ ID NO: 57549 - RNA, 18 nt, Artificial Sequence
  Description of Artificial Sequence: Synthetic oligonucleotide
cauguacaccacaaucuc

SEQ ID NO: 57550 - RNA, 18 nt, Artificial Sequence
  Description of Artificial Sequence: Synthetic oligonucleotide
ggugacauguacaccaca

SEQ ID NO: 57551 - RNA, 18 nt, Artificial Sequence
  Description of Artificial Sequence: Synthetic oligonucleotide
aaucaggugacauguaca

SEQ ID NO: 57552 - RNA, 18 nt, Artificial Sequence
  Description of Artificial Sequence: Synthetic oligonucleotide
uguaguccugguggcaug

SEQ ID NO: 57553 - RNA, 18 nt, Artificial Sequence
  Description of Artificial Sequence: Synthetic oligonucleotide
gccccuguaguccuggug

SEQ ID NO: 57554 - RNA, 18 nt, Artificial Sequence
  Description of Artificial Sequence: Synthetic oligonucleotide
acucugccccuguagucc

SEQ ID NO: 57555 - RNA, 18 nt, Artificial Sequence
  Description of Artificial Sequence: Synthetic oligonucleotide
gagacacucugccccugu

SEQ ID NO: 57556 - RNA, 18 nt, Artificial Sequence
  Description of Artificial Sequence: Synthetic oligonucleotide
cagaggagacacucugcc

SEQ ID NO: 57557 - RNA, 18 nt, Artificial Sequence
  Description of Artificial Sequence: Synthetic oligonucleotide
gcugccagaggagacacu

SEQ ID NO: 57558 - RNA, 18 nt, Artificial Sequence
  Description of Artificial Sequence: Synthetic oligonucleotide
ucagagcugccagaggag

SEQ ID NO: 57559 - RNA, 18 nt, Artificial Sequence
  Description of Artificial Sequence: Synthetic oligonucleotide
ugaucucagagcugccag

SEQ ID NO: 57560 - RNA, 18 nt, Artificial Sequence
  Description of Artificial Sequence: Synthetic oligonucleotide
ggauuugaucucagagcu

SEQ ID NO: 57561 - RNA, 18 nt, Artificial Sequence
  Description of Artificial Sequence: Synthetic oligonucleotide
ucaucggauuugaucuca

SEQ ID NO: 57562 - RNA, 18 nt, Artificial Sequence
  Description of Artificial Sequence: Synthetic oligonucleotide
ccucgucaucggauuuga

SEQ ID NO: 57563 - RNA, 18 nt, Artificial Sequence
  Description of Artificial Sequence: Synthetic oligonucleotide
aucacccucgucaucgga

SEQ ID NO: 57564 - RNA, 18 nt, Artificial Sequence
  Description of Artificial Sequence: Synthetic oligonucleotide
uucucaucacccucguca

SEQ ID NO: 57565 - RNA, 18 nt, Artificial Sequence
  Description of Artificial Sequence: Synthetic oligonucleotide
gcagguucucaucacccu

SEQ ID NO: 57566 - RNA, 18 nt, Artificial Sequence
  Description of Artificial Sequence: Synthetic oligonucleotide
gucuugcagguucucauc

SEQ ID NO: 57567 - RNA, 18 nt, Artificial Sequence
  Description of Artificial Sequence: Synthetic oligonucleotide
uucgugucuugcagguuc

SEQ ID NO: 57568 - RNA, 18 nt, Artificial Sequence
  Description of Artificial Sequence: Synthetic oligonucleotide
aagauuucgugucuugca

SEQ ID NO: 57569 - RNA, 18 nt, Artificial Sequence
  Description of Artificial Sequence: Synthetic oligonucleotide
cuccgaagauuucguguc

SEQ ID NO: 57570 - RNA, 18 nt, Artificial Sequence
  Description of Artificial Sequence: Synthetic oligonucleotide
uuguccuccgaagauuuc

SEQ ID NO: 57571 - RNA, 18 nt, Artificial Sequence
  Description of Artificial Sequence: Synthetic oligonucleotide
auuucuuguccuccgaag

SEQ ID NO: 57572 - RNA, 18 nt, Artificial Sequence
  Description of Artificial Sequence: Synthetic oligonucleotide
aucuaauuucuuguccuc

SEQ ID NO: 57573 - RNA, 18 nt, Artificial Sequence
  Description of Artificial Sequence: Synthetic oligonucleotide
ucgucaucuaauuucuug

SEQ ID NO: 57574 - RNA, 18 nt, Artificial Sequence
  Description of Artificial Sequence: Synthetic oligonucleotide
ucuugucgucaucuaauu

SEQ ID NO: 57575 - RNA, 18 nt, Artificial Sequence
  Description of Artificial Sequence: Synthetic oligonucleotide
auccuucuugucgucauc

SEQ ID NO: 57576 - RNA, 18 nt, Artificial Sequence
  Description of Artificial Sequence: Synthetic oligonucleotide
uugauauccuucuugucg

SEQ ID NO: 57577 - RNA, 18 nt, Artificial Sequence
  Description of Artificial Sequence: Synthetic oligonucleotide
uugauuugauauccuucu

SEQ ID NO: 57578 - RNA, 18 nt, Artificial Sequence
  Description of Artificial Sequence: Synthetic oligonucleotide
aguaauugauuugauauc

SEQ ID NO: 57579 - RNA, 18 nt, Artificial Sequence
  Description of Artificial Sequence: Synthetic oligonucleotide
uucacgauggguccccac

SEQ ID NO: 57580 - RNA, 18 nt, Artificial Sequence
  Description of Artificial Sequence: Synthetic oligonucleotide
ccaucuucacgauggguc

SEQ ID NO: 57581 - RNA, 18 nt, Artificial Sequence
  Description of Artificial Sequence: Synthetic oligonucleotide
ccacgccaucuucacgau

SEQ ID NO: 57582 - RNA, 18 nt, Artificial Sequence
  Description of Artificial Sequence: Synthetic oligonucleotide
cagggccacgccaucuuc

SEQ ID NO: 57583 - RNA, 18 nt, Artificial Sequence
  Description of Artificial Sequence: Synthetic oligonucleotide
ccucucagggccacgcca

SEQ ID NO: 57584 - RNA, 18 nt, Artificial Sequence
  Description of Artificial Sequence: Synthetic oligonucleotide
ggcugccucucagggcca

SEQ ID NO: 57585 - RNA, 18 nt, Artificial Sequence
  Description of Artificial Sequence: Synthetic oligonucleotide
agaauggcugccucucag

SEQ ID NO: 57586 - RNA, 18 nt, Artificial Sequence
  Description of Artificial Sequence: Synthetic oligonucleotide
agaagagaauggcugccu

SEQ ID NO: 57587 - RNA, 18 nt, Artificial Sequence
  Description of Artificial Sequence: Synthetic oligonucleotide
uuggcagaagagaauggc

SEQ ID NO: 57588 - RNA, 18 nt, Artificial Sequence
  Description of Artificial Sequence: Synthetic oligonucleotide
cugguuuggcagaagaga

SEQ ID NO: 57589 - RNA, 18 nt, Artificial Sequence
  Description of Artificial Sequence: Synthetic oligonucleotide
ggaaccugguuuggcaga

SEQ ID NO: 57590 - RNA, 18 nt, Artificial Sequence
  Description of Artificial Sequence: Synthetic oligonucleotide
gaaccggaaccugguuug

SEQ ID NO: 57591 - RNA, 18 nt, Artificial Sequence
  Description of Artificial Sequence: Synthetic oligonucleotide
cuguggaaccggaaccug

SEQ ID NO: 57592 - RNA, 18 nt, Artificial Sequence
  Description of Artificial Sequence: Synthetic oligonucleotide
ggaagcuguggaaccgga

SEQ ID NO: 57593 - RNA, 18 nt, Artificial Sequence
  Description of Artificial Sequence: Synthetic oligonucleotide
ggacaggaagcuguggaa

SEQ ID NO: 57594 - RNA, 18 nt, Artificial Sequence
  Description of Artificial Sequence: Synthetic oligonucleotide
agacuggacaggaagcug

SEQ ID NO: 57595 - RNA, 18 nt, Artificial Sequence
  Description of Artificial Sequence: Synthetic oligonucleotide
gucgcagacuggacagga

SEQ ID NO: 57596 - RNA, 18 nt, Artificial Sequence
  Description of Artificial Sequence: Synthetic oligonucleotide
gggaagucgcagacugga

SEQ ID NO: 57597 - RNA, 18 nt, Artificial Sequence
  Description of Artificial Sequence: Synthetic oligonucleotide
gguggguucaggucaggg

SEQ ID NO: 57598 - RNA, 18 nt, Artificial Sequence
  Description of Artificial Sequence: Synthetic oligonucleotide
ggguggguucaggucagg

SEQ ID NO: 57599 - RNA, 18 nt, Artificial Sequence
  Description of Artificial Sequence: Synthetic oligonucleotide
cucuguaaggguccuggg

SEQ ID NO: 57600 - RNA, 18 nt, Artificial Sequence
  Description of Artificial Sequence: Synthetic oligonucleotide
gugcccuggugaggccaa

SEQ ID NO: 57601 - RNA, 18 nt, Artificial Sequence
  Description of Artificial Sequence: Synthetic oligonucleotide
cagaagugcccuggugag

SEQ ID NO: 57602 - RNA, 18 nt, Artificial Sequence
  Description of Artificial Sequence: Synthetic oligonucleotide
gaggucagaagugcccug

SEQ ID NO: 57603 - RNA, 18 nt, Artificial Sequence
  Description of Artificial Sequence: Synthetic oligonucleotide
aaagugaggucagaagug

SEQ ID NO: 57604 - RNA, 18 nt, Artificial Sequence
  Description of Artificial Sequence: Synthetic oligonucleotide
uugugaaagugaggucag

SEQ ID NO: 57605 - RNA, 18 nt, Artificial Sequence
  Description of Artificial Sequence: Synthetic oligonucleotide
uccuauugugaaagugag

SEQ ID NO: 57606 - RNA, 18 nt, Artificial Sequence
  Description of Artificial Sequence: Synthetic oligonucleotide
acugguccuauugugaaa

SEQ ID NO: 57607 - RNA, 18 nt, Artificial Sequence
  Description of Artificial Sequence: Synthetic oligonucleotide
ucaacacugguccuauug

SEQ ID NO: 57608 - RNA, 18 nt, Artificial Sequence
  Description of Artificial Sequence: Synthetic oligonucleotide
ggguaucaacacuggucc

SEQ ID NO: 57609 - RNA, 18 nt, Artificial Sequence
  Description of Artificial Sequence: Synthetic oligonucleotide
aggcuggguaucaacacu

SEQ ID NO: 57610 - RNA, 18 nt, Artificial Sequence
  Description of Artificial Sequence: Synthetic oligonucleotide
ccaagaggcuggguauca

SEQ ID NO: 57611 - RNA, 18 nt, Artificial Sequence
  Description of Artificial Sequence: Synthetic oligonucleotide
gaacaccaagaggcuggg

SEQ ID NO: 57612 - RNA, 18 nt, Artificial Sequence
  Description of Artificial Sequence: Synthetic oligonucleotide
gggaugaacaccaagagg

SEQ ID NO: 57613 - RNA, 18 nt, Artificial Sequence
  Description of Artificial Sequence: Synthetic oligonucleotide
cuugagggaugaacacca

SEQ ID NO: 57614 - RNA, 18 nt, Artificial Sequence
  Description of Artificial Sequence: Synthetic oligonucleotide
ugcuucuugagggaugaa

SEQ ID NO: 57615 - RNA, 18 nt, Artificial Sequence
  Description of Artificial Sequence: Synthetic oligonucleotide
gccagugcuucuugaggg

SEQ ID NO: 57616 - RNA, 18 nt, Artificial Sequence
  Description of Artificial Sequence: Synthetic oligonucleotide
uuucugccagugcuucuu

SEQ ID NO: 57617 - RNA, 18 nt, Artificial Sequence
  Description of Artificial Sequence: Synthetic oligonucleotide
cuggguuucugccagugc

SEQ ID NO: 57618 - RNA, 18 nt, Artificial Sequence
  Description of Artificial Sequence: Synthetic oligonucleotide
gauuccuggguuucugcc

SEQ ID NO: 57619 - RNA, 18 nt, Artificial Sequence
  Description of Artificial Sequence: Synthetic oligonucleotide
aauuugauuccuggguuu

SEQ ID NO: 57620 - RNA, 18 nt, Artificial Sequence
  Description of Artificial Sequence: Synthetic oligonucleotide
ugcccaauuugauuccug

SEQ ID NO: 57621 - RNA, 18 nt, Artificial Sequence
  Description of Artificial Sequence: Synthetic oligonucleotide
uuuugugcccaauuugau

SEQ ID NO: 57622 - RNA, 18 nt, Artificial Sequence
  Description of Artificial Sequence: Synthetic oligonucleotide
accauuuuugugcccaau

SEQ ID NO: 57623 - RNA, 18 nt, Artificial Sequence
  Description of Artificial Sequence: Synthetic oligonucleotide
uccuuaccauuuuugugc

SEQ ID NO: 57624 - RNA, 18 nt, Artificial Sequence
  Description of Artificial Sequence: Synthetic oligonucleotide
ccauuuccuuaccauuuu

SEQ ID NO: 57625 - RNA, 18 nt, Artificial Sequence
  Description of Artificial Sequence: Synthetic oligonucleotide
cuuugccauuuccuuacc

SEQ ID NO: 57626 - RNA, 18 nt, Artificial Sequence
  Description of Artificial Sequence: Synthetic oligonucleotide
aaauacuuugccauuucc

SEQ ID NO: 57627 - RNA, 18 nt, Artificial Sequence
  Description of Artificial Sequence: Synthetic oligonucleotide
guucuaaauacuuugcca

SEQ ID NO: 57628 - RNA, 18 nt, Artificial Sequence
  Description of Artificial Sequence: Synthetic oligonucleotide
gcgaaguucuaaauacuu

SEQ ID NO: 57629 - RNA, 18 nt, Artificial Sequence
  Description of Artificial Sequence: Synthetic oligonucleotide
agcgggcgaaguucuaaa

SEQ ID NO: 57630 - RNA, 18 nt, Artificial Sequence
  Description of Artificial Sequence: Synthetic oligonucleotide
caauuagcgggcgaaguu

SEQ ID NO: 57631 - RNA, 18 nt, Artificial Sequence
  Description of Artificial Sequence: Synthetic oligonucleotide
aaacacaauuagcgggcg

SEQ ID NO: 57632 - RNA, 18 nt, Artificial Sequence
  Description of Artificial Sequence: Synthetic oligonucleotide
uggagaaacacaauuagc

SEQ ID NO: 57633 - RNA, 18 nt, Artificial Sequence
  Description of Artificial Sequence: Synthetic oligonucleotide
gucccuggagaaacacaa

SEQ ID NO: 57634 - RNA, 18 nt, Artificial Sequence
  Description of Artificial Sequence: Synthetic oligonucleotide
aaacagucccuggagaaa

SEQ ID NO: 57635 - RNA, 18 nt, Artificial Sequence
  Description of Artificial Sequence: Synthetic oligonucleotide
gaggaaaacagucccugg

SEQ ID NO: 57636 - RNA, 18 nt, Artificial Sequence
  Description of Artificial Sequence: Synthetic oligonucleotide
uguuugaggaaaacaguc

SEQ ID NO: 57637 - RNA, 18 nt, Artificial Sequence
  Description of Artificial Sequence: Synthetic oligonucleotide
gaggauguuugaggaaaa

SEQ ID NO: 57638 - RNA, 18 nt, Artificial Sequence
  Description of Artificial Sequence: Synthetic oligonucleotide
uuucagaggauguuugag

SEQ ID NO: 57639 - RNA, 18 nt, Artificial Sequence
  Description of Artificial Sequence: Synthetic oligonucleotide
caggauuucagaggaugu

SEQ ID NO: 57640 - RNA, 18 nt, Artificial Sequence
  Description of Artificial Sequence: Synthetic oligonucleotide
aggaccaggauuucagag

SEQ ID NO: 57641 - RNA, 18 nt, Artificial Sequence
  Description of Artificial Sequence: Synthetic oligonucleotide
gauauaggaccaggauuu

SEQ ID NO: 57642 - RNA, 18 nt, Artificial Sequence
  Description of Artificial Sequence: Synthetic oligonucleotide
cugcugauauaggaccag

SEQ ID NO: 57643 - RNA, 18 nt, Artificial Sequence
  Description of Artificial Sequence: Synthetic oligonucleotide
auucccugcugauauagg

SEQ ID NO: 57644 - RNA, 18 nt, Artificial Sequence
  Description of Artificial Sequence: Synthetic oligonucleotide
gccucauucccugcugau

SEQ ID NO: 57645 - RNA, 18 nt, Artificial Sequence
  Description of Artificial Sequence: Synthetic oligonucleotide
cuguggccucauucccug

SEQ ID NO: 57646 - RNA, 18 nt, Artificial Sequence
  Description of Artificial Sequence: Synthetic oligonucleotide
ucagucuguggccucauu

SEQ ID NO: 57647 - RNA, 18 nt, Artificial Sequence
  Description of Artificial Sequence: Synthetic oligonucleotide
ucucaucagucuguggcc

SEQ ID NO: 57648 - RNA, 18 nt, Artificial Sequence
  Description of Artificial Sequence: Synthetic oligonucleotide
uuuccucucaucagucug

SEQ ID NO: 57649 - RNA, 18 nt, Artificial Sequence
  Description of Artificial Sequence: Synthetic oligonucleotide
uaaaauuuccucucauca

SEQ ID NO: 57650 - RNA, 18 nt, Artificial Sequence
  Description of Artificial Sequence: Synthetic oligonucleotide
uaaaauaaaauuuccucu

SEQ ID NO: 57651 - RNA, 18 nt, Artificial Sequence
  Description of Artificial Sequence: Synthetic oligonucleotide
auagcuaaaauaaaauuu

SEQ ID NO: 57652 - RNA, 18 nt, Artificial Sequence
  Description of Artificial Sequence: Synthetic oligonucleotide
uggaaauagcuaaaauaa

SEQ ID NO: 57653 - RNA, 18 nt, Artificial Sequence
  Description of Artificial Sequence: Synthetic oligonucleotide
aaauguggaaauagcuaa

SEQ ID NO: 57654 - RNA, 18 nt, Artificial Sequence
  Description of Artificial Sequence: Synthetic oligonucleotide
gagaaaaauguggaaaua

SEQ ID NO: 57655 - RNA, 18 nt, Artificial Sequence
  Description of Artificial Sequence: Synthetic oligonucleotide
ugaaugagaaaaaugugg

SEQ ID NO: 57656 - RNA, 18 nt, Artificial Sequence
  Description of Artificial Sequence: Synthetic oligonucleotide
ggaccugaaugagaaaaa

SEQ ID NO: 57657 - RNA, 18 nt, Artificial Sequence
  Description of Artificial Sequence: Synthetic oligonucleotide
uuagaggaccugaaugag

SEQ ID NO: 57658 - RNA, 18 nt, Artificial Sequence
  Description of Artificial Sequence: Synthetic oligonucleotide
ccacauuagaggaccuga

SEQ ID NO: 57659 - RNA, 18 nt, Artificial Sequence
  Description of Artificial Sequence: Synthetic oligonucleotide
acuaaccacauuagagga

SEQ ID NO: 57660 - RNA, 18 nt, Artificial Sequence
  Description of Artificial Sequence: Synthetic oligonucleotide
ccacaacuaaccacauua

SEQ ID NO: 57661 - RNA, 18 nt, Artificial Sequence
  Description of Artificial Sequence: Synthetic oligonucleotide
ucaggccacaacuaacca

SEQ ID NO: 57662 - RNA, 18 nt, Artificial Sequence
  Description of Artificial Sequence: Synthetic oligonucleotide
cauuuucaggccacaacu

SEQ ID NO: 57663 - RNA, 18 nt, Artificial Sequence
  Description of Artificial Sequence: Synthetic oligonucleotide
aauaucauuuucaggcca

SEQ ID NO: 57664 - RNA, 18 nt, Artificial Sequence
  Description of Artificial Sequence: Synthetic oligonucleotide
uuggaaauaucauuuuca

SEQ ID NO: 57665 - RNA, 18 nt, Artificial Sequence
  Description of Artificial Sequence: Synthetic oligonucleotide
uucauuuggaaauaucau

SEQ ID NO: 57666 - RNA, 18 nt, Artificial Sequence
  Description of Artificial Sequence: Synthetic oligonucleotide
uccuauucauuuggaaau

SEQ ID NO: 57667 - RNA, 18 nt, Artificial Sequence
  Description of Artificial Sequence: Synthetic oligonucleotide
uuccuuccuauucauuug

SEQ ID NO: 57668 - RNA, 18 nt, Artificial Sequence
  Description of Artificial Sequence: Synthetic oligonucleotide
uuuccuuccuuccuauuc

SEQ ID NO: 57669 - RNA, 18 nt, Artificial Sequence
  Description of Artificial Sequence: Synthetic oligonucleotide
aacaauuuccuuccuucc

SEQ ID NO: 57670 - RNA, 18 nt, Artificial Sequence
  Description of Artificial Sequence: Synthetic oligonucleotide
acaaaaacaauuuccuuc

SEQ ID NO: 57671 - RNA, 18 nt, Artificial Sequence
  Description of Artificial Sequence: Synthetic oligonucleotide
aaacaacaaaaacaauuu

SEQ ID NO: 57672 - RNA, 18 nt, Artificial Sequence
  Description of Artificial Sequence: Synthetic oligonucleotide
aucuuaaacaacaaaaac

SEQ ID NO: 57673 - RNA, 18 nt, Artificial Sequence
  Description of Artificial Sequence: Synthetic oligonucleotide
cuuccaucuuaaacaaca

SEQ ID NO: 57674 - RNA, 18 nt, Artificial Sequence
  Description of Artificial Sequence: Synthetic oligonucleotide
auuuccuuccaucuuaaa

SEQ ID NO: 57675 - RNA, 18 nt, Artificial Sequence
  Description of Artificial Sequence: Synthetic oligonucleotide
ccuauauuuccuuccauc

SEQ ID NO: 57676 - RNA, 18 nt, Artificial Sequence
  Description of Artificial Sequence: Synthetic oligonucleotide
augcaccuauauuuccuu

SEQ ID NO: 57677 - RNA, 18 nt, Artificial Sequence
  Description of Artificial Sequence: Synthetic oligonucleotide
uuuaaaugcaccuauauu

SEQ ID NO: 57678 - RNA, 18 nt, Artificial Sequence
  Description of Artificial Sequence: Synthetic oligonucleotide
cauuuuuuaaaugcaccu

SEQ ID NO: 57679 - RNA, 18 nt, Artificial Sequence
  Description of Artificial Sequence: Synthetic oligonucleotide
agcuccauuuuuuaaaug

SEQ ID NO: 57680 - RNA, 18 nt, Artificial Sequence
  Description of Artificial Sequence: Synthetic oligonucleotide
aaccaagcuccauuuuuu

SEQ ID NO: 57681 - RNA, 18 nt, Artificial Sequence
  Description of Artificial Sequence: Synthetic oligonucleotide
caugcaaccaagcuccau

SEQ ID NO: 57682 - RNA, 18 nt, Artificial Sequence
  Description of Artificial Sequence: Synthetic oligonucleotide
aaaaucaugcaaccaagc

SEQ ID NO: 57683 - RNA, 18 nt, Artificial Sequence
  Description of Artificial Sequence: Synthetic oligonucleotide
gagcgaaaaucaugcaac

SEQ ID NO: 57684 - RNA, 18 nt, Artificial Sequence
  Description of Artificial Sequence: Synthetic oligonucleotide
cucaagagcgaaaaucau

SEQ ID NO: 57685 - RNA, 18 nt, Artificial Sequence
  Description of Artificial Sequence: Synthetic oligonucleotide
gaugacucaagagcgaaa

SEQ ID NO: 57686 - RNA, 18 nt, Artificial Sequence
  Description of Artificial Sequence: Synthetic oligonucleotide
ggcuagaugacucaagag

SEQ ID NO: 57687 - RNA, 18 nt, Artificial Sequence
  Description of Artificial Sequence: Synthetic oligonucleotide
uagagggcuagaugacuc

SEQ ID NO: 57688 - RNA, 18 nt, Artificial Sequence
  Description of Artificial Sequence: Synthetic oligonucleotide
aucauuagagggcuagau

SEQ ID NO: 57689 - RNA, 18 nt, Artificial Sequence
  Description of Artificial Sequence: Synthetic oligonucleotide
aggcaaucauuagagggc

SEQ ID NO: 57690 - RNA, 18 nt, Artificial Sequence
  Description of Artificial Sequence: Synthetic oligonucleotide
guaugaggcaaucauuag

SEQ ID NO: 57691 - RNA, 18 nt, Artificial Sequence
  Description of Artificial Sequence: Synthetic oligonucleotide
caccgguaugaggcaauc

SEQ ID NO: 57692 - RNA, 18 nt, Artificial Sequence
  Description of Artificial Sequence: Synthetic oligonucleotide
guaaucaccgguaugagg

SEQ ID NO: 57693 - RNA, 18 nt, Artificial Sequence
  Description of Artificial Sequence: Synthetic oligonucleotide
cgcucguaaucaccggua

SEQ ID NO: 57694 - RNA, 18 nt, Artificial Sequence
  Description of Artificial Sequence: Synthetic oligonucleotide
aaagccgcucguaaucac

SEQ ID NO: 57695 - RNA, 18 nt, Artificial Sequence
  Description of Artificial Sequence: Synthetic oligonucleotide
caugaaaagccgcucgua

SEQ ID NO: 57696 - RNA, 18 nt, Artificial Sequence
  Description of Artificial Sequence: Synthetic oligonucleotide
gggucaugaaaagccgcu

SEQ ID NO: 57697 - RNA, 18 nt, Artificial Sequence
  Description of Artificial Sequence: Synthetic oligonucleotide
aaaugguacauauggaag

SEQ ID NO: 57698 - RNA, 18 nt, Artificial Sequence
  Description of Artificial Sequence: Synthetic oligonucleotide
uuuuaaaaugguacauau

SEQ ID NO: 57699 - RNA, 18 nt, Artificial Sequence
  Description of Artificial Sequence: Synthetic oligonucleotide
cagcauuuuaaaauggua

SEQ ID NO: 57700 - RNA, 18 nt, Artificial Sequence
  Description of Artificial Sequence: Synthetic oligonucleotide
guaaucagcauuuuaaaa

SEQ ID NO: 57701 - RNA, 18 nt, Artificial Sequence
  Description of Artificial Sequence: Synthetic oligonucleotide
aagaaguaaucagcauuu

SEQ ID NO: 57702 - RNA, 18 nt, Artificial Sequence
  Description of Artificial Sequence: Synthetic oligonucleotide
uucucaagaaguaaucag

SEQ ID NO: 57703 - RNA, 18 nt, Artificial Sequence
  Description of Artificial Sequence: Synthetic oligonucleotide
ucuuauucucaagaagua

SEQ ID NO: 57704 - RNA, 18 nt, Artificial Sequence
  Description of Artificial Sequence: Synthetic oligonucleotide
gcuucucuuauucucaag

SEQ ID NO: 57705 - RNA, 18 nt, Artificial Sequence
  Description of Artificial Sequence: Synthetic oligonucleotide
auuaggcuucucuuauuc

SEQ ID NO: 57706 - RNA, 18 nt, Artificial Sequence
  Description of Artificial Sequence: Synthetic oligonucleotide
cugaaauuaggcuucucu

SEQ ID NO: 57707 - RNA, 18 nt, Artificial Sequence
  Description of Artificial Sequence: Synthetic oligonucleotide
auauucugaaauuaggcu

SEQ ID NO: 57708 - RNA, 18 nt, Artificial Sequence
  Description of Artificial Sequence: Synthetic oligonucleotide
uaaugauauucugaaauu

SEQ ID NO: 57709 - RNA, 18 nt, Artificial Sequence
  Description of Artificial Sequence: Synthetic oligonucleotide
uacccuaaugauauucug

SEQ ID NO: 57710 - RNA, 18 nt, Artificial Sequence
  Description of Artificial Sequence: Synthetic oligonucleotide
auagguacccuaaugaua

SEQ ID NO: 57711 - RNA, 18 nt, Artificial Sequence
  Description of Artificial Sequence: Synthetic oligonucleotide
cuucaauagguacccuaa

SEQ ID NO: 57712 - RNA, 18 nt, Artificial Sequence
  Description of Artificial Sequence: Synthetic oligonucleotide
caagacuucaauagguac

SEQ ID NO: 57713 - RNA, 18 nt, Artificial Sequence
  Description of Artificial Sequence: Synthetic oligonucleotide
gcagucaagacuucaaua

SEQ ID NO: 57714 - RNA, 18 nt, Artificial Sequence
  Description of Artificial Sequence: Synthetic oligonucleotide
uaugugcagucaagacuu

SEQ ID NO: 57715 - RNA, 18 nt, Artificial Sequence
  Description of Artificial Sequence: Synthetic oligonucleotide
cuaaauaugugcagucaa

SEQ ID NO: 57716 - RNA, 18 nt, Artificial Sequence
  Description of Artificial Sequence: Synthetic oligonucleotide
guaugcuaaauaugugca

SEQ ID NO: 57717 - RNA, 18 nt, Artificial Sequence
  Description of Artificial Sequence: Synthetic oligonucleotide
agggaguaugcuaaauau

SEQ ID NO: 57718 - RNA, 18 nt, Artificial Sequence
  Description of Artificial Sequence: Synthetic oligonucleotide
uucccagggaguaugcua

SEQ ID NO: 57719 - RNA, 18 nt, Artificial Sequence
  Description of Artificial Sequence: Synthetic oligonucleotide
uauaauucccagggagua

SEQ ID NO: 57720 - RNA, 18 nt, Artificial Sequence
  Description of Artificial Sequence: Synthetic oligonucleotide
uaaaauauaauucccagg

SEQ ID NO: 57721 - RNA, 18 nt, Artificial Sequence
  Description of Artificial Sequence: Synthetic oligonucleotide
guccuuaaaauauaauuc

SEQ ID NO: 57722 - RNA, 18 nt, Artificial Sequence
  Description of Artificial Sequence: Synthetic oligonucleotide
aaaauguccuuaaaauau

SEQ ID NO: 57723 - RNA, 18 nt, Artificial Sequence
  Description of Artificial Sequence: Synthetic oligonucleotide
auagaaaaauguccuuaa

SEQ ID NO: 57724 - RNA, 18 nt, Artificial Sequence
  Description of Artificial Sequence: Synthetic oligonucleotide
auuuaauagaaaaauguc

SEQ ID NO: 57725 - RNA, 18 nt, Artificial Sequence
  Description of Artificial Sequence: Synthetic oligonucleotide
caaugauuuaauagaaaa

SEQ ID NO: 57726 - RNA, 18 nt, Artificial Sequence
  Description of Artificial Sequence: Synthetic oligonucleotide
auaugcaaugauuuaaua

SEQ ID NO: 57727 - RNA, 18 nt, Artificial Sequence
  Description of Artificial Sequence: Synthetic oligonucleotide
cuuccauaugcaaugauu

SEQ ID NO: 57728 - RNA, 18 nt, Artificial Sequence
  Description of Artificial Sequence: Synthetic oligonucleotide
aguuucuuccauaugcaa

SEQ ID NO: 57729 - RNA, 18 nt, Artificial Sequence
  Description of Artificial Sequence: Synthetic oligonucleotide
uauugaguuucuuccaua

SEQ ID NO: 57730 - RNA, 18 nt, Artificial Sequence
  Description of Artificial Sequence: Synthetic oligonucleotide
uauuauauugaguuucuu

SEQ ID NO: 57731 - RNA, 18 nt, Artificial Sequence
  Description of Artificial Sequence: Synthetic oligonucleotide
ucagcuauuauauugagu

SEQ ID NO: 57732 - RNA, 18 nt, Artificial Sequence
  Description of Artificial Sequence: Synthetic oligonucleotide
aaauaucagcuauuauau

SEQ ID NO: 57733 - RNA, 18 nt, Artificial Sequence
  Description of Artificial Sequence: Synthetic oligonucleotide
caaguaaauaucagcuau

SEQ ID NO: 57734 - RNA, 18 nt, Artificial Sequence
  Description of Artificial Sequence: Synthetic oligonucleotide
gaacccaaguaaauauca

SEQ ID NO: 57735 - RNA, 18 nt, Artificial Sequence
  Description of Artificial Sequence: Synthetic oligonucleotide
auuaagaacccaaguaaa

SEQ ID NO: 57736 - RNA, 18 nt, Artificial Sequence
  Description of Artificial Sequence: Synthetic oligonucleotide
uucugauuaagaacccaa

SEQ ID NO: 57737 - RNA, 18 nt, Artificial Sequence
  Description of Artificial Sequence: Synthetic oligonucleotide
caauguucugauuaagaa

SEQ ID NO: 57738 - RNA, 18 nt, Artificial Sequence
  Description of Artificial Sequence: Synthetic oligonucleotide
acagccaauguucugauu

SEQ ID NO: 57739 - RNA, 18 nt, Artificial Sequence
  Description of Artificial Sequence: Synthetic oligonucleotide
aucacacagccaauguuc

SEQ ID NO: 57740 - RNA, 18 nt, Artificial Sequence
  Description of Artificial Sequence: Synthetic oligonucleotide
ugaaaaucacacagccaa

SEQ ID NO: 57741 - RNA, 18 nt, Artificial Sequence
  Description of Artificial Sequence: Synthetic oligonucleotide
aaucaugaaaaucacaca

SEQ ID NO: 57742 - RNA, 18 nt, Artificial Sequence
  Description of Artificial Sequence: Synthetic oligonucleotide
aucauaaucaugaaaauc

SEQ ID NO: 57743 - RNA, 18 nt, Artificial Sequence
  Description of Artificial Sequence: Synthetic oligonucleotide
ugaaaaucauaaucauga

SEQ ID NO: 57744 - RNA, 18 nt, Artificial Sequence
  Description of Artificial Sequence: Synthetic oligonucleotide
ugcaaugaaaaucauaau

SEQ ID NO: 57745 - RNA, 18 nt, Artificial Sequence
  Description of Artificial Sequence: Synthetic oligonucleotide
uuaauugcaaugaaaauc

SEQ ID NO: 57746 - RNA, 18 nt, Artificial Sequence
  Description of Artificial Sequence: Synthetic oligonucleotide
ucaacuuaauugcaauga

SEQ ID NO: 57747 - RNA, 18 nt, Artificial Sequence
  Description of Artificial Sequence: Synthetic oligonucleotide
aaacaucaacuuaauugc

SEQ ID NO: 57748 - RNA, 18 nt, Artificial Sequence
  Description of Artificial Sequence: Synthetic oligonucleotide
cuacaaaacaucaacuua

SEQ ID NO: 57749 - RNA, 18 nt, Artificial Sequence
  Description of Artificial Sequence: Synthetic oligonucleotide
acugucuacaaaacauca

SEQ ID NO: 57750 - RNA, 18 nt, Artificial Sequence
  Description of Artificial Sequence: Synthetic oligonucleotide
auuucacugucuacaaaa

SEQ ID NO: 57751 - RNA, 18 nt, Artificial Sequence
  Description of Artificial Sequence: Synthetic oligonucleotide
ugguaauuucacugucua

SEQ ID NO: 57752 - RNA, 18 nt, Artificial Sequence
  Description of Artificial Sequence: Synthetic oligonucleotide
guagaugguaauuucacu

SEQ ID NO: 57753 - RNA, 18 nt, Artificial Sequence
  Description of Artificial Sequence: Synthetic oligonucleotide
uuggaguagaugguaauu

SEQ ID NO: 57754 - RNA, 18 nt, Artificial Sequence
  Description of Artificial Sequence: Synthetic oligonucleotide
aucuuuuggaguagaugg

SEQ ID NO: 57755 - RNA, 18 nt, Artificial Sequence
  Description of Artificial Sequence: Synthetic oligonucleotide
uugcaaucuuuuggagua

SEQ ID NO: 57756 - RNA, 18 nt, Artificial Sequence
  Description of Artificial Sequence: Synthetic oligonucleotide
cuauuuugcaaucuuuug

SEQ ID NO: 57757 - RNA, 18 nt, Artificial Sequence
  Description of Artificial Sequence: Synthetic oligonucleotide
aaauucuauuuugcaauc

SEQ ID NO: 57758 - RNA, 18 nt, Artificial Sequence
  Description of Artificial Sequence: Synthetic oligonucleotide
agguuaaauucuauuuug

SEQ ID NO: 57759 - RNA, 18 nt, Artificial Sequence
  Description of Artificial Sequence: Synthetic oligonucleotide
cucuaagguuaaauucua

SEQ ID NO: 57760 - RNA, 18 nt, Artificial Sequence
  Description of Artificial Sequence: Synthetic oligonucleotide
auuggcucuaagguuaaa

SEQ ID NO: 57761 - RNA, 18 nt, Artificial Sequence
  Description of Artificial Sequence: Synthetic oligonucleotide
ccugcauuggcucuaagg

SEQ ID NO: 57762 - RNA, 18 nt, Artificial Sequence
  Description of Artificial Sequence: Synthetic oligonucleotide
uuuucccugcauuggcuc

SEQ ID NO: 57763 - RNA, 18 nt, Artificial Sequence
  Description of Artificial Sequence: Synthetic oligonucleotide
acaaguuuucccugcauu

SEQ ID NO: 57764 - RNA, 18 nt, Artificial Sequence
  Description of Artificial Sequence: Synthetic oligonucleotide
cagaaacaaguuuucccu

SEQ ID NO: 57765 - RNA, 18 nt, Artificial Sequence
  Description of Artificial Sequence: Synthetic oligonucleotide
accugcagaaacaaguuu

SEQ ID NO: 57766 - RNA, 18 nt, Artificial Sequence
  Description of Artificial Sequence: Synthetic oligonucleotide
aaugcaccugcagaaaca

SEQ ID NO: 57767 - RNA, 18 nt, Artificial Sequence
  Description of Artificial Sequence: Synthetic oligonucleotide
caaaaaaugcaccugcag

SEQ ID NO: 57768 - RNA, 18 nt, Artificial Sequence
  Description of Artificial Sequence: Synthetic oligonucleotide
aguuucaaaaaaugcacc

SEQ ID NO: 57769 - RNA, 18 nt, Artificial Sequence
  Description of Artificial Sequence: Synthetic oligonucleotide
guugaaguuucaaaaaau

SEQ ID NO: 57770 - RNA, 18 nt, Artificial Sequence
  Description of Artificial Sequence: Synthetic oligonucleotide
uaucuguugaaguuucaa

SEQ ID NO: 57771 - RNA, 18 nt, Artificial Sequence
  Description of Artificial Sequence: Synthetic oligonucleotide
ccugcuaucuguugaagu

SEQ ID NO: 57772 - RNA, 18 nt, Artificial Sequence
  Description of Artificial Sequence: Synthetic oligonucleotide
uucccccugcuaucuguu

SEQ ID NO: 57773 - RNA, 18 nt, Artificial Sequence
  Description of Artificial Sequence: Synthetic oligonucleotide
uuuuuuucccccugcuau

SEQ ID NO: 57774 - RNA, 18 nt, Artificial Sequence
  Description of Artificial Sequence: Synthetic oligonucleotide
ucacuuuuuuuucccccu

SEQ ID NO: 57775 - RNA, 18 nt, Artificial Sequence
  Description of Artificial Sequence: Synthetic oligonucleotide
uucugucacuuuuuuuuc

SEQ ID NO: 57776 - RNA, 18 nt, Artificial Sequence
  Description of Artificial Sequence: Synthetic oligonucleotide
gauccuucugucacuuuu

SEQ ID NO: 57777 - RNA, 18 nt, Artificial Sequence
  Description of Artificial Sequence: Synthetic oligonucleotide
acugugauccuucuguca

SEQ ID NO: 57778 - RNA, 18 nt, Artificial Sequence
  Description of Artificial Sequence: Synthetic oligonucleotide
gcugaacugugauccuuc

SEQ ID NO: 57779 - RNA, 18 nt, Artificial Sequence
  Description of Artificial Sequence: Synthetic oligonucleotide
auacugcugaacugugau

SEQ ID NO: 57780 - RNA, 18 nt, Artificial Sequence
  Description of Artificial Sequence: Synthetic oligonucleotide
aauucauacugcugaacu

SEQ ID NO: 57781 - RNA, 18 nt, Artificial Sequence
  Description of Artificial Sequence: Synthetic oligonucleotide
cagacaauucauacugcu

SEQ ID NO: 57782 - RNA, 18 nt, Artificial Sequence
  Description of Artificial Sequence: Synthetic oligonucleotide
gccagcagacaauucaua

SEQ ID NO: 57783 - RNA, 18 nt, Artificial Sequence
  Description of Artificial Sequence: Synthetic oligonucleotide
aggcugccagcagacaau

SEQ ID NO: 57784 - RNA, 18 nt, Artificial Sequence
  Description of Artificial Sequence: Synthetic oligonucleotide
uugcaaggcugccagcag

SEQ ID NO: 57785 - RNA, 18 nt, Artificial Sequence
  Description of Artificial Sequence: Synthetic oligonucleotide
ccagauugcaaggcugcc

SEQ ID NO: 57786 - RNA, 18 nt, Artificial Sequence
  Description of Artificial Sequence: Synthetic oligonucleotide
gcacaccagauugcaagg

SEQ ID NO: 57787 - RNA, 18 nt, Artificial Sequence
  Description of Artificial Sequence: Synthetic oligonucleotide
ugccugcacaccagauug

SEQ ID NO: 57788 - RNA, 18 nt, Artificial Sequence
  Description of Artificial Sequence: Synthetic oligonucleotide
cucacugccugcacacca

SEQ ID NO: 57789 - RNA, 18 nt, Artificial Sequence
  Description of Artificial Sequence: Synthetic oligonucleotide
acaaucucacugccugca

SEQ ID NO: 57790 - RNA, 18 nt, Artificial Sequence
  Description of Artificial Sequence: Synthetic oligonucleotide
acaccacaaucucacugc

SEQ ID NO: 57791 - RNA, 18 nt, Artificial Sequence
  Description of Artificial Sequence: Synthetic oligonucleotide
cauguacaccacaaucuc

SEQ ID NO: 57792 - RNA, 18 nt, Artificial Sequence
  Description of Artificial Sequence: Synthetic oligonucleotide
ggugacauguacaccaca

SEQ ID NO: 57793 - RNA, 18 nt, Artificial Sequence
  Description of Artificial Sequence: Synthetic oligonucleotide
aaucaggugacauguaca

SEQ ID NO: 57794 - RNA, 18 nt, Artificial Sequence
  Description of Artificial Sequence: Synthetic oligonucleotide
uguaguccugguggcaug

SEQ ID NO: 57795 - RNA, 18 nt, Artificial Sequence
  Description of Artificial Sequence: Synthetic oligonucleotide
gccccuguaguccuggug

SEQ ID NO: 57796 - RNA, 18 nt, Artificial Sequence
  Description of Artificial Sequence: Synthetic oligonucleotide
acucugccccuguagucc

SEQ ID NO: 57797 - RNA, 18 nt, Artificial Sequence
  Description of Artificial Sequence: Synthetic oligonucleotide
gagacacucugccccugu

SEQ ID NO: 57798 - RNA, 18 nt, Artificial Sequence
  Description of Artificial Sequence: Synthetic oligonucleotide
cagaggagacacucugcc

SEQ ID NO: 57799 - RNA, 18 nt, Artificial Sequence
  Description of Artificial Sequence: Synthetic oligonucleotide
gcugccagaggagacacu

SEQ ID NO: 57800 - RNA, 18 nt, Artificial Sequence
  Description of Artificial Sequence: Synthetic oligonucleotide
ucagagcugccagaggag

SEQ ID NO: 57801 - RNA, 18 nt, Artificial Sequence
  Description of Artificial Sequence: Synthetic oligonucleotide
ugaucucagagcugccag

SEQ ID NO: 57802 - RNA, 18 nt, Artificial Sequence
  Description of Artificial Sequence: Synthetic oligonucleotide
ggauuugaucucagagcu

SEQ ID NO: 57803 - RNA, 18 nt, Artificial Sequence
  Description of Artificial Sequence: Synthetic oligonucleotide
ucaucggauuugaucuca

SEQ ID NO: 57804 - RNA, 18 nt, Artificial Sequence
  Description of Artificial Sequence: Synthetic oligonucleotide
ccucgucaucggauuuga

SEQ ID NO: 57805 - RNA, 18 nt, Artificial Sequence
  Description of Artificial Sequence: Synthetic oligonucleotide
aucacccucgucaucgga

SEQ ID NO: 57806 - RNA, 18 nt, Artificial Sequence
  Description of Artificial Sequence: Synthetic oligonucleotide
uucucaucacccucguca

SEQ ID NO: 57807 - RNA, 18 nt, Artificial Sequence
  Description of Artificial Sequence: Synthetic oligonucleotide
gcagguucucaucacccu

SEQ ID NO: 57808 - RNA, 18 nt, Artificial Sequence
  Description of Artificial Sequence: Synthetic oligonucleotide
gucuugcagguucucauc

SEQ ID NO: 57809 - RNA, 18 nt, Artificial Sequence
  Description of Artificial Sequence: Synthetic oligonucleotide
uucgugucuugcagguuc

SEQ ID NO: 57810 - RNA, 18 nt, Artificial Sequence
  Description of Artificial Sequence: Synthetic oligonucleotide
aagauuucgugucuugca

SEQ ID NO: 57811 - RNA, 18 nt, Artificial Sequence
  Description of Artificial Sequence: Synthetic oligonucleotide
cuccgaagauuucguguc

SEQ ID NO: 57812 - RNA, 18 nt, Artificial Sequence
  Description of Artificial Sequence: Synthetic oligonucleotide
uuguccuccgaagauuuc

SEQ ID NO: 57813 - RNA, 18 nt, Artificial Sequence
  Description of Artificial Sequence: Synthetic oligonucleotide
auuucuuguccuccgaag

SEQ ID NO: 57814 - RNA, 18 nt, Artificial Sequence
  Description of Artificial Sequence: Synthetic oligonucleotide
aucuaauuucuuguccuc

SEQ ID NO: 57815 - RNA, 18 nt, Artificial Sequence
  Description of Artificial Sequence: Synthetic oligonucleotide
ucgucaucuaauuucuug

SEQ ID NO: 57816 - RNA, 18 nt, Artificial Sequence
  Description of Artificial Sequence: Synthetic oligonucleotide
ucuugucgucaucuaauu

SEQ ID NO: 57817 - RNA, 18 nt, Artificial Sequence
  Description of Artificial Sequence: Synthetic oligonucleotide
auccuucuugucgucauc

SEQ ID NO: 57818 - RNA, 18 nt, Artificial Sequence
  Description of Artificial Sequence: Synthetic oligonucleotide
uugauauccuucuugucg

SEQ ID NO: 57819 - RNA, 18 nt, Artificial Sequence
  Description of Artificial Sequence: Synthetic oligonucleotide
uugauuugauauccuucu

SEQ ID NO: 57820 - RNA, 18 nt, Artificial Sequence
  Description of Artificial Sequence: Synthetic oligonucleotide
aguaauugauuugauauc

SEQ ID NO: 57821 - RNA, 18 nt, Artificial Sequence
  Description of Artificial Sequence: Synthetic oligonucleotide
uucacgauggguccccac

SEQ ID NO: 57822 - RNA, 18 nt, Artificial Sequence
  Description of Artificial Sequence: Synthetic oligonucleotide
ccaucuucacgauggguc

SEQ ID NO: 57823 - RNA, 18 nt, Artificial Sequence
  Description of Artificial Sequence: Synthetic oligonucleotide
ccacgccaucuucacgau

SEQ ID NO: 57824 - RNA, 18 nt, Artificial Sequence
  Description of Artificial Sequence: Synthetic oligonucleotide
cagggccacgccaucuuc

SEQ ID NO: 57825 - RNA, 18 nt, Artificial Sequence
  Description of Artificial Sequence: Synthetic oligonucleotide
ccucucagggccacgcca

SEQ ID NO: 57826 - RNA, 18 nt, Artificial Sequence
  Description of Artificial Sequence: Synthetic oligonucleotide
ggcugccucucagggcca

SEQ ID NO: 57827 - RNA, 18 nt, Artificial Sequence
  Description of Artificial Sequence: Synthetic oligonucleotide
agaauggcugccucucag

SEQ ID NO: 57828 - RNA, 18 nt, Artificial Sequence
  Description of Artificial Sequence: Synthetic oligonucleotide
agaagagaauggcugccu

SEQ ID NO: 57829 - RNA, 18 nt, Artificial Sequence
  Description of Artificial Sequence: Synthetic oligonucleotide
uuggcagaagagaauggc

SEQ ID NO: 57830 - RNA, 18 nt, Artificial Sequence
  Description of Artificial Sequence: Synthetic oligonucleotide
cugguuuggcagaagaga

SEQ ID NO: 57831 - RNA, 18 nt, Artificial Sequence
  Description of Artificial Sequence: Synthetic oligonucleotide
ggaaccugguuuggcaga

SEQ ID NO: 57832 - RNA, 18 nt, Artificial Sequence
  Description of Artificial Sequence: Synthetic oligonucleotide
gaaccggaaccugguuug

SEQ ID NO: 57833 - RNA, 18 nt, Artificial Sequence
  Description of Artificial Sequence: Synthetic oligonucleotide
cuguggaaccggaaccug

SEQ ID NO: 57834 - RNA, 18 nt, Artificial Sequence
  Description of Artificial Sequence: Synthetic oligonucleotide
ggaagcuguggaaccgga

SEQ ID NO: 57835 - RNA, 18 nt, Artificial Sequence
  Description of Artificial Sequence: Synthetic oligonucleotide
ggacaggaagcuguggaa

SEQ ID NO: 57836 - RNA, 18 nt, Artificial Sequence
  Description of Artificial Sequence: Synthetic oligonucleotide
agacuggacaggaagcug

SEQ ID NO: 57837 - RNA, 18 nt, Artificial Sequence
  Description of Artificial Sequence: Synthetic oligonucleotide
gucgcagacuggacagga

SEQ ID NO: 57838 - RNA, 18 nt, Artificial Sequence
  Description of Artificial Sequence: Synthetic oligonucleotide
gggaagucgcagacugga

SEQ ID NO: 57839 - RNA, 18 nt, Artificial Sequence
  Description of Artificial Sequence: Synthetic oligonucleotide
gguggguucaggucaggg

SEQ ID NO: 57840 - RNA, 18 nt, Artificial Sequence
  Description of Artificial Sequence: Synthetic oligonucleotide
ggguggguucaggucagg

SEQ ID NO: 57841 - RNA, 18 nt, Artificial Sequence
  Description of Artificial Sequence: Synthetic oligonucleotide
cucuguaaggguccuggg

SEQ ID NO: 57842 - RNA, 18 nt, Artificial Sequence
  Description of Artificial Sequence: Synthetic oligonucleotide
gugcccuggugaggccaa

SEQ ID NO: 57843 - RNA, 18 nt, Artificial Sequence
  Description of Artificial Sequence: Synthetic oligonucleotide
cagaagugcccuggugag

SEQ ID NO: 57844 - RNA, 18 nt, Artificial Sequence
  Description of Artificial Sequence: Synthetic oligonucleotide
gaggucagaagugcccug

SEQ ID NO: 57845 - RNA, 18 nt, Artificial Sequence
  Description of Artificial Sequence: Synthetic oligonucleotide
aaagugaggucagaagug

SEQ ID NO: 57846 - RNA, 18 nt, Artificial Sequence
  Description of Artificial Sequence: Synthetic oligonucleotide
uugugaaagugaggucag

SEQ ID NO: 57847 - RNA, 18 nt, Artificial Sequence
  Description of Artificial Sequence: Synthetic oligonucleotide
uccuauugugaaagugag

SEQ ID NO: 57848 - RNA, 18 nt, Artificial Sequence
  Description of Artificial Sequence: Synthetic oligonucleotide
acugguccuauugugaaa

SEQ ID NO: 57849 - RNA, 18 nt, Artificial Sequence
  Description of Artificial Sequence: Synthetic oligonucleotide
ucaacacugguccuauug

SEQ ID NO: 57850 - RNA, 18 nt, Artificial Sequence
  Description of Artificial Sequence: Synthetic oligonucleotide
ggguaucaacacuggucc

SEQ ID NO: 57851 - RNA, 18 nt, Artificial Sequence
  Description of Artificial Sequence: Synthetic oligonucleotide
aggcuggguaucaacacu

SEQ ID NO: 57852 - RNA, 18 nt, Artificial Sequence
  Description of Artificial Sequence: Synthetic oligonucleotide
ccaagaggcuggguauca

SEQ ID NO: 57853 - RNA, 18 nt, Artificial Sequence
  Description of Artificial Sequence: Synthetic oligonucleotide
gaacaccaagaggcuggg

SEQ ID NO: 57854 - RNA, 18 nt, Artificial Sequence
  Description of Artificial Sequence: Synthetic oligonucleotide
gggaugaacaccaagagg

SEQ ID NO: 57855 - RNA, 18 nt, Artificial Sequence
  Description of Artificial Sequence: Synthetic oligonucleotide
cuugagggaugaacacca

SEQ ID NO: 57856 - RNA, 18 nt, Artificial Sequence
  Description of Artificial Sequence: Synthetic oligonucleotide
ugcuucuugagggaugaa

SEQ ID NO: 57857 - RNA, 18 nt, Artificial Sequence
  Description of Artificial Sequence: Synthetic oligonucleotide
gccagugcuucuugaggg

SEQ ID NO: 57858 - RNA, 18 nt, Artificial Sequence
  Description of Artificial Sequence: Synthetic oligonucleotide
uuucugccagugcuucuu

SEQ ID NO: 57859 - RNA, 18 nt, Artificial Sequence
  Description of Artificial Sequence: Synthetic oligonucleotide
cuggguuucugccagugc

SEQ ID NO: 57860 - RNA, 18 nt, Artificial Sequence
  Description of Artificial Sequence: Synthetic oligonucleotide
gauuccuggguuucugcc

SEQ ID NO: 57861 - RNA, 18 nt, Artificial Sequence
  Description of Artificial Sequence: Synthetic oligonucleotide
aauuugauuccuggguuu

SEQ ID NO: 57862 - RNA, 18 nt, Artificial Sequence
  Description of Artificial Sequence: Synthetic oligonucleotide
ugcccaauuugauuccug

SEQ ID NO: 57863 - RNA, 18 nt, Artificial Sequence
  Description of Artificial Sequence: Synthetic oligonucleotide
uuuugugcccaauuugau

SEQ ID NO: 57864 - RNA, 18 nt, Artificial Sequence
  Description of Artificial Sequence: Synthetic oligonucleotide
accauuuuugugcccaau

SEQ ID NO: 57865 - RNA, 18 nt, Artificial Sequence
  Description of Artificial Sequence: Synthetic oligonucleotide
uccuuaccauuuuugugc

SEQ ID NO: 57866 - RNA, 18 nt, Artificial Sequence
  Description of Artificial Sequence: Synthetic oligonucleotide
ccauuuccuuaccauuuu

SEQ ID NO: 57867 - RNA, 18 nt, Artificial Sequence
  Description of Artificial Sequence: Synthetic oligonucleotide
cuuugccauuuccuuacc

SEQ ID NO: 57868 - RNA, 18 nt, Artificial Sequence
  Description of Artificial Sequence: Synthetic oligonucleotide
aaauacuuugccauuucc

SEQ ID NO: 57869 - RNA, 18 nt, Artificial Sequence
  Description of Artificial Sequence: Synthetic oligonucleotide
guucuaaauacuuugcca

SEQ ID NO: 57870 - RNA, 18 nt, Artificial Sequence
  Description of Artificial Sequence: Synthetic oligonucleotide
gcgaaguucuaaauacuu

SEQ ID NO: 57871 - RNA, 18 nt, Artificial Sequence
  Description of Artificial Sequence: Synthetic oligonucleotide
agcgggcgaaguucuaaa

SEQ ID NO: 57872 - RNA, 18 nt, Artificial Sequence
  Description of Artificial Sequence: Synthetic oligonucleotide
caauuagcgggcgaaguu

SEQ ID NO: 57873 - RNA, 18 nt, Artificial Sequence
  Description of Artificial Sequence: Synthetic oligonucleotide
aaacacaauuagcgggcg

SEQ ID NO: 57874 - RNA, 18 nt, Artificial Sequence
  Description of Artificial Sequence: Synthetic oligonucleotide
uggagaaacacaauuagc

SEQ ID NO: 57875 - RNA, 18 nt, Artificial Sequence
  Description of Artificial Sequence: Synthetic oligonucleotide
gucccuggagaaacacaa

SEQ ID NO: 57876 - RNA, 18 nt, Artificial Sequence
  Description of Artificial Sequence: Synthetic oligonucleotide
aaacagucccuggagaaa

SEQ ID NO: 57877 - RNA, 18 nt, Artificial Sequence
  Description of Artificial Sequence: Synthetic oligonucleotide
gaggaaaacagucccugg

SEQ ID NO: 57878 - RNA, 18 nt, Artificial Sequence
  Description of Artificial Sequence: Synthetic oligonucleotide
uguuugaggaaaacaguc

SEQ ID NO: 57879 - RNA, 18 nt, Artificial Sequence
  Description of Artificial Sequence: Synthetic oligonucleotide
gaggauguuugaggaaaa

SEQ ID NO: 57880 - RNA, 18 nt, Artificial Sequence
  Description of Artificial Sequence: Synthetic oligonucleotide
uuucagaggauguuugag

SEQ ID NO: 57881 - RNA, 18 nt, Artificial Sequence
  Description of Artificial Sequence: Synthetic oligonucleotide
caggauuucagaggaugu

SEQ ID NO: 57882 - RNA, 18 nt, Artificial Sequence
  Description of Artificial Sequence: Synthetic oligonucleotide
aggaccaggauuucagag

SEQ ID NO: 57883 - RNA, 18 nt, Artificial Sequence
  Description of Artificial Sequence: Synthetic oligonucleotide
gauauaggaccaggauuu

SEQ ID NO: 57884 - RNA, 18 nt, Artificial Sequence
  Description of Artificial Sequence: Synthetic oligonucleotide
cugcugauauaggaccag

SEQ ID NO: 57885 - RNA, 18 nt, Artificial Sequence
  Description of Artificial Sequence: Synthetic oligonucleotide
auucccugcugauauagg

SEQ ID NO: 57886 - RNA, 18 nt, Artificial Sequence
  Description of Artificial Sequence: Synthetic oligonucleotide
gccucauucccugcugau

SEQ ID NO: 57887 - RNA, 18 nt, Artificial Sequence
  Description of Artificial Sequence: Synthetic oligonucleotide
cuguggccucauucccug

SEQ ID NO: 57888 - RNA, 18 nt, Artificial Sequence
  Description of Artificial Sequence: Synthetic oligonucleotide
ucagucuguggccucauu

SEQ ID NO: 57889 - RNA, 18 nt, Artificial Sequence
  Description of Artificial Sequence: Synthetic oligonucleotide
ucucaucagucuguggcc

SEQ ID NO: 57890 - RNA, 18 nt, Artificial Sequence
  Description of Artificial Sequence: Synthetic oligonucleotide
uuuccucucaucagucug

SEQ ID NO: 57891 - RNA, 18 nt, Artificial Sequence
  Description of Artificial Sequence: Synthetic oligonucleotide
uaaaauuuccucucauca

SEQ ID NO: 57892 - RNA, 18 nt, Artificial Sequence
  Description of Artificial Sequence: Synthetic oligonucleotide
uaaaauaaaauuuccucu

SEQ ID NO: 57893 - RNA, 18 nt, Artificial Sequence
  Description of Artificial Sequence: Synthetic oligonucleotide
auagcuaaaauaaaauuu

SEQ ID NO: 57894 - RNA, 18 nt, Artificial Sequence
  Description of Artificial Sequence: Synthetic oligonucleotide
uggaaauagcuaaaauaa

SEQ ID NO: 57895 - RNA, 18 nt, Artificial Sequence
  Description of Artificial Sequence: Synthetic oligonucleotide
aaauguggaaauagcuaa

SEQ ID NO: 57896 - RNA, 18 nt, Artificial Sequence
  Description of Artificial Sequence: Synthetic oligonucleotide
gagaaaaauguggaaaua

SEQ ID NO: 57897 - RNA, 18 nt, Artificial Sequence
  Description of Artificial Sequence: Synthetic oligonucleotide
ugaaugagaaaaaugugg

SEQ ID NO: 57898 - RNA, 18 nt, Artificial Sequence
  Description of Artificial Sequence: Synthetic oligonucleotide
ggaccugaaugagaaaaa

SEQ ID NO: 57899 - RNA, 18 nt, Artificial Sequence
  Description of Artificial Sequence: Synthetic oligonucleotide
uuagaggaccugaaugag

SEQ ID NO: 57900 - RNA, 18 nt, Artificial Sequence
  Description of Artificial Sequence: Synthetic oligonucleotide
ccacauuagaggaccuga

SEQ ID NO: 57901 - RNA, 18 nt, Artificial Sequence
  Description of Artificial Sequence: Synthetic oligonucleotide
acuaaccacauuagagga

SEQ ID NO: 57902 - RNA, 18 nt, Artificial Sequence
  Description of Artificial Sequence: Synthetic oligonucleotide
ccacaacuaaccacauua

SEQ ID NO: 57903 - RNA, 18 nt, Artificial Sequence
  Description of Artificial Sequence: Synthetic oligonucleotide
ucaggccacaacuaacca

SEQ ID NO: 57904 - RNA, 18 nt, Artificial Sequence
  Description of Artificial Sequence: Synthetic oligonucleotide
cauuuucaggccacaacu

SEQ ID NO: 57905 - RNA, 18 nt, Artificial Sequence
  Description of Artificial Sequence: Synthetic oligonucleotide
aauaucauuuucaggcca

SEQ ID NO: 57906 - RNA, 18 nt, Artificial Sequence
  Description of Artificial Sequence: Synthetic oligonucleotide
uuggaaauaucauuuuca

SEQ ID NO: 57907 - RNA, 18 nt, Artificial Sequence
  Description of Artificial Sequence: Synthetic oligonucleotide
uucauuuggaaauaucau

SEQ ID NO: 57908 - RNA, 18 nt, Artificial Sequence
  Description of Artificial Sequence: Synthetic oligonucleotide
uccuauucauuuggaaau

SEQ ID NO: 57909 - RNA, 18 nt, Artificial Sequence
  Description of Artificial Sequence: Synthetic oligonucleotide
uuccuuccuauucauuug

SEQ ID NO: 57910 - RNA, 18 nt, Artificial Sequence
  Description of Artificial Sequence: Synthetic oligonucleotide
uuuccuuccuuccuauuc

SEQ ID NO: 57911 - RNA, 18 nt, Artificial Sequence
  Description of Artificial Sequence: Synthetic oligonucleotide
aacaauuuccuuccuucc

SEQ ID NO: 57912 - RNA, 18 nt, Artificial Sequence
  Description of Artificial Sequence: Synthetic oligonucleotide
acaaaaacaauuuccuuc

SEQ ID NO: 57913 - RNA, 18 nt, Artificial Sequence
  Description of Artificial Sequence: Synthetic oligonucleotide
aaacaacaaaaacaauuu

SEQ ID NO: 57914 - RNA, 18 nt, Artificial Sequence
  Description of Artificial Sequence: Synthetic oligonucleotide
aucuuaaacaacaaaaac

SEQ ID NO: 57915 - RNA, 18 nt, Artificial Sequence
  Description of Artificial Sequence: Synthetic oligonucleotide
cuuccaucuuaaacaaca

SEQ ID NO: 57916 - RNA, 18 nt, Artificial Sequence
  Description of Artificial Sequence: Synthetic oligonucleotide
auuuccuuccaucuuaaa

SEQ ID NO: 57917 - RNA, 18 nt, Artificial Sequence
  Description of Artificial Sequence: Synthetic oligonucleotide
ccuauauuuccuuccauc

SEQ ID NO: 57918 - RNA, 18 nt, Artificial Sequence
  Description of Artificial Sequence: Synthetic oligonucleotide
augcaccuauauuuccuu

SEQ ID NO: 57919 - RNA, 18 nt, Artificial Sequence
  Description of Artificial Sequence: Synthetic oligonucleotide
uuuaaaugcaccuauauu

SEQ ID NO: 57920 - RNA, 18 nt, Artificial Sequence
  Description of Artificial Sequence: Synthetic oligonucleotide
cauuuuuuaaaugcaccu

SEQ ID NO: 57921 - RNA, 18 nt, Artificial Sequence
  Description of Artificial Sequence: Synthetic oligonucleotide
agcuccauuuuuuaaaug

SEQ ID NO: 57922 - RNA, 18 nt, Artificial Sequence
  Description of Artificial Sequence: Synthetic oligonucleotide
aaccaagcuccauuuuuu

SEQ ID NO: 57923 - RNA, 18 nt, Artificial Sequence
  Description of Artificial Sequence: Synthetic oligonucleotide
caugcaaccaagcuccau

SEQ ID NO: 57924 - RNA, 18 nt, Artificial Sequence
  Description of Artificial Sequence: Synthetic oligonucleotide
aaaaucaugcaaccaagc

SEQ ID NO: 57925 - RNA, 18 nt, Artificial Sequence
  Description of Artificial Sequence: Synthetic oligonucleotide
gagcgaaaaucaugcaac

SEQ ID NO: 57926 - RNA, 18 nt, Artificial Sequence
  Description of Artificial Sequence: Synthetic oligonucleotide
cucaagagcgaaaaucau

SEQ ID NO: 57927 - RNA, 18 nt, Artificial Sequence
  Description of Artificial Sequence: Synthetic oligonucleotide
gaugacucaagagcgaaa

SEQ ID NO: 57928 - RNA, 18 nt, Artificial Sequence
  Description of Artificial Sequence: Synthetic oligonucleotide
ggcuagaugacucaagag

SEQ ID NO: 57929 - RNA, 18 nt, Artificial Sequence
  Description of Artificial Sequence: Synthetic oligonucleotide
uagagggcuagaugacuc

SEQ ID NO: 57930 - RNA, 18 nt, Artificial Sequence
  Description of Artificial Sequence: Synthetic oligonucleotide
aucauuagagggcuagau

SEQ ID NO: 57931 - RNA, 18 nt, Artificial Sequence
  Description of Artificial Sequence: Synthetic oligonucleotide
aggcaaucauuagagggc

SEQ ID NO: 57932 - RNA, 18 nt, Artificial Sequence
  Description of Artificial Sequence: Synthetic oligonucleotide
guaugaggcaaucauuag

SEQ ID NO: 57933 - RNA, 18 nt, Artificial Sequence
  Description of Artificial Sequence: Synthetic oligonucleotide
caccgguaugaggcaauc

SEQ ID NO: 57934 - RNA, 18 nt, Artificial Sequence
  Description of Artificial Sequence: Synthetic oligonucleotide
guaaucaccgguaugagg

SEQ ID NO: 57935 - RNA, 18 nt, Artificial Sequence
  Description of Artificial Sequence: Synthetic oligonucleotide
cgcucguaaucaccggua

SEQ ID NO: 57936 - RNA, 18 nt, Artificial Sequence
  Description of Artificial Sequence: Synthetic oligonucleotide
aaagccgcucguaaucac

SEQ ID NO: 57937 - RNA, 18 nt, Artificial Sequence
  Description of Artificial Sequence: Synthetic oligonucleotide
caugaaaagccgcucgua

SEQ ID NO: 57938 - RNA, 18 nt, Artificial Sequence
  Description of Artificial Sequence: Synthetic oligonucleotide
gggucaugaaaagccgcu

SEQ ID NO: 57939 - RNA, 18 nt, Artificial Sequence
  Description of Artificial Sequence: Synthetic oligonucleotide
aaaugguacauauggaag

SEQ ID NO: 57940 - RNA, 18 nt, Artificial Sequence
  Description of Artificial Sequence: Synthetic oligonucleotide
uuuuaaaaugguacauau

SEQ ID NO: 57941 - RNA, 18 nt, Artificial Sequence
  Description of Artificial Sequence: Synthetic oligonucleotide
cagcauuuuaaaauggua

SEQ ID NO: 57942 - RNA, 18 nt, Artificial Sequence
  Description of Artificial Sequence: Synthetic oligonucleotide
guaaucagcauuuuaaaa

SEQ ID NO: 57943 - RNA, 18 nt, Artificial Sequence
  Description of Artificial Sequence: Synthetic oligonucleotide
aagaaguaaucagcauuu

SEQ ID NO: 57944 - RNA, 18 nt, Artificial Sequence
  Description of Artificial Sequence: Synthetic oligonucleotide
uucucaagaaguaaucag

SEQ ID NO: 57945 - RNA, 18 nt, Artificial Sequence
  Description of Artificial Sequence: Synthetic oligonucleotide
ucuuauucucaagaagua

SEQ ID NO: 57946 - RNA, 18 nt, Artificial Sequence
  Description of Artificial Sequence: Synthetic oligonucleotide
gcuucucuuauucucaag

SEQ ID NO: 57947 - RNA, 18 nt, Artificial Sequence
  Description of Artificial Sequence: Synthetic oligonucleotide
auuaggcuucucuuauuc

SEQ ID NO: 57948 - RNA, 18 nt, Artificial Sequence
  Description of Artificial Sequence: Synthetic oligonucleotide
cugaaauuaggcuucucu

SEQ ID NO: 57949 - RNA, 18 nt, Artificial Sequence
  Description of Artificial Sequence: Synthetic oligonucleotide
auauucugaaauuaggcu

SEQ ID NO: 57950 - RNA, 18 nt, Artificial Sequence
  Description of Artificial Sequence: Synthetic oligonucleotide
uaaugauauucugaaauu

SEQ ID NO: 57951 - RNA, 18 nt, Artificial Sequence
  Description of Artificial Sequence: Synthetic oligonucleotide
uacccuaaugauauucug

SEQ ID NO: 57952 - RNA, 18 nt, Artificial Sequence
  Description of Artificial Sequence: Synthetic oligonucleotide
auagguacccuaaugaua

SEQ ID NO: 57953 - RNA, 18 nt, Artificial Sequence
  Description of Artificial Sequence: Synthetic oligonucleotide
cuucaauagguacccuaa

SEQ ID NO: 57954 - RNA, 18 nt, Artificial Sequence
  Description of Artificial Sequence: Synthetic oligonucleotide
caagacuucaauagguac

SEQ ID NO: 57955 - RNA, 18 nt, Artificial Sequence
  Description of Artificial Sequence: Synthetic oligonucleotide
gcagucaagacuucaaua

SEQ ID NO: 57956 - RNA, 18 nt, Artificial Sequence
  Description of Artificial Sequence: Synthetic oligonucleotide
uaugugcagucaagacuu

SEQ ID NO: 57957 - RNA, 18 nt, Artificial Sequence
  Description of Artificial Sequence: Synthetic oligonucleotide
cuaaauaugugcagucaa

SEQ ID NO: 57958 - RNA, 18 nt, Artificial Sequence
  Description of Artificial Sequence: Synthetic oligonucleotide
guaugcuaaauaugugca

SEQ ID NO: 57959 - RNA, 18 nt, Artificial Sequence
  Description of Artificial Sequence: Synthetic oligonucleotide
agggaguaugcuaaauau

SEQ ID NO: 57960 - RNA, 18 nt, Artificial Sequence
  Description of Artificial Sequence: Synthetic oligonucleotide
uucccagggaguaugcua

SEQ ID NO: 57961 - RNA, 18 nt, Artificial Sequence
  Description of Artificial Sequence: Synthetic oligonucleotide
uauaauucccagggagua

SEQ ID NO: 57962 - RNA, 18 nt, Artificial Sequence
  Description of Artificial Sequence: Synthetic oligonucleotide
uaaaauauaauucccagg

SEQ ID NO: 57963 - RNA, 18 nt, Artificial Sequence
  Description of Artificial Sequence: Synthetic oligonucleotide
guccuuaaaauauaauuc

SEQ ID NO: 57964 - RNA, 18 nt, Artificial Sequence
  Description of Artificial Sequence: Synthetic oligonucleotide
aaaauguccuuaaaauau

SEQ ID NO: 57965 - RNA, 18 nt, Artificial Sequence
  Description of Artificial Sequence: Synthetic oligonucleotide
auagaaaaauguccuuaa

SEQ ID NO: 57966 - RNA, 18 nt, Artificial Sequence
  Description of Artificial Sequence: Synthetic oligonucleotide
auuuaauagaaaaauguc

SEQ ID NO: 57967 - RNA, 18 nt, Artificial Sequence
  Description of Artificial Sequence: Synthetic oligonucleotide
caaugauuuaauagaaaa

SEQ ID NO: 57968 - RNA, 18 nt, Artificial Sequence
  Description of Artificial Sequence: Synthetic oligonucleotide
auaugcaaugauuuaaua

SEQ ID NO: 57969 - RNA, 18 nt, Artificial Sequence
  Description of Artificial Sequence: Synthetic oligonucleotide
cuuccauaugcaaugauu

SEQ ID NO: 57970 - RNA, 18 nt, Artificial Sequence
  Description of Artificial Sequence: Synthetic oligonucleotide
aguuucuuccauaugcaa

SEQ ID NO: 57971 - RNA, 18 nt, Artificial Sequence
  Description of Artificial Sequence: Synthetic oligonucleotide
uauugaguuucuuccaua

SEQ ID NO: 57972 - RNA, 18 nt, Artificial Sequence
  Description of Artificial Sequence: Synthetic oligonucleotide
uauuauauugaguuucuu

SEQ ID NO: 57973 - RNA, 18 nt, Artificial Sequence
  Description of Artificial Sequence: Synthetic oligonucleotide
ucagcuauuauauugagu

SEQ ID NO: 57974 - RNA, 18 nt, Artificial Sequence
  Description of Artificial Sequence: Synthetic oligonucleotide
aaauaucagcuauuauau

SEQ ID NO: 57975 - RNA, 18 nt, Artificial Sequence
  Description of Artificial Sequence: Synthetic oligonucleotide
caaguaaauaucagcuau

SEQ ID NO: 57976 - RNA, 18 nt, Artificial Sequence
  Description of Artificial Sequence: Synthetic oligonucleotide
gaacccaaguaaauauca

SEQ ID NO: 57977 - RNA, 18 nt, Artificial Sequence
  Description of Artificial Sequence: Synthetic oligonucleotide
auuaagaacccaaguaaa

SEQ ID NO: 57978 - RNA, 18 nt, Artificial Sequence
  Description of Artificial Sequence: Synthetic oligonucleotide
uucugauuaagaacccaa

SEQ ID NO: 57979 - RNA, 18 nt, Artificial Sequence
  Description of Artificial Sequence: Synthetic oligonucleotide
caauguucugauuaagaa

SEQ ID NO: 57980 - RNA, 18 nt, Artificial Sequence
  Description of Artificial Sequence: Synthetic oligonucleotide
acagccaauguucugauu

SEQ ID NO: 57981 - RNA, 18 nt, Artificial Sequence
  Description of Artificial Sequence: Synthetic oligonucleotide
aucacacagccaauguuc

SEQ ID NO: 57982 - RNA, 18 nt, Artificial Sequence
  Description of Artificial Sequence: Synthetic oligonucleotide
ugaaaaucacacagccaa

SEQ ID NO: 57983 - RNA, 18 nt, Artificial Sequence
  Description of Artificial Sequence: Synthetic oligonucleotide
aaucaugaaaaucacaca

SEQ ID NO: 57984 - RNA, 18 nt, Artificial Sequence
  Description of Artificial Sequence: Synthetic oligonucleotide
aucauaaucaugaaaauc

SEQ ID NO: 57985 - RNA, 18 nt, Artificial Sequence
  Description of Artificial Sequence: Synthetic oligonucleotide
ugaaaaucauaaucauga

SEQ ID NO: 57986 - RNA, 18 nt, Artificial Sequence
  Description of Artificial Sequence: Synthetic oligonucleotide
ugcaaugaaaaucauaau

SEQ ID NO: 57987 - RNA, 18 nt, Artificial Sequence
  Description of Artificial Sequence: Synthetic oligonucleotide
uuaauugcaaugaaaauc

SEQ ID NO: 57988 - RNA, 18 nt, Artificial Sequence
  Description of Artificial Sequence: Synthetic oligonucleotide
ucaacuuaauugcaauga

SEQ ID NO: 57989 - RNA, 18 nt, Artificial Sequence
  Description of Artificial Sequence: Synthetic oligonucleotide
aaacaucaacuuaauugc

SEQ ID NO: 57990 - RNA, 18 nt, Artificial Sequence
  Description of Artificial Sequence: Synthetic oligonucleotide
cuacaaaacaucaacuua

SEQ ID NO: 57991 - RNA, 18 nt, Artificial Sequence
  Description of Artificial Sequence: Synthetic oligonucleotide
acugucuacaaaacauca

SEQ ID NO: 57992 - RNA, 18 nt, Artificial Sequence
  Description of Artificial Sequence: Synthetic oligonucleotide
auuucacugucuacaaaa

SEQ ID NO: 57993 - RNA, 18 nt, Artificial Sequence
  Description of Artificial Sequence: Synthetic oligonucleotide
ugguaauuucacugucua

SEQ ID NO: 57994 - RNA, 18 nt, Artificial Sequence
  Description of Artificial Sequence: Synthetic oligonucleotide
guagaugguaauuucacu

SEQ ID NO: 57995 - RNA, 18 nt, Artificial Sequence
  Description of Artificial Sequence: Synthetic oligonucleotide
uuggaguagaugguaauu

SEQ ID NO: 57996 - RNA, 18 nt, Artificial Sequence
  Description of Artificial Sequence: Synthetic oligonucleotide
aucuuuuggaguagaugg

SEQ ID NO: 57997 - RNA, 18 nt, Artificial Sequence
  Description of Artificial Sequence: Synthetic oligonucleotide
uugcaaucuuuuggagua

SEQ ID NO: 57998 - RNA, 18 nt, Artificial Sequence
  Description of Artificial Sequence: Synthetic oligonucleotide
cuauuuugcaaucuuuug

SEQ ID NO: 57999 - RNA, 18 nt, Artificial Sequence
  Description of Artificial Sequence: Synthetic oligonucleotide
aaauucuauuuugcaauc

SEQ ID NO: 58000 - RNA, 18 nt, Artificial Sequence
  Description of Artificial Sequence: Synthetic oligonucleotide
agguuaaauucuauuuug

SEQ ID NO: 58001 - RNA, 18 nt, Artificial Sequence
  Description of Artificial Sequence: Synthetic oligonucleotide
cucuaagguuaaauucua

SEQ ID NO: 58002 - RNA, 18 nt, Artificial Sequence
  Description of Artificial Sequence: Synthetic oligonucleotide
auuggcucuaagguuaaa

SEQ ID NO: 58003 - RNA, 18 nt, Artificial Sequence
  Description of Artificial Sequence: Synthetic oligonucleotide
ccugcauuggcucuaagg

SEQ ID NO: 58004 - RNA, 18 nt, Artificial Sequence
  Description of Artificial Sequence: Synthetic oligonucleotide
uuuucccugcauuggcuc

SEQ ID NO: 58005 - RNA, 18 nt, Artificial Sequence
  Description of Artificial Sequence: Synthetic oligonucleotide
acaaguuuucccugcauu

SEQ ID NO: 58006 - RNA, 18 nt, Artificial Sequence
  Description of Artificial Sequence: Synthetic oligonucleotide
cagaaacaaguuuucccu

SEQ ID NO: 58007 - RNA, 18 nt, Artificial Sequence
  Description of Artificial Sequence: Synthetic oligonucleotide
accugcagaaacaaguuu

SEQ ID NO: 58008 - RNA, 18 nt, Artificial Sequence
  Description of Artificial Sequence: Synthetic oligonucleotide
aaugcaccugcagaaaca

SEQ ID NO: 58009 - RNA, 18 nt, Artificial Sequence
  Description of Artificial Sequence: Synthetic oligonucleotide
caaaaaaugcaccugcag

SEQ ID NO: 58010 - RNA, 18 nt, Artificial Sequence
  Description of Artificial Sequence: Synthetic oligonucleotide
aguuucaaaaaaugcacc

SEQ ID NO: 58011 - RNA, 18 nt, Artificial Sequence
  Description of Artificial Sequence: Synthetic oligonucleotide
guugaaguuucaaaaaau

SEQ ID NO: 58012 - RNA, 18 nt, Artificial Sequence
  Description of Artificial Sequence: Synthetic oligonucleotide
uaucuguugaaguuucaa

SEQ ID NO: 58013 - RNA, 18 nt, Artificial Sequence
  Description of Artificial Sequence: Synthetic oligonucleotide
ccugcuaucuguugaagu

SEQ ID NO: 58014 - RNA, 18 nt, Artificial Sequence
  Description of Artificial Sequence: Synthetic oligonucleotide
uucccccugcuaucuguu

SEQ ID NO: 58015 - RNA, 18 nt, Artificial Sequence
  Description of Artificial Sequence: Synthetic oligonucleotide
uuuuuuucccccugcuau

SEQ ID NO: 58016 - RNA, 18 nt, Artificial Sequence
  Description of Artificial Sequence: Synthetic oligonucleotide
ucacuuuuuuuucccccu

SEQ ID NO: 58017 - RNA, 18 nt, Artificial Sequence
  Description of Artificial Sequence: Synthetic oligonucleotide
uucugucacuuuuuuuuc

SEQ ID NO: 58018 - RNA, 18 nt, Artificial Sequence
  Description of Artificial Sequence: Synthetic oligonucleotide
gauccuucugucacuuuu

SEQ ID NO: 58019 - RNA, 18 nt, Artificial Sequence
  Description of Artificial Sequence: Synthetic oligonucleotide
acugugauccuucuguca

SEQ ID NO: 58020 - RNA, 18 nt, Artificial Sequence
  Description of Artificial Sequence: Synthetic oligonucleotide
gcugaacugugauccuuc

SEQ ID NO: 58021 - RNA, 18 nt, Artificial Sequence
  Description of Artificial Sequence: Synthetic oligonucleotide
auacugcugaacugugau

SEQ ID NO: 58022 - RNA, 18 nt, Artificial Sequence
  Description of Artificial Sequence: Synthetic oligonucleotide
aauucauacugcugaacu

SEQ ID NO: 58023 - RNA, 18 nt, Artificial Sequence
  Description of Artificial Sequence: Synthetic oligonucleotide
cagacaauucauacugcu

SEQ ID NO: 58024 - RNA, 18 nt, Artificial Sequence
  Description of Artificial Sequence: Synthetic oligonucleotide
gccagcagacaauucaua

SEQ ID NO: 58025 - RNA, 18 nt, Artificial Sequence
  Description of Artificial Sequence: Synthetic oligonucleotide
aggcugccagcagacaau

SEQ ID NO: 58026 - RNA, 18 nt, Artificial Sequence
  Description of Artificial Sequence: Synthetic oligonucleotide
uugcaaggcugccagcag

SEQ ID NO: 58027 - RNA, 18 nt, Artificial Sequence
  Description of Artificial Sequence: Synthetic oligonucleotide
ccagauugcaaggcugcc

SEQ ID NO: 58028 - RNA, 18 nt, Artificial Sequence
  Description of Artificial Sequence: Synthetic oligonucleotide
gcacaccagauugcaagg

SEQ ID NO: 58029 - RNA, 18 nt, Artificial Sequence
  Description of Artificial Sequence: Synthetic oligonucleotide
ugccugcacaccagauug

SEQ ID NO: 58030 - RNA, 18 nt, Artificial Sequence
  Description of Artificial Sequence: Synthetic oligonucleotide
cucacugccugcacacca

SEQ ID NO: 58031 - RNA, 18 nt, Artificial Sequence
  Description of Artificial Sequence: Synthetic oligonucleotide
acaaucucacugccugca

SEQ ID NO: 58032 - RNA, 18 nt, Artificial Sequence
  Description of Artificial Sequence: Synthetic oligonucleotide
acaccacaaucucacugc

SEQ ID NO: 58033 - RNA, 18 nt, Artificial Sequence
  Description of Artificial Sequence: Synthetic oligonucleotide
cauguacaccacaaucuc

SEQ ID NO: 58034 - RNA, 18 nt, Artificial Sequence
  Description of Artificial Sequence: Synthetic oligonucleotide
ggugacauguacaccaca

SEQ ID NO: 58035 - RNA, 18 nt, Artificial Sequence
  Description of Artificial Sequence: Synthetic oligonucleotide
aaucaggugacauguaca

SEQ ID NO: 58036 - RNA, 18 nt, Artificial Sequence
  Description of Artificial Sequence: Synthetic oligonucleotide
uguaguccugguggcaug

SEQ ID NO: 58037 - RNA, 18 nt, Artificial Sequence
  Description of Artificial Sequence: Synthetic oligonucleotide
gccccuguaguccuggug

SEQ ID NO: 58038 - RNA, 18 nt, Artificial Sequence
  Description of Artificial Sequence: Synthetic oligonucleotide
acucugccccuguagucc

SEQ ID NO: 58039 - RNA, 18 nt, Artificial Sequence
  Description of Artificial Sequence: Synthetic oligonucleotide
gagacacucugccccugu

SEQ ID NO: 58040 - RNA, 18 nt, Artificial Sequence
  Description of Artificial Sequence: Synthetic oligonucleotide
cagaggagacacucugcc

SEQ ID NO: 58041 - RNA, 18 nt, Artificial Sequence
  Description of Artificial Sequence: Synthetic oligonucleotide
gcugccagaggagacacu

SEQ ID NO: 58042 - RNA, 18 nt, Artificial Sequence
  Description of Artificial Sequence: Synthetic oligonucleotide
ucagagcugccagaggag

SEQ ID NO: 58043 - RNA, 18 nt, Artificial Sequence
  Description of Artificial Sequence: Synthetic oligonucleotide
ugaucucagagcugccag

SEQ ID NO: 58044 - RNA, 18 nt, Artificial Sequence
  Description of Artificial Sequence: Synthetic oligonucleotide
ggauuugaucucagagcu

SEQ ID NO: 58045 - RNA, 18 nt, Artificial Sequence
  Description of Artificial Sequence: Synthetic oligonucleotide
ucaucggauuugaucuca

SEQ ID NO: 58046 - RNA, 18 nt, Artificial Sequence
  Description of Artificial Sequence: Synthetic oligonucleotide
ccucgucaucggauuuga

SEQ ID NO: 58047 - RNA, 18 nt, Artificial Sequence
  Description of Artificial Sequence: Synthetic oligonucleotide
aucacccucgucaucgga

SEQ ID NO: 58048 - RNA, 18 nt, Artificial Sequence
  Description of Artificial Sequence: Synthetic oligonucleotide
uucucaucacccucguca

SEQ ID NO: 58049 - RNA, 18 nt, Artificial Sequence
  Description of Artificial Sequence: Synthetic oligonucleotide
gcagguucucaucacccu

SEQ ID NO: 58050 - RNA, 18 nt, Artificial Sequence
  Description of Artificial Sequence: Synthetic oligonucleotide
gucuugcagguucucauc

SEQ ID NO: 58051 - RNA, 18 nt, Artificial Sequence
  Description of Artificial Sequence: Synthetic oligonucleotide
uucgugucuugcagguuc

SEQ ID NO: 58052 - RNA, 18 nt, Artificial Sequence
  Description of Artificial Sequence: Synthetic oligonucleotide
aagauuucgugucuugca

SEQ ID NO: 58053 - RNA, 18 nt, Artificial Sequence
  Description of Artificial Sequence: Synthetic oligonucleotide
cuccgaagauuucguguc

SEQ ID NO: 58054 - RNA, 18 nt, Artificial Sequence
  Description of Artificial Sequence: Synthetic oligonucleotide
uuguccuccgaagauuuc

SEQ ID NO: 58055 - RNA, 18 nt, Artificial Sequence
  Description of Artificial Sequence: Synthetic oligonucleotide
auuucuuguccuccgaag

SEQ ID NO: 58056 - RNA, 18 nt, Artificial Sequence
  Description of Artificial Sequence: Synthetic oligonucleotide
aucuaauuucuuguccuc

SEQ ID NO: 58057 - RNA, 18 nt, Artificial Sequence
  Description of Artificial Sequence: Synthetic oligonucleotide
ucgucaucuaauuucuug

SEQ ID NO: 58058 - RNA, 18 nt, Artificial Sequence
  Description of Artificial Sequence: Synthetic oligonucleotide
ucuugucgucaucuaauu

SEQ ID NO: 58059 - RNA, 18 nt, Artificial Sequence
  Description of Artificial Sequence: Synthetic oligonucleotide
auccuucuugucgucauc

SEQ ID NO: 58060 - RNA, 18 nt, Artificial Sequence
  Description of Artificial Sequence: Synthetic oligonucleotide
uugauauccuucuugucg

SEQ ID NO: 58061 - RNA, 18 nt, Artificial Sequence
  Description of Artificial Sequence: Synthetic oligonucleotide
uugauuugauauccuucu

SEQ ID NO: 58062 - RNA, 18 nt, Artificial Sequence
  Description of Artificial Sequence: Synthetic oligonucleotide
aguaauugauuugauauc

SEQ ID NO: 58063 - RNA, 18 nt, Artificial Sequence
  Description of Artificial Sequence: Synthetic oligonucleotide
gaccuaguaauugauuug

SEQ ID NO: 58064 - RNA, 18 nt, Artificial Sequence
  Description of Artificial Sequence: Synthetic oligonucleotide
aucuugaccuaguaauug

SEQ ID NO: 58065 - RNA, 18 nt, Artificial Sequence
  Description of Artificial Sequence: Synthetic oligonucleotide
uucacgauggguccccac

SEQ ID NO: 58066 - RNA, 18 nt, Artificial Sequence
  Description of Artificial Sequence: Synthetic oligonucleotide
ccaucuucacgauggguc

SEQ ID NO: 58067 - RNA, 18 nt, Artificial Sequence
  Description of Artificial Sequence: Synthetic oligonucleotide
ccacgccaucuucacgau

SEQ ID NO: 58068 - RNA, 18 nt, Artificial Sequence
  Description of Artificial Sequence: Synthetic oligonucleotide
cagggccacgccaucuuc

SEQ ID NO: 58069 - RNA, 18 nt, Artificial Sequence
  Description of Artificial Sequence: Synthetic oligonucleotide
ccucucagggccacgcca

SEQ ID NO: 58070 - RNA, 18 nt, Artificial Sequence
  Description of Artificial Sequence: Synthetic oligonucleotide
ggcugccucucagggcca

SEQ ID NO: 58071 - RNA, 18 nt, Artificial Sequence
  Description of Artificial Sequence: Synthetic oligonucleotide
agaauggcugccucucag

SEQ ID NO: 58072 - RNA, 18 nt, Artificial Sequence
  Description of Artificial Sequence: Synthetic oligonucleotide
agaagagaauggcugccu

SEQ ID NO: 58073 - RNA, 18 nt, Artificial Sequence
  Description of Artificial Sequence: Synthetic oligonucleotide
uuggcagaagagaauggc

SEQ ID NO: 58074 - RNA, 18 nt, Artificial Sequence
  Description of Artificial Sequence: Synthetic oligonucleotide
cugguuuggcagaagaga

SEQ ID NO: 58075 - RNA, 18 nt, Artificial Sequence
  Description of Artificial Sequence: Synthetic oligonucleotide
ggaaccugguuuggcaga

SEQ ID NO: 58076 - RNA, 18 nt, Artificial Sequence
  Description of Artificial Sequence: Synthetic oligonucleotide
gaaccggaaccugguuug

SEQ ID NO: 58077 - RNA, 18 nt, Artificial Sequence
  Description of Artificial Sequence: Synthetic oligonucleotide
cuguggaaccggaaccug

SEQ ID NO: 58078 - RNA, 18 nt, Artificial Sequence
  Description of Artificial Sequence: Synthetic oligonucleotide
ggaagcuguggaaccgga

SEQ ID NO: 58079 - RNA, 18 nt, Artificial Sequence
  Description of Artificial Sequence: Synthetic oligonucleotide
ggacaggaagcuguggaa

SEQ ID NO: 58080 - RNA, 18 nt, Artificial Sequence
  Description of Artificial Sequence: Synthetic oligonucleotide
agacuggacaggaagcug

SEQ ID NO: 58081 - RNA, 18 nt, Artificial Sequence
  Description of Artificial Sequence: Synthetic oligonucleotide
gucgcagacuggacagga

SEQ ID NO: 58082 - RNA, 18 nt, Artificial Sequence
  Description of Artificial Sequence: Synthetic oligonucleotide
gggaagucgcagacugga

SEQ ID NO: 58083 - RNA, 18 nt, Artificial Sequence
  Description of Artificial Sequence: Synthetic oligonucleotide
gguggguucaggucaggg

SEQ ID NO: 58084 - RNA, 18 nt, Artificial Sequence
  Description of Artificial Sequence: Synthetic oligonucleotide
ggguggguucaggucagg

SEQ ID NO: 58085 - RNA, 18 nt, Artificial Sequence
  Description of Artificial Sequence: Synthetic oligonucleotide
cucuguaaggguccuggg

SEQ ID NO: 58086 - RNA, 18 nt, Artificial Sequence
  Description of Artificial Sequence: Synthetic oligonucleotide
gugcccuggugaggccaa

SEQ ID NO: 58087 - RNA, 18 nt, Artificial Sequence
  Description of Artificial Sequence: Synthetic oligonucleotide
cagaagugcccuggugag

SEQ ID NO: 58088 - RNA, 18 nt, Artificial Sequence
  Description of Artificial Sequence: Synthetic oligonucleotide
gaggucagaagugcccug

SEQ ID NO: 58089 - RNA, 18 nt, Artificial Sequence
  Description of Artificial Sequence: Synthetic oligonucleotide
aaagugaggucagaagug

SEQ ID NO: 58090 - RNA, 18 nt, Artificial Sequence
  Description of Artificial Sequence: Synthetic oligonucleotide
uugugaaagugaggucag

SEQ ID NO: 58091 - RNA, 18 nt, Artificial Sequence
  Description of Artificial Sequence: Synthetic oligonucleotide
uccuauugugaaagugag

SEQ ID NO: 58092 - RNA, 18 nt, Artificial Sequence
  Description of Artificial Sequence: Synthetic oligonucleotide
acugguccuauugugaaa

SEQ ID NO: 58093 - RNA, 18 nt, Artificial Sequence
  Description of Artificial Sequence: Synthetic oligonucleotide
ucaacacugguccuauug

SEQ ID NO: 58094 - RNA, 18 nt, Artificial Sequence
  Description of Artificial Sequence: Synthetic oligonucleotide
ggguaucaacacuggucc

SEQ ID NO: 58095 - RNA, 18 nt, Artificial Sequence
  Description of Artificial Sequence: Synthetic oligonucleotide
aggcuggguaucaacacu

SEQ ID NO: 58096 - RNA, 18 nt, Artificial Sequence
  Description of Artificial Sequence: Synthetic oligonucleotide
ccaagaggcuggguauca

SEQ ID NO: 58097 - RNA, 18 nt, Artificial Sequence
  Description of Artificial Sequence: Synthetic oligonucleotide
gaacaccaagaggcuggg

SEQ ID NO: 58098 - RNA, 18 nt, Artificial Sequence
  Description of Artificial Sequence: Synthetic oligonucleotide
gggaugaacaccaagagg

SEQ ID NO: 58099 - RNA, 18 nt, Artificial Sequence
  Description of Artificial Sequence: Synthetic oligonucleotide
cuugagggaugaacacca

SEQ ID NO: 58100 - RNA, 18 nt, Artificial Sequence
  Description of Artificial Sequence: Synthetic oligonucleotide
ugcuucuugagggaugaa

SEQ ID NO: 58101 - RNA, 18 nt, Artificial Sequence
  Description of Artificial Sequence: Synthetic oligonucleotide
gccagugcuucuugaggg

SEQ ID NO: 58102 - RNA, 18 nt, Artificial Sequence
  Description of Artificial Sequence: Synthetic oligonucleotide
uuucugccagugcuucuu

SEQ ID NO: 58103 - RNA, 18 nt, Artificial Sequence
  Description of Artificial Sequence: Synthetic oligonucleotide
cuggguuucugccagugc

SEQ ID NO: 58104 - RNA, 18 nt, Artificial Sequence
  Description of Artificial Sequence: Synthetic oligonucleotide
gauuccuggguuucugcc

SEQ ID NO: 58105 - RNA, 18 nt, Artificial Sequence
  Description of Artificial Sequence: Synthetic oligonucleotide
aauuugauuccuggguuu

SEQ ID NO: 58106 - RNA, 18 nt, Artificial Sequence
  Description of Artificial Sequence: Synthetic oligonucleotide
ugcccaauuugauuccug

SEQ ID NO: 58107 - RNA, 18 nt, Artificial Sequence
  Description of Artificial Sequence: Synthetic oligonucleotide
uuuugugcccaauuugau

SEQ ID NO: 58108 - RNA, 18 nt, Artificial Sequence
  Description of Artificial Sequence: Synthetic oligonucleotide
accauuuuugugcccaau

SEQ ID NO: 58109 - RNA, 18 nt, Artificial Sequence
  Description of Artificial Sequence: Synthetic oligonucleotide
uccuuaccauuuuugugc

SEQ ID NO: 58110 - RNA, 18 nt, Artificial Sequence
  Description of Artificial Sequence: Synthetic oligonucleotide
ccauuuccuuaccauuuu

SEQ ID NO: 58111 - RNA, 18 nt, Artificial Sequence
  Description of Artificial Sequence: Synthetic oligonucleotide
cuuugccauuuccuuacc

SEQ ID NO: 58112 - RNA, 18 nt, Artificial Sequence
  Description of Artificial Sequence: Synthetic oligonucleotide
aaauacuuugccauuucc

SEQ ID NO: 58113 - RNA, 18 nt, Artificial Sequence
  Description of Artificial Sequence: Synthetic oligonucleotide
guucuaaauacuuugcca

SEQ ID NO: 58114 - RNA, 18 nt, Artificial Sequence
  Description of Artificial Sequence: Synthetic oligonucleotide
gcgaaguucuaaauacuu

SEQ ID NO: 58115 - RNA, 18 nt, Artificial Sequence
  Description of Artificial Sequence: Synthetic oligonucleotide
agcgggcgaaguucuaaa

SEQ ID NO: 58116 - RNA, 18 nt, Artificial Sequence
  Description of Artificial Sequence: Synthetic oligonucleotide
caauuagcgggcgaaguu

SEQ ID NO: 58117 - RNA, 18 nt, Artificial Sequence
  Description of Artificial Sequence: Synthetic oligonucleotide
aaacacaauuagcgggcg

SEQ ID NO: 58118 - RNA, 18 nt, Artificial Sequence
  Description of Artificial Sequence: Synthetic oligonucleotide
uggagaaacacaauuagc

SEQ ID NO: 58119 - RNA, 18 nt, Artificial Sequence
  Description of Artificial Sequence: Synthetic oligonucleotide
gucccuggagaaacacaa

SEQ ID NO: 58120 - RNA, 18 nt, Artificial Sequence
  Description of Artificial Sequence: Synthetic oligonucleotide
aaacagucccuggagaaa

SEQ ID NO: 58121 - RNA, 18 nt, Artificial Sequence
  Description of Artificial Sequence: Synthetic oligonucleotide
gaggaaaacagucccugg

SEQ ID NO: 58122 - RNA, 18 nt, Artificial Sequence
  Description of Artificial Sequence: Synthetic oligonucleotide
uguuugaggaaaacaguc

SEQ ID NO: 58123 - RNA, 18 nt, Artificial Sequence
  Description of Artificial Sequence: Synthetic oligonucleotide
gaggauguuugaggaaaa

SEQ ID NO: 58124 - RNA, 18 nt, Artificial Sequence
  Description of Artificial Sequence: Synthetic oligonucleotide
uuucagaggauguuugag

SEQ ID NO: 58125 - RNA, 18 nt, Artificial Sequence
  Description of Artificial Sequence: Synthetic oligonucleotide
caggauuucagaggaugu

SEQ ID NO: 58126 - RNA, 18 nt, Artificial Sequence
  Description of Artificial Sequence: Synthetic oligonucleotide
aggaccaggauuucagag

SEQ ID NO: 58127 - RNA, 18 nt, Artificial Sequence
  Description of Artificial Sequence: Synthetic oligonucleotide
gauauaggaccaggauuu

SEQ ID NO: 58128 - RNA, 18 nt, Artificial Sequence
  Description of Artificial Sequence: Synthetic oligonucleotide
cugcugauauaggaccag

SEQ ID NO: 58129 - RNA, 18 nt, Artificial Sequence
  Description of Artificial Sequence: Synthetic oligonucleotide
auucccugcugauauagg

SEQ ID NO: 58130 - RNA, 18 nt, Artificial Sequence
  Description of Artificial Sequence: Synthetic oligonucleotide
gccucauucccugcugau

SEQ ID NO: 58131 - RNA, 18 nt, Artificial Sequence
  Description of Artificial Sequence: Synthetic oligonucleotide
cuguggccucauucccug

SEQ ID NO: 58132 - RNA, 18 nt, Artificial Sequence
  Description of Artificial Sequence: Synthetic oligonucleotide
ucagucuguggccucauu

SEQ ID NO: 58133 - RNA, 18 nt, Artificial Sequence
  Description of Artificial Sequence: Synthetic oligonucleotide
ucucaucagucuguggcc

SEQ ID NO: 58134 - RNA, 18 nt, Artificial Sequence
  Description of Artificial Sequence: Synthetic oligonucleotide
uuuccucucaucagucug

SEQ ID NO: 58135 - RNA, 18 nt, Artificial Sequence
  Description of Artificial Sequence: Synthetic oligonucleotide
uaaaauuuccucucauca

SEQ ID NO: 58136 - RNA, 18 nt, Artificial Sequence
  Description of Artificial Sequence: Synthetic oligonucleotide
uaaaauaaaauuuccucu

SEQ ID NO: 58137 - RNA, 18 nt, Artificial Sequence
  Description of Artificial Sequence: Synthetic oligonucleotide
auagcuaaaauaaaauuu

SEQ ID NO: 58138 - RNA, 18 nt, Artificial Sequence
  Description of Artificial Sequence: Synthetic oligonucleotide
uggaaauagcuaaaauaa

SEQ ID NO: 58139 - RNA, 18 nt, Artificial Sequence
  Description of Artificial Sequence: Synthetic oligonucleotide
aaauguggaaauagcuaa

SEQ ID NO: 58140 - RNA, 18 nt, Artificial Sequence
  Description of Artificial Sequence: Synthetic oligonucleotide
gagaaaaauguggaaaua

SEQ ID NO: 58141 - RNA, 18 nt, Artificial Sequence
  Description of Artificial Sequence: Synthetic oligonucleotide
ugaaugagaaaaaugugg

SEQ ID NO: 58142 - RNA, 18 nt, Artificial Sequence
  Description of Artificial Sequence: Synthetic oligonucleotide
ggaccugaaugagaaaaa

SEQ ID NO: 58143 - RNA, 18 nt, Artificial Sequence
  Description of Artificial Sequence: Synthetic oligonucleotide
uuagaggaccugaaugag

SEQ ID NO: 58144 - RNA, 18 nt, Artificial Sequence
  Description of Artificial Sequence: Synthetic oligonucleotide
ccacauuagaggaccuga

SEQ ID NO: 58145 - RNA, 18 nt, Artificial Sequence
  Description of Artificial Sequence: Synthetic oligonucleotide
acuaaccacauuagagga

SEQ ID NO: 58146 - RNA, 18 nt, Artificial Sequence
  Description of Artificial Sequence: Synthetic oligonucleotide
ccacaacuaaccacauua

SEQ ID NO: 58147 - RNA, 18 nt, Artificial Sequence
  Description of Artificial Sequence: Synthetic oligonucleotide
ucaggccacaacuaacca

SEQ ID NO: 58148 - RNA, 18 nt, Artificial Sequence
  Description of Artificial Sequence: Synthetic oligonucleotide
cauuuucaggccacaacu

SEQ ID NO: 58149 - RNA, 18 nt, Artificial Sequence
  Description of Artificial Sequence: Synthetic oligonucleotide
aauaucauuuucaggcca

SEQ ID NO: 58150 - RNA, 18 nt, Artificial Sequence
  Description of Artificial Sequence: Synthetic oligonucleotide
uuggaaauaucauuuuca

SEQ ID NO: 58151 - RNA, 18 nt, Artificial Sequence
  Description of Artificial Sequence: Synthetic oligonucleotide
uucauuuggaaauaucau

SEQ ID NO: 58152 - RNA, 18 nt, Artificial Sequence
  Description of Artificial Sequence: Synthetic oligonucleotide
uccuauucauuuggaaau

SEQ ID NO: 58153 - RNA, 18 nt, Artificial Sequence
  Description of Artificial Sequence: Synthetic oligonucleotide
uuccuuccuauucauuug

SEQ ID NO: 58154 - RNA, 18 nt, Artificial Sequence
  Description of Artificial Sequence: Synthetic oligonucleotide
uuuccuuccuuccuauuc

SEQ ID NO: 58155 - RNA, 18 nt, Artificial Sequence
  Description of Artificial Sequence: Synthetic oligonucleotide
aacaauuuccuuccuucc

SEQ ID NO: 58156 - RNA, 18 nt, Artificial Sequence
  Description of Artificial Sequence: Synthetic oligonucleotide
acaaaaacaauuuccuuc

SEQ ID NO: 58157 - RNA, 18 nt, Artificial Sequence
  Description of Artificial Sequence: Synthetic oligonucleotide
aaacaacaaaaacaauuu

SEQ ID NO: 58158 - RNA, 18 nt, Artificial Sequence
  Description of Artificial Sequence: Synthetic oligonucleotide
aucuuaaacaacaaaaac

SEQ ID NO: 58159 - RNA, 18 nt, Artificial Sequence
  Description of Artificial Sequence: Synthetic oligonucleotide
cuuccaucuuaaacaaca

SEQ ID NO: 58160 - RNA, 18 nt, Artificial Sequence
  Description of Artificial Sequence: Synthetic oligonucleotide
auuuccuuccaucuuaaa

SEQ ID NO: 58161 - RNA, 18 nt, Artificial Sequence
  Description of Artificial Sequence: Synthetic oligonucleotide
ccuauauuuccuuccauc

SEQ ID NO: 58162 - RNA, 18 nt, Artificial Sequence
  Description of Artificial Sequence: Synthetic oligonucleotide
augcaccuauauuuccuu

SEQ ID NO: 58163 - RNA, 18 nt, Artificial Sequence
  Description of Artificial Sequence: Synthetic oligonucleotide
uuuaaaugcaccuauauu

SEQ ID NO: 58164 - RNA, 18 nt, Artificial Sequence
  Description of Artificial Sequence: Synthetic oligonucleotide
cauuuuuuaaaugcaccu

SEQ ID NO: 58165 - RNA, 18 nt, Artificial Sequence
  Description of Artificial Sequence: Synthetic oligonucleotide
agcuccauuuuuuaaaug

SEQ ID NO: 58166 - RNA, 18 nt, Artificial Sequence
  Description of Artificial Sequence: Synthetic oligonucleotide
aaccaagcuccauuuuuu

SEQ ID NO: 58167 - RNA, 18 nt, Artificial Sequence
  Description of Artificial Sequence: Synthetic oligonucleotide
caugcaaccaagcuccau

SEQ ID NO: 58168 - RNA, 18 nt, Artificial Sequence
  Description of Artificial Sequence: Synthetic oligonucleotide
aaaaucaugcaaccaagc

SEQ ID NO: 58169 - RNA, 18 nt, Artificial Sequence
  Description of Artificial Sequence: Synthetic oligonucleotide
gagcgaaaaucaugcaac

SEQ ID NO: 58170 - RNA, 18 nt, Artificial Sequence
  Description of Artificial Sequence: Synthetic oligonucleotide
cucaagagcgaaaaucau

SEQ ID NO: 58171 - RNA, 18 nt, Artificial Sequence
  Description of Artificial Sequence: Synthetic oligonucleotide
gaugacucaagagcgaaa

SEQ ID NO: 58172 - RNA, 18 nt, Artificial Sequence
  Description of Artificial Sequence: Synthetic oligonucleotide
ggcuagaugacucaagag

SEQ ID NO: 58173 - RNA, 18 nt, Artificial Sequence
  Description of Artificial Sequence: Synthetic oligonucleotide
uagagggcuagaugacuc

SEQ ID NO: 58174 - RNA, 18 nt, Artificial Sequence
  Description of Artificial Sequence: Synthetic oligonucleotide
aucauuagagggcuagau

SEQ ID NO: 58175 - RNA, 18 nt, Artificial Sequence
  Description of Artificial Sequence: Synthetic oligonucleotide
aggcaaucauuagagggc

SEQ ID NO: 58176 - RNA, 18 nt, Artificial Sequence
  Description of Artificial Sequence: Synthetic oligonucleotide
guaugaggcaaucauuag

SEQ ID NO: 58177 - RNA, 18 nt, Artificial Sequence
  Description of Artificial Sequence: Synthetic oligonucleotide
caccgguaugaggcaauc

SEQ ID NO: 58178 - RNA, 18 nt, Artificial Sequence
  Description of Artificial Sequence: Synthetic oligonucleotide
guaaucaccgguaugagg

SEQ ID NO: 58179 - RNA, 18 nt, Artificial Sequence
  Description of Artificial Sequence: Synthetic oligonucleotide
cgcucguaaucaccggua

SEQ ID NO: 58180 - RNA, 18 nt, Artificial Sequence
  Description of Artificial Sequence: Synthetic oligonucleotide
aaagccgcucguaaucac

SEQ ID NO: 58181 - RNA, 18 nt, Artificial Sequence
  Description of Artificial Sequence: Synthetic oligonucleotide
caugaaaagccgcucgua

SEQ ID NO: 58182 - RNA, 18 nt, Artificial Sequence
  Description of Artificial Sequence: Synthetic oligonucleotide
gggucaugaaaagccgcu

SEQ ID NO: 58183 - RNA, 18 nt, Artificial Sequence
  Description of Artificial Sequence: Synthetic oligonucleotide
aaaugguacauauggaag

SEQ ID NO: 58184 - RNA, 18 nt, Artificial Sequence
  Description of Artificial Sequence: Synthetic oligonucleotide
uuuuaaaaugguacauau

SEQ ID NO: 58185 - RNA, 18 nt, Artificial Sequence
  Description of Artificial Sequence: Synthetic oligonucleotide
cagcauuuuaaaauggua

SEQ ID NO: 58186 - RNA, 18 nt, Artificial Sequence
  Description of Artificial Sequence: Synthetic oligonucleotide
guaaucagcauuuuaaaa

SEQ ID NO: 58187 - RNA, 18 nt, Artificial Sequence
  Description of Artificial Sequence: Synthetic oligonucleotide
aagaaguaaucagcauuu

SEQ ID NO: 58188 - RNA, 18 nt, Artificial Sequence
  Description of Artificial Sequence: Synthetic oligonucleotide
uucucaagaaguaaucag

SEQ ID NO: 58189 - RNA, 18 nt, Artificial Sequence
  Description of Artificial Sequence: Synthetic oligonucleotide
ucuuauucucaagaagua

SEQ ID NO: 58190 - RNA, 18 nt, Artificial Sequence
  Description of Artificial Sequence: Synthetic oligonucleotide
gcuucucuuauucucaag

SEQ ID NO: 58191 - RNA, 18 nt, Artificial Sequence
  Description of Artificial Sequence: Synthetic oligonucleotide
auuaggcuucucuuauuc

SEQ ID NO: 58192 - RNA, 18 nt, Artificial Sequence
  Description of Artificial Sequence: Synthetic oligonucleotide
cugaaauuaggcuucucu

SEQ ID NO: 58193 - RNA, 18 nt, Artificial Sequence
  Description of Artificial Sequence: Synthetic oligonucleotide
auauucugaaauuaggcu

SEQ ID NO: 58194 - RNA, 18 nt, Artificial Sequence
  Description of Artificial Sequence: Synthetic oligonucleotide
uaaugauauucugaaauu

SEQ ID NO: 58195 - RNA, 18 nt, Artificial Sequence
  Description of Artificial Sequence: Synthetic oligonucleotide
uacccuaaugauauucug

SEQ ID NO: 58196 - RNA, 18 nt, Artificial Sequence
  Description of Artificial Sequence: Synthetic oligonucleotide
auagguacccuaaugaua

SEQ ID NO: 58197 - RNA, 18 nt, Artificial Sequence
  Description of Artificial Sequence: Synthetic oligonucleotide
cuucaauagguacccuaa

SEQ ID NO: 58198 - RNA, 18 nt, Artificial Sequence
  Description of Artificial Sequence: Synthetic oligonucleotide
caagacuucaauagguac

SEQ ID NO: 58199 - RNA, 18 nt, Artificial Sequence
  Description of Artificial Sequence: Synthetic oligonucleotide
gcagucaagacuucaaua

SEQ ID NO: 58200 - RNA, 18 nt, Artificial Sequence
  Description of Artificial Sequence: Synthetic oligonucleotide
uaugugcagucaagacuu

SEQ ID NO: 58201 - RNA, 18 nt, Artificial Sequence
  Description of Artificial Sequence: Synthetic oligonucleotide
cuaaauaugugcagucaa

SEQ ID NO: 58202 - RNA, 18 nt, Artificial Sequence
  Description of Artificial Sequence: Synthetic oligonucleotide
guaugcuaaauaugugca

SEQ ID NO: 58203 - RNA, 18 nt, Artificial Sequence
  Description of Artificial Sequence: Synthetic oligonucleotide
agggaguaugcuaaauau

SEQ ID NO: 58204 - RNA, 18 nt, Artificial Sequence
  Description of Artificial Sequence: Synthetic oligonucleotide
uucccagggaguaugcua

SEQ ID NO: 58205 - RNA, 18 nt, Artificial Sequence
  Description of Artificial Sequence: Synthetic oligonucleotide
uauaauucccagggagua

SEQ ID NO: 58206 - RNA, 18 nt, Artificial Sequence
  Description of Artificial Sequence: Synthetic oligonucleotide
uaaaauauaauucccagg

SEQ ID NO: 58207 - RNA, 18 nt, Artificial Sequence
  Description of Artificial Sequence: Synthetic oligonucleotide
guccuuaaaauauaauuc

SEQ ID NO: 58208 - RNA, 18 nt, Artificial Sequence
  Description of Artificial Sequence: Synthetic oligonucleotide
aaaauguccuuaaaauau

SEQ ID NO: 58209 - RNA, 18 nt, Artificial Sequence
  Description of Artificial Sequence: Synthetic oligonucleotide
auagaaaaauguccuuaa

SEQ ID NO: 58210 - RNA, 18 nt, Artificial Sequence
  Description of Artificial Sequence: Synthetic oligonucleotide
auuuaauagaaaaauguc

SEQ ID NO: 58211 - RNA, 18 nt, Artificial Sequence
  Description of Artificial Sequence: Synthetic oligonucleotide
caaugauuuaauagaaaa

SEQ ID NO: 58212 - RNA, 18 nt, Artificial Sequence
  Description of Artificial Sequence: Synthetic oligonucleotide
auaugcaaugauuuaaua

SEQ ID NO: 58213 - RNA, 18 nt, Artificial Sequence
  Description of Artificial Sequence: Synthetic oligonucleotide
cuuccauaugcaaugauu

SEQ ID NO: 58214 - RNA, 18 nt, Artificial Sequence
  Description of Artificial Sequence: Synthetic oligonucleotide
aguuucuuccauaugcaa

SEQ ID NO: 58215 - RNA, 18 nt, Artificial Sequence
  Description of Artificial Sequence: Synthetic oligonucleotide
uauugaguuucuuccaua

SEQ ID NO: 58216 - RNA, 18 nt, Artificial Sequence
  Description of Artificial Sequence: Synthetic oligonucleotide
uauuauauugaguuucuu

SEQ ID NO: 58217 - RNA, 18 nt, Artificial Sequence
  Description of Artificial Sequence: Synthetic oligonucleotide
ucagcuauuauauugagu

SEQ ID NO: 58218 - RNA, 18 nt, Artificial Sequence
  Description of Artificial Sequence: Synthetic oligonucleotide
aaauaucagcuauuauau

SEQ ID NO: 58219 - RNA, 18 nt, Artificial Sequence
  Description of Artificial Sequence: Synthetic oligonucleotide
caaguaaauaucagcuau

SEQ ID NO: 58220 - RNA, 18 nt, Artificial Sequence
  Description of Artificial Sequence: Synthetic oligonucleotide
gaacccaaguaaauauca

SEQ ID NO: 58221 - RNA, 18 nt, Artificial Sequence
  Description of Artificial Sequence: Synthetic oligonucleotide
auuaagaacccaaguaaa

SEQ ID NO: 58222 - RNA, 18 nt, Artificial Sequence
  Description of Artificial Sequence: Synthetic oligonucleotide
uucugauuaagaacccaa

SEQ ID NO: 58223 - RNA, 18 nt, Artificial Sequence
  Description of Artificial Sequence: Synthetic oligonucleotide
caauguucugauuaagaa

SEQ ID NO: 58224 - RNA, 18 nt, Artificial Sequence
  Description of Artificial Sequence: Synthetic oligonucleotide
acagccaauguucugauu

SEQ ID NO: 58225 - RNA, 18 nt, Artificial Sequence
  Description of Artificial Sequence: Synthetic oligonucleotide
aucacacagccaauguuc

SEQ ID NO: 58226 - RNA, 18 nt, Artificial Sequence
  Description of Artificial Sequence: Synthetic oligonucleotide
ugaaaaucacacagccaa

SEQ ID NO: 58227 - RNA, 18 nt, Artificial Sequence
  Description of Artificial Sequence: Synthetic oligonucleotide
aaucaugaaaaucacaca

SEQ ID NO: 58228 - RNA, 18 nt, Artificial Sequence
  Description of Artificial Sequence: Synthetic oligonucleotide
aucauaaucaugaaaauc

SEQ ID NO: 58229 - RNA, 18 nt, Artificial Sequence
  Description of Artificial Sequence: Synthetic oligonucleotide
ugaaaaucauaaucauga

SEQ ID NO: 58230 - RNA, 18 nt, Artificial Sequence
  Description of Artificial Sequence: Synthetic oligonucleotide
ugcaaugaaaaucauaau

SEQ ID NO: 58231 - RNA, 18 nt, Artificial Sequence
  Description of Artificial Sequence: Synthetic oligonucleotide
uuaauugcaaugaaaauc

SEQ ID NO: 58232 - RNA, 18 nt, Artificial Sequence
  Description of Artificial Sequence: Synthetic oligonucleotide
ucaacuuaauugcaauga

SEQ ID NO: 58233 - RNA, 18 nt, Artificial Sequence
  Description of Artificial Sequence: Synthetic oligonucleotide
aaacaucaacuuaauugc

SEQ ID NO: 58234 - RNA, 18 nt, Artificial Sequence
  Description of Artificial Sequence: Synthetic oligonucleotide
cuacaaaacaucaacuua

SEQ ID NO: 58235 - RNA, 18 nt, Artificial Sequence
  Description of Artificial Sequence: Synthetic oligonucleotide
acugucuacaaaacauca

SEQ ID NO: 58236 - RNA, 18 nt, Artificial Sequence
  Description of Artificial Sequence: Synthetic oligonucleotide
auuucacugucuacaaaa

SEQ ID NO: 58237 - RNA, 18 nt, Artificial Sequence
  Description of Artificial Sequence: Synthetic oligonucleotide
ugguaauuucacugucua

SEQ ID NO: 58238 - RNA, 18 nt, Artificial Sequence
  Description of Artificial Sequence: Synthetic oligonucleotide
guagaugguaauuucacu

SEQ ID NO: 58239 - RNA, 18 nt, Artificial Sequence
  Description of Artificial Sequence: Synthetic oligonucleotide
uuggaguagaugguaauu

SEQ ID NO: 58240 - RNA, 18 nt, Artificial Sequence
  Description of Artificial Sequence: Synthetic oligonucleotide
aucuuuuggaguagaugg

SEQ ID NO: 58241 - RNA, 18 nt, Artificial Sequence
  Description of Artificial Sequence: Synthetic oligonucleotide
uugcaaucuuuuggagua

SEQ ID NO: 58242 - RNA, 18 nt, Artificial Sequence
  Description of Artificial Sequence: Synthetic oligonucleotide
cuauuuugcaaucuuuug

SEQ ID NO: 58243 - RNA, 18 nt, Artificial Sequence
  Description of Artificial Sequence: Synthetic oligonucleotide
aaauucuauuuugcaauc

SEQ ID NO: 58244 - RNA, 18 nt, Artificial Sequence
  Description of Artificial Sequence: Synthetic oligonucleotide
agguuaaauucuauuuug

SEQ ID NO: 58245 - RNA, 18 nt, Artificial Sequence
  Description of Artificial Sequence: Synthetic oligonucleotide
cucuaagguuaaauucua

SEQ ID NO: 58246 - RNA, 18 nt, Artificial Sequence
  Description of Artificial Sequence: Synthetic oligonucleotide
auuggcucuaagguuaaa

SEQ ID NO: 58247 - RNA, 18 nt, Artificial Sequence
  Description of Artificial Sequence: Synthetic oligonucleotide
ccugcauuggcucuaagg

SEQ ID NO: 58248 - RNA, 18 nt, Artificial Sequence
  Description of Artificial Sequence: Synthetic oligonucleotide
uuuucccugcauuggcuc

SEQ ID NO: 58249 - RNA, 18 nt, Artificial Sequence
  Description of Artificial Sequence: Synthetic oligonucleotide
acaaguuuucccugcauu

SEQ ID NO: 58250 - RNA, 18 nt, Artificial Sequence
  Description of Artificial Sequence: Synthetic oligonucleotide
cagaaacaaguuuucccu

SEQ ID NO: 58251 - RNA, 18 nt, Artificial Sequence
  Description of Artificial Sequence: Synthetic oligonucleotide
accugcagaaacaaguuu

SEQ ID NO: 58252 - RNA, 18 nt, Artificial Sequence
  Description of Artificial Sequence: Synthetic oligonucleotide
aaugcaccugcagaaaca

SEQ ID NO: 58253 - RNA, 18 nt, Artificial Sequence
  Description of Artificial Sequence: Synthetic oligonucleotide
caaaaaaugcaccugcag

SEQ ID NO: 58254 - RNA, 18 nt, Artificial Sequence
  Description of Artificial Sequence: Synthetic oligonucleotide
aguuucaaaaaaugcacc

SEQ ID NO: 58255 - RNA, 18 nt, Artificial Sequence
  Description of Artificial Sequence: Synthetic oligonucleotide
guugaaguuucaaaaaau

SEQ ID NO: 58256 - RNA, 18 nt, Artificial Sequence
  Description of Artificial Sequence: Synthetic oligonucleotide
uaucuguugaaguuucaa

SEQ ID NO: 58257 - RNA, 18 nt, Artificial Sequence
  Description of Artificial Sequence: Synthetic oligonucleotide
ccugcuaucuguugaagu

SEQ ID NO: 58258 - RNA, 18 nt, Artificial Sequence
  Description of Artificial Sequence: Synthetic oligonucleotide
uucccccugcuaucuguu

SEQ ID NO: 58259 - RNA, 18 nt, Artificial Sequence
  Description of Artificial Sequence: Synthetic oligonucleotide
uuuuuuucccccugcuau

SEQ ID NO: 58260 - RNA, 18 nt, Artificial Sequence
  Description of Artificial Sequence: Synthetic oligonucleotide
ucacuuuuuuuucccccu

SEQ ID NO: 58261 - RNA, 18 nt, Artificial Sequence
  Description of Artificial Sequence: Synthetic oligonucleotide
uucugucacuuuuuuuuc

SEQ ID NO: 58262 - RNA, 18 nt, Artificial Sequence
  Description of Artificial Sequence: Synthetic oligonucleotide
gauccuucugucacuuuu

SEQ ID NO: 58263 - RNA, 18 nt, Artificial Sequence
  Description of Artificial Sequence: Synthetic oligonucleotide
acugugauccuucuguca

SEQ ID NO: 58264 - RNA, 18 nt, Artificial Sequence
  Description of Artificial Sequence: Synthetic oligonucleotide
gcugaacugugauccuuc

SEQ ID NO: 58265 - RNA, 18 nt, Artificial Sequence
  Description of Artificial Sequence: Synthetic oligonucleotide
auacugcugaacugugau

SEQ ID NO: 58266 - RNA, 18 nt, Artificial Sequence
  Description of Artificial Sequence: Synthetic oligonucleotide
aauucauacugcugaacu

SEQ ID NO: 58267 - RNA, 18 nt, Artificial Sequence
  Description of Artificial Sequence: Synthetic oligonucleotide
cagacaauucauacugcu

SEQ ID NO: 58268 - RNA, 18 nt, Artificial Sequence
  Description of Artificial Sequence: Synthetic oligonucleotide
gccagcagacaauucaua

SEQ ID NO: 58269 - RNA, 18 nt, Artificial Sequence
  Description of Artificial Sequence: Synthetic oligonucleotide
aggcugccagcagacaau

SEQ ID NO: 58270 - RNA, 18 nt, Artificial Sequence
  Description of Artificial Sequence: Synthetic oligonucleotide
uugcaaggcugccagcag

SEQ ID NO: 58271 - RNA, 18 nt, Artificial Sequence
  Description of Artificial Sequence: Synthetic oligonucleotide
ccagauugcaaggcugcc

SEQ ID NO: 58272 - RNA, 18 nt, Artificial Sequence
  Description of Artificial Sequence: Synthetic oligonucleotide
gcacaccagauugcaagg

SEQ ID NO: 58273 - RNA, 18 nt, Artificial Sequence
  Description of Artificial Sequence: Synthetic oligonucleotide
ugccugcacaccagauug

SEQ ID NO: 58274 - RNA, 18 nt, Artificial Sequence
  Description of Artificial Sequence: Synthetic oligonucleotide
cucacugccugcacacca

SEQ ID NO: 58275 - RNA, 18 nt, Artificial Sequence
  Description of Artificial Sequence: Synthetic oligonucleotide
acaaucucacugccugca

SEQ ID NO: 58276 - RNA, 18 nt, Artificial Sequence
  Description of Artificial Sequence: Synthetic oligonucleotide
acaccacaaucucacugc

SEQ ID NO: 58277 - RNA, 18 nt, Artificial Sequence
  Description of Artificial Sequence: Synthetic oligonucleotide
cauguacaccacaaucuc

SEQ ID NO: 58278 - RNA, 18 nt, Artificial Sequence
  Description of Artificial Sequence: Synthetic oligonucleotide
ggugacauguacaccaca

SEQ ID NO: 58279 - RNA, 18 nt, Artificial Sequence
  Description of Artificial Sequence: Synthetic oligonucleotide
aaucaggugacauguaca

SEQ ID NO: 58280 - RNA, 18 nt, Artificial Sequence
  Description of Artificial Sequence: Synthetic oligonucleotide
uguaguccugguggcaug

SEQ ID NO: 58281 - RNA, 18 nt, Artificial Sequence
  Description of Artificial Sequence: Synthetic oligonucleotide
gccccuguaguccuggug

SEQ ID NO: 58282 - RNA, 18 nt, Artificial Sequence
  Description of Artificial Sequence: Synthetic oligonucleotide
acucugccccuguagucc

SEQ ID NO: 58283 - RNA, 18 nt, Artificial Sequence
  Description of Artificial Sequence: Synthetic oligonucleotide
gagacacucugccccugu

SEQ ID NO: 58284 - RNA, 18 nt, Artificial Sequence
  Description of Artificial Sequence: Synthetic oligonucleotide
cagaggagacacucugcc

SEQ ID NO: 58285 - RNA, 18 nt, Artificial Sequence
  Description of Artificial Sequence: Synthetic oligonucleotide
gcugccagaggagacacu

SEQ ID NO: 58286 - RNA, 18 nt, Artificial Sequence
  Description of Artificial Sequence: Synthetic oligonucleotide
ucagagcugccagaggag

SEQ ID NO: 58287 - RNA, 18 nt, Artificial Sequence
  Description of Artificial Sequence: Synthetic oligonucleotide
ugaucucagagcugccag

SEQ ID NO: 58288 - RNA, 18 nt, Artificial Sequence
  Description of Artificial Sequence: Synthetic oligonucleotide
ggauuugaucucagagcu

SEQ ID NO: 58289 - RNA, 18 nt, Artificial Sequence
  Description of Artificial Sequence: Synthetic oligonucleotide
ucaucggauuugaucuca

SEQ ID NO: 58290 - RNA, 18 nt, Artificial Sequence
  Description of Artificial Sequence: Synthetic oligonucleotide
ccucgucaucggauuuga

SEQ ID NO: 58291 - RNA, 18 nt, Artificial Sequence
  Description of Artificial Sequence: Synthetic oligonucleotide
aucacccucgucaucgga

SEQ ID NO: 58292 - RNA, 18 nt, Artificial Sequence
  Description of Artificial Sequence: Synthetic oligonucleotide
uucucaucacccucguca

SEQ ID NO: 58293 - RNA, 18 nt, Artificial Sequence
  Description of Artificial Sequence: Synthetic oligonucleotide
gcagguucucaucacccu

SEQ ID NO: 58294 - RNA, 18 nt, Artificial Sequence
  Description of Artificial Sequence: Synthetic oligonucleotide
gucuugcagguucucauc

SEQ ID NO: 58295 - RNA, 18 nt, Artificial Sequence
  Description of Artificial Sequence: Synthetic oligonucleotide
uucgugucuugcagguuc

SEQ ID NO: 58296 - RNA, 18 nt, Artificial Sequence
  Description of Artificial Sequence: Synthetic oligonucleotide
aagauuucgugucuugca

SEQ ID NO: 58297 - RNA, 18 nt, Artificial Sequence
  Description of Artificial Sequence: Synthetic oligonucleotide
cuccgaagauuucguguc

SEQ ID NO: 58298 - RNA, 18 nt, Artificial Sequence
  Description of Artificial Sequence: Synthetic oligonucleotide
uuguccuccgaagauuuc

SEQ ID NO: 58299 - RNA, 18 nt, Artificial Sequence
  Description of Artificial Sequence: Synthetic oligonucleotide
auuucuuguccuccgaag

SEQ ID NO: 58300 - RNA, 18 nt, Artificial Sequence
  Description of Artificial Sequence: Synthetic oligonucleotide
aucuaauuucuuguccuc

SEQ ID NO: 58301 - RNA, 18 nt, Artificial Sequence
  Description of Artificial Sequence: Synthetic oligonucleotide
ucgucaucuaauuucuug

SEQ ID NO: 58302 - RNA, 18 nt, Artificial Sequence
  Description of Artificial Sequence: Synthetic oligonucleotide
ucuugucgucaucuaauu

SEQ ID NO: 58303 - RNA, 18 nt, Artificial Sequence
  Description of Artificial Sequence: Synthetic oligonucleotide
auccuucuugucgucauc

SEQ ID NO: 58304 - RNA, 18 nt, Artificial Sequence
  Description of Artificial Sequence: Synthetic oligonucleotide
uugauauccuucuugucg

SEQ ID NO: 58305 - RNA, 18 nt, Artificial Sequence
  Description of Artificial Sequence: Synthetic oligonucleotide
uugauuugauauccuucu

SEQ ID NO: 58306 - RNA, 18 nt, Artificial Sequence
  Description of Artificial Sequence: Synthetic oligonucleotide
aguaauugauuugauauc

SEQ ID NO: 58307 - RNA, 18 nt, Artificial Sequence
  Description of Artificial Sequence: Synthetic oligonucleotide
gaccuaguaauugauuug

SEQ ID NO: 58308 - RNA, 18 nt, Artificial Sequence
  Description of Artificial Sequence: Synthetic oligonucleotide
aucuugaccuaguaauug

SEQ ID NO: 58309 - RNA, 18 nt, Artificial Sequence
  Description of Artificial Sequence: Synthetic oligonucleotide
uucacgauggguccccac

SEQ ID NO: 58310 - RNA, 18 nt, Artificial Sequence
  Description of Artificial Sequence: Synthetic oligonucleotide
ccaucuucacgauggguc

SEQ ID NO: 58311 - RNA, 18 nt, Artificial Sequence
  Description of Artificial Sequence: Synthetic oligonucleotide
ccacgccaucuucacgau

SEQ ID NO: 58312 - RNA, 18 nt, Artificial Sequence
  Description of Artificial Sequence: Synthetic oligonucleotide
cagggccacgccaucuuc

SEQ ID NO: 58313 - RNA, 18 nt, Artificial Sequence
  Description of Artificial Sequence: Synthetic oligonucleotide
ccucucagggccacgcca

SEQ ID NO: 58314 - RNA, 18 nt, Artificial Sequence
  Description of Artificial Sequence: Synthetic oligonucleotide
ggcugccucucagggcca

SEQ ID NO: 58315 - RNA, 18 nt, Artificial Sequence
  Description of Artificial Sequence: Synthetic oligonucleotide
agaauggcugccucucag

SEQ ID NO: 58316 - RNA, 18 nt, Artificial Sequence
  Description of Artificial Sequence: Synthetic oligonucleotide
agaagagaauggcugccu

SEQ ID NO: 58317 - RNA, 18 nt, Artificial Sequence
  Description of Artificial Sequence: Synthetic oligonucleotide
uuggcagaagagaauggc

SEQ ID NO: 58318 - RNA, 18 nt, Artificial Sequence
  Description of Artificial Sequence: Synthetic oligonucleotide
cugguuuggcagaagaga

SEQ ID NO: 58319 - RNA, 18 nt, Artificial Sequence
  Description of Artificial Sequence: Synthetic oligonucleotide
ggaaccugguuuggcaga

SEQ ID NO: 58320 - RNA, 18 nt, Artificial Sequence
  Description of Artificial Sequence: Synthetic oligonucleotide
gaaccggaaccugguuug

SEQ ID NO: 58321 - RNA, 18 nt, Artificial Sequence
  Description of Artificial Sequence: Synthetic oligonucleotide
cuguggaaccggaaccug

SEQ ID NO: 58322 - RNA, 18 nt, Artificial Sequence
  Description of Artificial Sequence: Synthetic oligonucleotide
ggaagcuguggaaccgga

SEQ ID NO: 58323 - RNA, 18 nt, Artificial Sequence
  Description of Artificial Sequence: Synthetic oligonucleotide
ggacaggaagcuguggaa

SEQ ID NO: 58324 - RNA, 18 nt, Artificial Sequence
  Description of Artificial Sequence: Synthetic oligonucleotide
agacuggacaggaagcug

SEQ ID NO: 58325 - RNA, 18 nt, Artificial Sequence
  Description of Artificial Sequence: Synthetic oligonucleotide
gucgcagacuggacagga

SEQ ID NO: 58326 - RNA, 18 nt, Artificial Sequence
  Description of Artificial Sequence: Synthetic oligonucleotide
gggaagucgcagacugga

SEQ ID NO: 58327 - RNA, 18 nt, Artificial Sequence
  Description of Artificial Sequence: Synthetic oligonucleotide
gguggguucaggucaggg

SEQ ID NO: 58328 - RNA, 18 nt, Artificial Sequence
  Description of Artificial Sequence: Synthetic oligonucleotide
ggguggguucaggucagg

SEQ ID NO: 58329 - RNA, 18 nt, Artificial Sequence
  Description of Artificial Sequence: Synthetic oligonucleotide
cucuguaaggguccuggg

SEQ ID NO: 58330 - RNA, 18 nt, Artificial Sequence
  Description of Artificial Sequence: Synthetic oligonucleotide
gugcccuggugaggccaa

SEQ ID NO: 58331 - RNA, 18 nt, Artificial Sequence
  Description of Artificial Sequence: Synthetic oligonucleotide
cagaagugcccuggugag

SEQ ID NO: 58332 - RNA, 18 nt, Artificial Sequence
  Description of Artificial Sequence: Synthetic oligonucleotide
gaggucagaagugcccug

SEQ ID NO: 58333 - RNA, 18 nt, Artificial Sequence
  Description of Artificial Sequence: Synthetic oligonucleotide
aaagugaggucagaagug

SEQ ID NO: 58334 - RNA, 18 nt, Artificial Sequence
  Description of Artificial Sequence: Synthetic oligonucleotide
uugugaaagugaggucag

SEQ ID NO: 58335 - RNA, 18 nt, Artificial Sequence
  Description of Artificial Sequence: Synthetic oligonucleotide
uccuauugugaaagugag

SEQ ID NO: 58336 - RNA, 18 nt, Artificial Sequence
  Description of Artificial Sequence: Synthetic oligonucleotide
acugguccuauugugaaa

SEQ ID NO: 58337 - RNA, 18 nt, Artificial Sequence
  Description of Artificial Sequence: Synthetic oligonucleotide
ucaacacugguccuauug

SEQ ID NO: 58338 - RNA, 18 nt, Artificial Sequence
  Description of Artificial Sequence: Synthetic oligonucleotide
ggguaucaacacuggucc

SEQ ID NO: 58339 - RNA, 18 nt, Artificial Sequence
  Description of Artificial Sequence: Synthetic oligonucleotide
aggcuggguaucaacacu

SEQ ID NO: 58340 - RNA, 18 nt, Artificial Sequence
  Description of Artificial Sequence: Synthetic oligonucleotide
ccaagaggcuggguauca

SEQ ID NO: 58341 - RNA, 18 nt, Artificial Sequence
  Description of Artificial Sequence: Synthetic oligonucleotide
gaacaccaagaggcuggg

SEQ ID NO: 58342 - RNA, 18 nt, Artificial Sequence
  Description of Artificial Sequence: Synthetic oligonucleotide
gggaugaacaccaagagg

SEQ ID NO: 58343 - RNA, 18 nt, Artificial Sequence
  Description of Artificial Sequence: Synthetic oligonucleotide
cuugagggaugaacacca

SEQ ID NO: 58344 - RNA, 18 nt, Artificial Sequence
  Description of Artificial Sequence: Synthetic oligonucleotide
ugcuucuugagggaugaa

SEQ ID NO: 58345 - RNA, 18 nt, Artificial Sequence
  Description of Artificial Sequence: Synthetic oligonucleotide
gccagugcuucuugaggg

SEQ ID NO: 58346 - RNA, 18 nt, Artificial Sequence
  Description of Artificial Sequence: Synthetic oligonucleotide
uuucugccagugcuucuu

SEQ ID NO: 58347 - RNA, 18 nt, Artificial Sequence
  Description of Artificial Sequence: Synthetic oligonucleotide
cuggguuucugccagugc

SEQ ID NO: 58348 - RNA, 18 nt, Artificial Sequence
  Description of Artificial Sequence: Synthetic oligonucleotide
gauuccuggguuucugcc

SEQ ID NO: 58349 - RNA, 18 nt, Artificial Sequence
  Description of Artificial Sequence: Synthetic oligonucleotide
aauuugauuccuggguuu

SEQ ID NO: 58350 - RNA, 18 nt, Artificial Sequence
  Description of Artificial Sequence: Synthetic oligonucleotide
ugcccaauuugauuccug

SEQ ID NO: 58351 - RNA, 18 nt, Artificial Sequence
  Description of Artificial Sequence: Synthetic oligonucleotide
uuuugugcccaauuugau

SEQ ID NO: 58352 - RNA, 18 nt, Artificial Sequence
  Description of Artificial Sequence: Synthetic oligonucleotide
accauuuuugugcccaau

SEQ ID NO: 58353 - RNA, 18 nt, Artificial Sequence
  Description of Artificial Sequence: Synthetic oligonucleotide
uccuuaccauuuuugugc

SEQ ID NO: 58354 - RNA, 18 nt, Artificial Sequence
  Description of Artificial Sequence: Synthetic oligonucleotide
ccauuuccuuaccauuuu

SEQ ID NO: 58355 - RNA, 18 nt, Artificial Sequence
  Description of Artificial Sequence: Synthetic oligonucleotide
cuuugccauuuccuuacc

SEQ ID NO: 58356 - RNA, 18 nt, Artificial Sequence
  Description of Artificial Sequence: Synthetic oligonucleotide
aaauacuuugccauuucc

SEQ ID NO: 58357 - RNA, 18 nt, Artificial Sequence
  Description of Artificial Sequence: Synthetic oligonucleotide
guucuaaauacuuugcca

SEQ ID NO: 58358 - RNA, 18 nt, Artificial Sequence
  Description of Artificial Sequence: Synthetic oligonucleotide
gcgaaguucuaaauacuu

SEQ ID NO: 58359 - RNA, 18 nt, Artificial Sequence
  Description of Artificial Sequence: Synthetic oligonucleotide
agcgggcgaaguucuaaa

SEQ ID NO: 58360 - RNA, 18 nt, Artificial Sequence
  Description of Artificial Sequence: Synthetic oligonucleotide
caauuagcgggcgaaguu

SEQ ID NO: 58361 - RNA, 18 nt, Artificial Sequence
  Description of Artificial Sequence: Synthetic oligonucleotide
aaacacaauuagcgggcg

SEQ ID NO: 58362 - RNA, 18 nt, Artificial Sequence
  Description of Artificial Sequence: Synthetic oligonucleotide
uggagaaacacaauuagc

SEQ ID NO: 58363 - RNA, 18 nt, Artificial Sequence
  Description of Artificial Sequence: Synthetic oligonucleotide
gucccuggagaaacacaa

SEQ ID NO: 58364 - RNA, 18 nt, Artificial Sequence
  Description of Artificial Sequence: Synthetic oligonucleotide
aaacagucccuggagaaa

SEQ ID NO: 58365 - RNA, 18 nt, Artificial Sequence
  Description of Artificial Sequence: Synthetic oligonucleotide
gaggaaaacagucccugg

SEQ ID NO: 58366 - RNA, 18 nt, Artificial Sequence
  Description of Artificial Sequence: Synthetic oligonucleotide
uguuugaggaaaacaguc

SEQ ID NO: 58367 - RNA, 18 nt, Artificial Sequence
  Description of Artificial Sequence: Synthetic oligonucleotide
gaggauguuugaggaaaa

SEQ ID NO: 58368 - RNA, 18 nt, Artificial Sequence
  Description of Artificial Sequence: Synthetic oligonucleotide
uuucagaggauguuugag

SEQ ID NO: 58369 - RNA, 18 nt, Artificial Sequence
  Description of Artificial Sequence: Synthetic oligonucleotide
caggauuucagaggaugu

SEQ ID NO: 58370 - RNA, 18 nt, Artificial Sequence
  Description of Artificial Sequence: Synthetic oligonucleotide
aggaccaggauuucagag

SEQ ID NO: 58371 - RNA, 18 nt, Artificial Sequence
  Description of Artificial Sequence: Synthetic oligonucleotide
gauauaggaccaggauuu

SEQ ID NO: 58372 - RNA, 18 nt, Artificial Sequence
  Description of Artificial Sequence: Synthetic oligonucleotide
cugcugauauaggaccag

SEQ ID NO: 58373 - RNA, 18 nt, Artificial Sequence
  Description of Artificial Sequence: Synthetic oligonucleotide
auucccugcugauauagg

SEQ ID NO: 58374 - RNA, 18 nt, Artificial Sequence
  Description of Artificial Sequence: Synthetic oligonucleotide
gccucauucccugcugau

SEQ ID NO: 58375 - RNA, 18 nt, Artificial Sequence
  Description of Artificial Sequence: Synthetic oligonucleotide
cuguggccucauucccug

SEQ ID NO: 58376 - RNA, 18 nt, Artificial Sequence
  Description of Artificial Sequence: Synthetic oligonucleotide
ucagucuguggccucauu

SEQ ID NO: 58377 - RNA, 18 nt, Artificial Sequence
  Description of Artificial Sequence: Synthetic oligonucleotide
ucucaucagucuguggcc

SEQ ID NO: 58378 - RNA, 18 nt, Artificial Sequence
  Description of Artificial Sequence: Synthetic oligonucleotide
uuuccucucaucagucug

SEQ ID NO: 58379 - RNA, 18 nt, Artificial Sequence
  Description of Artificial Sequence: Synthetic oligonucleotide
uaaaauuuccucucauca

SEQ ID NO: 58380 - RNA, 18 nt, Artificial Sequence
  Description of Artificial Sequence: Synthetic oligonucleotide
uaaaauaaaauuuccucu

SEQ ID NO: 58381 - RNA, 18 nt, Artificial Sequence
  Description of Artificial Sequence: Synthetic oligonucleotide
auagcuaaaauaaaauuu

SEQ ID NO: 58382 - RNA, 18 nt, Artificial Sequence
  Description of Artificial Sequence: Synthetic oligonucleotide
uggaaauagcuaaaauaa

SEQ ID NO: 58383 - RNA, 18 nt, Artificial Sequence
  Description of Artificial Sequence: Synthetic oligonucleotide
aaauguggaaauagcuaa

SEQ ID NO: 58384 - RNA, 18 nt, Artificial Sequence
  Description of Artificial Sequence: Synthetic oligonucleotide
gagaaaaauguggaaaua

SEQ ID NO: 58385 - RNA, 18 nt, Artificial Sequence
  Description of Artificial Sequence: Synthetic oligonucleotide
ugaaugagaaaaaugugg

SEQ ID NO: 58386 - RNA, 18 nt, Artificial Sequence
  Description of Artificial Sequence: Synthetic oligonucleotide
ggaccugaaugagaaaaa

SEQ ID NO: 58387 - RNA, 18 nt, Artificial Sequence
  Description of Artificial Sequence: Synthetic oligonucleotide
uuagaggaccugaaugag

SEQ ID NO: 58388 - RNA, 18 nt, Artificial Sequence
  Description of Artificial Sequence: Synthetic oligonucleotide
ccacauuagaggaccuga

SEQ ID NO: 58389 - RNA, 18 nt, Artificial Sequence
  Description of Artificial Sequence: Synthetic oligonucleotide
acuaaccacauuagagga

SEQ ID NO: 58390 - RNA, 18 nt, Artificial Sequence
  Description of Artificial Sequence: Synthetic oligonucleotide
ccacaacuaaccacauua

SEQ ID NO: 58391 - RNA, 18 nt, Artificial Sequence
  Description of Artificial Sequence: Synthetic oligonucleotide
ucaggccacaacuaacca

SEQ ID NO: 58392 - RNA, 18 nt, Artificial Sequence
  Description of Artificial Sequence: Synthetic oligonucleotide
cauuuucaggccacaacu

SEQ ID NO: 58393 - RNA, 18 nt, Artificial Sequence
  Description of Artificial Sequence: Synthetic oligonucleotide
aauaucauuuucaggcca

SEQ ID NO: 58394 - RNA, 18 nt, Artificial Sequence
  Description of Artificial Sequence: Synthetic oligonucleotide
uuggaaauaucauuuuca

SEQ ID NO: 58395 - RNA, 18 nt, Artificial Sequence
  Description of Artificial Sequence: Synthetic oligonucleotide
uucauuuggaaauaucau

SEQ ID NO: 58396 - RNA, 18 nt, Artificial Sequence
  Description of Artificial Sequence: Synthetic oligonucleotide
uccuauucauuuggaaau

SEQ ID NO: 58397 - RNA, 18 nt, Artificial Sequence
  Description of Artificial Sequence: Synthetic oligonucleotide
uuccuuccuauucauuug

SEQ ID NO: 58398 - RNA, 18 nt, Artificial Sequence
  Description of Artificial Sequence: Synthetic oligonucleotide
uuuccuuccuuccuauuc

SEQ ID NO: 58399 - RNA, 18 nt, Artificial Sequence
  Description of Artificial Sequence: Synthetic oligonucleotide
aacaauuuccuuccuucc

SEQ ID NO: 58400 - RNA, 18 nt, Artificial Sequence
  Description of Artificial Sequence: Synthetic oligonucleotide
acaaaaacaauuuccuuc

SEQ ID NO: 58401 - RNA, 18 nt, Artificial Sequence
  Description of Artificial Sequence: Synthetic oligonucleotide
aaacaacaaaaacaauuu

SEQ ID NO: 58402 - RNA, 18 nt, Artificial Sequence
  Description of Artificial Sequence: Synthetic oligonucleotide
aucuuaaacaacaaaaac

SEQ ID NO: 58403 - RNA, 18 nt, Artificial Sequence
  Description of Artificial Sequence: Synthetic oligonucleotide
cuuccaucuuaaacaaca

SEQ ID NO: 58404 - RNA, 18 nt, Artificial Sequence
  Description of Artificial Sequence: Synthetic oligonucleotide
auuuccuuccaucuuaaa

SEQ ID NO: 58405 - RNA, 18 nt, Artificial Sequence
  Description of Artificial Sequence: Synthetic oligonucleotide
ccuauauuuccuuccauc

SEQ ID NO: 58406 - RNA, 18 nt, Artificial Sequence
  Description of Artificial Sequence: Synthetic oligonucleotide
augcaccuauauuuccuu

SEQ ID NO: 58407 - RNA, 18 nt, Artificial Sequence
  Description of Artificial Sequence: Synthetic oligonucleotide
uuuaaaugcaccuauauu

SEQ ID NO: 58408 - RNA, 18 nt, Artificial Sequence
  Description of Artificial Sequence: Synthetic oligonucleotide
cauuuuuuaaaugcaccu

SEQ ID NO: 58409 - RNA, 18 nt, Artificial Sequence
  Description of Artificial Sequence: Synthetic oligonucleotide
agcuccauuuuuuaaaug

SEQ ID NO: 58410 - RNA, 18 nt, Artificial Sequence
  Description of Artificial Sequence: Synthetic oligonucleotide
aaccaagcuccauuuuuu

SEQ ID NO: 58411 - RNA, 18 nt, Artificial Sequence
  Description of Artificial Sequence: Synthetic oligonucleotide
caugcaaccaagcuccau

SEQ ID NO: 58412 - RNA, 18 nt, Artificial Sequence
  Description of Artificial Sequence: Synthetic oligonucleotide
aaaaucaugcaaccaagc

SEQ ID NO: 58413 - RNA, 18 nt, Artificial Sequence
  Description of Artificial Sequence: Synthetic oligonucleotide
gagcgaaaaucaugcaac

SEQ ID NO: 58414 - RNA, 18 nt, Artificial Sequence
  Description of Artificial Sequence: Synthetic oligonucleotide
cucaagagcgaaaaucau

SEQ ID NO: 58415 - RNA, 18 nt, Artificial Sequence
  Description of Artificial Sequence: Synthetic oligonucleotide
gaugacucaagagcgaaa

SEQ ID NO: 58416 - RNA, 18 nt, Artificial Sequence
  Description of Artificial Sequence: Synthetic oligonucleotide
ggcuagaugacucaagag

SEQ ID NO: 58417 - RNA, 18 nt, Artificial Sequence
  Description of Artificial Sequence: Synthetic oligonucleotide
uagagggcuagaugacuc

SEQ ID NO: 58418 - RNA, 18 nt, Artificial Sequence
  Description of Artificial Sequence: Synthetic oligonucleotide
aucauuagagggcuagau

SEQ ID NO: 58419 - RNA, 18 nt, Artificial Sequence
  Description of Artificial Sequence: Synthetic oligonucleotide
aggcaaucauuagagggc

SEQ ID NO: 58420 - RNA, 18 nt, Artificial Sequence
  Description of Artificial Sequence: Synthetic oligonucleotide
guaugaggcaaucauuag

SEQ ID NO: 58421 - RNA, 18 nt, Artificial Sequence
  Description of Artificial Sequence: Synthetic oligonucleotide
caccgguaugaggcaauc

SEQ ID NO: 58422 - RNA, 18 nt, Artificial Sequence
  Description of Artificial Sequence: Synthetic oligonucleotide
guaaucaccgguaugagg

SEQ ID NO: 58423 - RNA, 18 nt, Artificial Sequence
  Description of Artificial Sequence: Synthetic oligonucleotide
cgcucguaaucaccggua

SEQ ID NO: 58424 - RNA, 18 nt, Artificial Sequence
  Description of Artificial Sequence: Synthetic oligonucleotide
aaagccgcucguaaucac

SEQ ID NO: 58425 - RNA, 18 nt, Artificial Sequence
  Description of Artificial Sequence: Synthetic oligonucleotide
caugaaaagccgcucgua

SEQ ID NO: 58426 - RNA, 18 nt, Artificial Sequence
  Description of Artificial Sequence: Synthetic oligonucleotide
gggucaugaaaagccgcu

SEQ ID NO: 58427 - RNA, 18 nt, Artificial Sequence
  Description of Artificial Sequence: Synthetic oligonucleotide
aaaugguacauauggaag

SEQ ID NO: 58428 - RNA, 18 nt, Artificial Sequence
  Description of Artificial Sequence: Synthetic oligonucleotide
uuuuaaaaugguacauau

SEQ ID NO: 58429 - RNA, 18 nt, Artificial Sequence
  Description of Artificial Sequence: Synthetic oligonucleotide
cagcauuuuaaaauggua

SEQ ID NO: 58430 - RNA, 18 nt, Artificial Sequence
  Description of Artificial Sequence: Synthetic oligonucleotide
guaaucagcauuuuaaaa

SEQ ID NO: 58431 - RNA, 18 nt, Artificial Sequence
  Description of Artificial Sequence: Synthetic oligonucleotide
aagaaguaaucagcauuu

SEQ ID NO: 58432 - RNA, 18 nt, Artificial Sequence
  Description of Artificial Sequence: Synthetic oligonucleotide
uucucaagaaguaaucag

SEQ ID NO: 58433 - RNA, 18 nt, Artificial Sequence
  Description of Artificial Sequence: Synthetic oligonucleotide
ucuuauucucaagaagua

SEQ ID NO: 58434 - RNA, 18 nt, Artificial Sequence
  Description of Artificial Sequence: Synthetic oligonucleotide
gcuucucuuauucucaag

SEQ ID NO: 58435 - RNA, 18 nt, Artificial Sequence
  Description of Artificial Sequence: Synthetic oligonucleotide
auuaggcuucucuuauuc

SEQ ID NO: 58436 - RNA, 18 nt, Artificial Sequence
  Description of Artificial Sequence: Synthetic oligonucleotide
cugaaauuaggcuucucu

SEQ ID NO: 58437 - RNA, 18 nt, Artificial Sequence
  Description of Artificial Sequence: Synthetic oligonucleotide
auauucugaaauuaggcu

SEQ ID NO: 58438 - RNA, 18 nt, Artificial Sequence
  Description of Artificial Sequence: Synthetic oligonucleotide
uaaugauauucugaaauu

SEQ ID NO: 58439 - RNA, 18 nt, Artificial Sequence
  Description of Artificial Sequence: Synthetic oligonucleotide
uacccuaaugauauucug

SEQ ID NO: 58440 - RNA, 18 nt, Artificial Sequence
  Description of Artificial Sequence: Synthetic oligonucleotide
auagguacccuaaugaua

SEQ ID NO: 58441 - RNA, 18 nt, Artificial Sequence
  Description of Artificial Sequence: Synthetic oligonucleotide
cuucaauagguacccuaa

SEQ ID NO: 58442 - RNA, 18 nt, Artificial Sequence
  Description of Artificial Sequence: Synthetic oligonucleotide
caagacuucaauagguac

SEQ ID NO: 58443 - RNA, 18 nt, Artificial Sequence
  Description of Artificial Sequence: Synthetic oligonucleotide
gcagucaagacuucaaua

SEQ ID NO: 58444 - RNA, 18 nt, Artificial Sequence
  Description of Artificial Sequence: Synthetic oligonucleotide
uaugugcagucaagacuu

SEQ ID NO: 58445 - RNA, 18 nt, Artificial Sequence
  Description of Artificial Sequence: Synthetic oligonucleotide
cuaaauaugugcagucaa

SEQ ID NO: 58446 - RNA, 18 nt, Artificial Sequence
  Description of Artificial Sequence: Synthetic oligonucleotide
guaugcuaaauaugugca

SEQ ID NO: 58447 - RNA, 18 nt, Artificial Sequence
  Description of Artificial Sequence: Synthetic oligonucleotide
agggaguaugcuaaauau

SEQ ID NO: 58448 - RNA, 18 nt, Artificial Sequence
  Description of Artificial Sequence: Synthetic oligonucleotide
uucccagggaguaugcua

SEQ ID NO: 58449 - RNA, 18 nt, Artificial Sequence
  Description of Artificial Sequence: Synthetic oligonucleotide
uauaauucccagggagua

SEQ ID NO: 58450 - RNA, 18 nt, Artificial Sequence
  Description of Artificial Sequence: Synthetic oligonucleotide
uaaaauauaauucccagg

SEQ ID NO: 58451 - RNA, 18 nt, Artificial Sequence
  Description of Artificial Sequence: Synthetic oligonucleotide
guccuuaaaauauaauuc

SEQ ID NO: 58452 - RNA, 18 nt, Artificial Sequence
  Description of Artificial Sequence: Synthetic oligonucleotide
aaaauguccuuaaaauau

SEQ ID NO: 58453 - RNA, 18 nt, Artificial Sequence
  Description of Artificial Sequence: Synthetic oligonucleotide
auagaaaaauguccuuaa

SEQ ID NO: 58454 - RNA, 18 nt, Artificial Sequence
  Description of Artificial Sequence: Synthetic oligonucleotide
auuuaauagaaaaauguc

SEQ ID NO: 58455 - RNA, 18 nt, Artificial Sequence
  Description of Artificial Sequence: Synthetic oligonucleotide
caaugauuuaauagaaaa

SEQ ID NO: 58456 - RNA, 18 nt, Artificial Sequence
  Description of Artificial Sequence: Synthetic oligonucleotide
auaugcaaugauuuaaua

SEQ ID NO: 58457 - RNA, 18 nt, Artificial Sequence
  Description of Artificial Sequence: Synthetic oligonucleotide
cuuccauaugcaaugauu

SEQ ID NO: 58458 - RNA, 18 nt, Artificial Sequence
  Description of Artificial Sequence: Synthetic oligonucleotide
aguuucuuccauaugcaa

SEQ ID NO: 58459 - RNA, 18 nt, Artificial Sequence
  Description of Artificial Sequence: Synthetic oligonucleotide
uauugaguuucuuccaua

SEQ ID NO: 58460 - RNA, 18 nt, Artificial Sequence
  Description of Artificial Sequence: Synthetic oligonucleotide
uauuauauugaguuucuu

SEQ ID NO: 58461 - RNA, 18 nt, Artificial Sequence
  Description of Artificial Sequence: Synthetic oligonucleotide
ucagcuauuauauugagu

SEQ ID NO: 58462 - RNA, 18 nt, Artificial Sequence
  Description of Artificial Sequence: Synthetic oligonucleotide
aaauaucagcuauuauau

SEQ ID NO: 58463 - RNA, 18 nt, Artificial Sequence
  Description of Artificial Sequence: Synthetic oligonucleotide
caaguaaauaucagcuau

SEQ ID NO: 58464 - RNA, 18 nt, Artificial Sequence
  Description of Artificial Sequence: Synthetic oligonucleotide
gaacccaaguaaauauca

SEQ ID NO: 58465 - RNA, 18 nt, Artificial Sequence
  Description of Artificial Sequence: Synthetic oligonucleotide
auuaagaacccaaguaaa

SEQ ID NO: 58466 - RNA, 18 nt, Artificial Sequence
  Description of Artificial Sequence: Synthetic oligonucleotide
uucugauuaagaacccaa

SEQ ID NO: 58467 - RNA, 18 nt, Artificial Sequence
  Description of Artificial Sequence: Synthetic oligonucleotide
caauguucugauuaagaa

SEQ ID NO: 58468 - RNA, 18 nt, Artificial Sequence
  Description of Artificial Sequence: Synthetic oligonucleotide
acagccaauguucugauu

SEQ ID NO: 58469 - RNA, 18 nt, Artificial Sequence
  Description of Artificial Sequence: Synthetic oligonucleotide
aucacacagccaauguuc

SEQ ID NO: 58470 - RNA, 18 nt, Artificial Sequence
  Description of Artificial Sequence: Synthetic oligonucleotide
ugaaaaucacacagccaa

SEQ ID NO: 58471 - RNA, 18 nt, Artificial Sequence
  Description of Artificial Sequence: Synthetic oligonucleotide
aaucaugaaaaucacaca

SEQ ID NO: 58472 - RNA, 18 nt, Artificial Sequence
  Description of Artificial Sequence: Synthetic oligonucleotide
aucauaaucaugaaaauc

SEQ ID NO: 58473 - RNA, 18 nt, Artificial Sequence
  Description of Artificial Sequence: Synthetic oligonucleotide
ugaaaaucauaaucauga

SEQ ID NO: 58474 - RNA, 18 nt, Artificial Sequence
  Description of Artificial Sequence: Synthetic oligonucleotide
ugcaaugaaaaucauaau

SEQ ID NO: 58475 - RNA, 18 nt, Artificial Sequence
  Description of Artificial Sequence: Synthetic oligonucleotide
uuaauugcaaugaaaauc

SEQ ID NO: 58476 - RNA, 18 nt, Artificial Sequence
  Description of Artificial Sequence: Synthetic oligonucleotide
ucaacuuaauugcaauga

SEQ ID NO: 58477 - RNA, 18 nt, Artificial Sequence
  Description of Artificial Sequence: Synthetic oligonucleotide
aaacaucaacuuaauugc

SEQ ID NO: 58478 - RNA, 18 nt, Artificial Sequence
  Description of Artificial Sequence: Synthetic oligonucleotide
cuacaaaacaucaacuua

SEQ ID NO: 58479 - RNA, 18 nt, Artificial Sequence
  Description of Artificial Sequence: Synthetic oligonucleotide
acugucuacaaaacauca

SEQ ID NO: 58480 - RNA, 18 nt, Artificial Sequence
  Description of Artificial Sequence: Synthetic oligonucleotide
auuucacugucuacaaaa

SEQ ID NO: 58481 - RNA, 18 nt, Artificial Sequence
  Description of Artificial Sequence: Synthetic oligonucleotide
ugguaauuucacugucua

SEQ ID NO: 58482 - RNA, 18 nt, Artificial Sequence
  Description of Artificial Sequence: Synthetic oligonucleotide
guagaugguaauuucacu

SEQ ID NO: 58483 - RNA, 18 nt, Artificial Sequence
  Description of Artificial Sequence: Synthetic oligonucleotide
uuggaguagaugguaauu

SEQ ID NO: 58484 - RNA, 18 nt, Artificial Sequence
  Description of Artificial Sequence: Synthetic oligonucleotide
aucuuuuggaguagaugg

SEQ ID NO: 58485 - RNA, 18 nt, Artificial Sequence
  Description of Artificial Sequence: Synthetic oligonucleotide
uugcaaucuuuuggagua

SEQ ID NO: 58486 - RNA, 18 nt, Artificial Sequence
  Description of Artificial Sequence: Synthetic oligonucleotide
cuauuuugcaaucuuuug

SEQ ID NO: 58487 - RNA, 18 nt, Artificial Sequence
  Description of Artificial Sequence: Synthetic oligonucleotide
aaauucuauuuugcaauc

SEQ ID NO: 58488 - RNA, 18 nt, Artificial Sequence
  Description of Artificial Sequence: Synthetic oligonucleotide
agguuaaauucuauuuug

SEQ ID NO: 58489 - RNA, 18 nt, Artificial Sequence
  Description of Artificial Sequence: Synthetic oligonucleotide
cucuaagguuaaauucua

SEQ ID NO: 58490 - RNA, 18 nt, Artificial Sequence
  Description of Artificial Sequence: Synthetic oligonucleotide
auuggcucuaagguuaaa

SEQ ID NO: 58491 - RNA, 18 nt, Artificial Sequence
  Description of Artificial Sequence: Synthetic oligonucleotide
ccugcauuggcucuaagg

SEQ ID NO: 58492 - RNA, 18 nt, Artificial Sequence
  Description of Artificial Sequence: Synthetic oligonucleotide
uuuucccugcauuggcuc

SEQ ID NO: 58493 - RNA, 18 nt, Artificial Sequence
  Description of Artificial Sequence: Synthetic oligonucleotide
acaaguuuucccugcauu

SEQ ID NO: 58494 - RNA, 18 nt, Artificial Sequence
  Description of Artificial Sequence: Synthetic oligonucleotide
cagaaacaaguuuucccu

SEQ ID NO: 58495 - RNA, 18 nt, Artificial Sequence
  Description of Artificial Sequence: Synthetic oligonucleotide
accugcagaaacaaguuu

SEQ ID NO: 58496 - RNA, 18 nt, Artificial Sequence
  Description of Artificial Sequence: Synthetic oligonucleotide
aaugcaccugcagaaaca

SEQ ID NO: 58497 - RNA, 18 nt, Artificial Sequence
  Description of Artificial Sequence: Synthetic oligonucleotide
caaaaaaugcaccugcag

SEQ ID NO: 58498 - RNA, 18 nt, Artificial Sequence
  Description of Artificial Sequence: Synthetic oligonucleotide
aguuucaaaaaaugcacc

SEQ ID NO: 58499 - RNA, 18 nt, Artificial Sequence
  Description of Artificial Sequence: Synthetic oligonucleotide
guugaaguuucaaaaaau

SEQ ID NO: 58500 - RNA, 18 nt, Artificial Sequence
  Description of Artificial Sequence: Synthetic oligonucleotide
uaucuguugaaguuucaa

SEQ ID NO: 58501 - RNA, 18 nt, Artificial Sequence
  Description of Artificial Sequence: Synthetic oligonucleotide
ccugcuaucuguugaagu

SEQ ID NO: 58502 - RNA, 18 nt, Artificial Sequence
  Description of Artificial Sequence: Synthetic oligonucleotide
uucccccugcuaucuguu

SEQ ID NO: 58503 - RNA, 18 nt, Artificial Sequence
  Description of Artificial Sequence: Synthetic oligonucleotide
uuuuuuucccccugcuau

SEQ ID NO: 58504 - RNA, 18 nt, Artificial Sequence
  Description of Artificial Sequence: Synthetic oligonucleotide
ucacuuuuuuuucccccu

SEQ ID NO: 58505 - RNA, 18 nt, Artificial Sequence
  Description of Artificial Sequence: Synthetic oligonucleotide
uucugucacuuuuuuuuc

SEQ ID NO: 58506 - RNA, 18 nt, Artificial Sequence
  Description of Artificial Sequence: Synthetic oligonucleotide
gauccuucugucacuuuu

SEQ ID NO: 58507 - RNA, 18 nt, Artificial Sequence
  Description of Artificial Sequence: Synthetic oligonucleotide
acugugauccuucuguca

SEQ ID NO: 58508 - RNA, 18 nt, Artificial Sequence
  Description of Artificial Sequence: Synthetic oligonucleotide
gcugaacugugauccuuc

SEQ ID NO: 58509 - RNA, 18 nt, Artificial Sequence
  Description of Artificial Sequence: Synthetic oligonucleotide
auacugcugaacugugau

SEQ ID NO: 58510 - RNA, 18 nt, Artificial Sequence
  Description of Artificial Sequence: Synthetic oligonucleotide
aauucauacugcugaacu

SEQ ID NO: 58511 - RNA, 18 nt, Artificial Sequence
  Description of Artificial Sequence: Synthetic oligonucleotide
cagacaauucauacugcu

SEQ ID NO: 58512 - RNA, 18 nt, Artificial Sequence
  Description of Artificial Sequence: Synthetic oligonucleotide
gccagcagacaauucaua

SEQ ID NO: 58513 - RNA, 18 nt, Artificial Sequence
  Description of Artificial Sequence: Synthetic oligonucleotide
aggcugccagcagacaau

SEQ ID NO: 58514 - RNA, 18 nt, Artificial Sequence
  Description of Artificial Sequence: Synthetic oligonucleotide
uugcaaggcugccagcag

SEQ ID NO: 58515 - RNA, 18 nt, Artificial Sequence
  Description of Artificial Sequence: Synthetic oligonucleotide
ccagauugcaaggcugcc

SEQ ID NO: 58516 - RNA, 18 nt, Artificial Sequence
  Description of Artificial Sequence: Synthetic oligonucleotide
gcacaccagauugcaagg

SEQ ID NO: 58517 - RNA, 18 nt, Artificial Sequence
  Description of Artificial Sequence: Synthetic oligonucleotide
ugccugcacaccagauug

SEQ ID NO: 58518 - RNA, 18 nt, Artificial Sequence
  Description of Artificial Sequence: Synthetic oligonucleotide
cucacugccugcacacca

SEQ ID NO: 58519 - RNA, 18 nt, Artificial Sequence
  Description of Artificial Sequence: Synthetic oligonucleotide
acaaucucacugccugca

SEQ ID NO: 58520 - RNA, 18 nt, Artificial Sequence
  Description of Artificial Sequence: Synthetic oligonucleotide
acaccacaaucucacugc

SEQ ID NO: 58521 - RNA, 18 nt, Artificial Sequence
  Description of Artificial Sequence: Synthetic oligonucleotide
cauguacaccacaaucuc

SEQ ID NO: 58522 - RNA, 18 nt, Artificial Sequence
  Description of Artificial Sequence: Synthetic oligonucleotide
ggugacauguacaccaca

SEQ ID NO: 58523 - RNA, 18 nt, Artificial Sequence
  Description of Artificial Sequence: Synthetic oligonucleotide
aaucaggugacauguaca

SEQ ID NO: 58524 - RNA, 18 nt, Artificial Sequence
  Description of Artificial Sequence: Synthetic oligonucleotide
uguaguccugguggcaug

SEQ ID NO: 58525 - RNA, 18 nt, Artificial Sequence
  Description of Artificial Sequence: Synthetic oligonucleotide
gccccuguaguccuggug

SEQ ID NO: 58526 - RNA, 18 nt, Artificial Sequence
  Description of Artificial Sequence: Synthetic oligonucleotide
acucugccccuguagucc

SEQ ID NO: 58527 - RNA, 18 nt, Artificial Sequence
  Description of Artificial Sequence: Synthetic oligonucleotide
gagacacucugccccugu

SEQ ID NO: 58528 - RNA, 18 nt, Artificial Sequence
  Description of Artificial Sequence: Synthetic oligonucleotide
cagaggagacacucugcc

SEQ ID NO: 58529 - RNA, 18 nt, Artificial Sequence
  Description of Artificial Sequence: Synthetic oligonucleotide
gcugccagaggagacacu

SEQ ID NO: 58530 - RNA, 18 nt, Artificial Sequence
  Description of Artificial Sequence: Synthetic oligonucleotide
ucagagcugccagaggag

SEQ ID NO: 58531 - RNA, 18 nt, Artificial Sequence
  Description of Artificial Sequence: Synthetic oligonucleotide
ugaucucagagcugccag

SEQ ID NO: 58532 - RNA, 18 nt, Artificial Sequence
  Description of Artificial Sequence: Synthetic oligonucleotide
ggauuugaucucagagcu

SEQ ID NO: 58533 - RNA, 18 nt, Artificial Sequence
  Description of Artificial Sequence: Synthetic oligonucleotide
ucaucggauuugaucuca

SEQ ID NO: 58534 - RNA, 18 nt, Artificial Sequence
  Description of Artificial Sequence: Synthetic oligonucleotide
ccucgucaucggauuuga

SEQ ID NO: 58535 - RNA, 18 nt, Artificial Sequence
  Description of Artificial Sequence: Synthetic oligonucleotide
aucacccucgucaucgga

SEQ ID NO: 58536 - RNA, 18 nt, Artificial Sequence
  Description of Artificial Sequence: Synthetic oligonucleotide
uucucaucacccucguca

SEQ ID NO: 58537 - RNA, 18 nt, Artificial Sequence
  Description of Artificial Sequence: Synthetic oligonucleotide
gcagguucucaucacccu

SEQ ID NO: 58538 - RNA, 18 nt, Artificial Sequence
  Description of Artificial Sequence: Synthetic oligonucleotide
gucuugcagguucucauc

SEQ ID NO: 58539 - RNA, 18 nt, Artificial Sequence
  Description of Artificial Sequence: Synthetic oligonucleotide
uucgugucuugcagguuc

SEQ ID NO: 58540 - RNA, 18 nt, Artificial Sequence
  Description of Artificial Sequence: Synthetic oligonucleotide
aagauuucgugucuugca

SEQ ID NO: 58541 - RNA, 18 nt, Artificial Sequence
  Description of Artificial Sequence: Synthetic oligonucleotide
cuccgaagauuucguguc

SEQ ID NO: 58542 - RNA, 18 nt, Artificial Sequence
  Description of Artificial Sequence: Synthetic oligonucleotide
uuguccuccgaagauuuc

SEQ ID NO: 58543 - RNA, 18 nt, Artificial Sequence
  Description of Artificial Sequence: Synthetic oligonucleotide
auuucuuguccuccgaag

SEQ ID NO: 58544 - RNA, 18 nt, Artificial Sequence
  Description of Artificial Sequence: Synthetic oligonucleotide
aucuaauuucuuguccuc

SEQ ID NO: 58545 - RNA, 18 nt, Artificial Sequence
  Description of Artificial Sequence: Synthetic oligonucleotide
ucgucaucuaauuucuug

SEQ ID NO: 58546 - RNA, 18 nt, Artificial Sequence
  Description of Artificial Sequence: Synthetic oligonucleotide
ucuugucgucaucuaauu

SEQ ID NO: 58547 - RNA, 18 nt, Artificial Sequence
  Description of Artificial Sequence: Synthetic oligonucleotide
auccuucuugucgucauc

SEQ ID NO: 58548 - RNA, 18 nt, Artificial Sequence
  Description of Artificial Sequence: Synthetic oligonucleotide
uugauauccuucuugucg

SEQ ID NO: 58549 - RNA, 18 nt, Artificial Sequence
  Description of Artificial Sequence: Synthetic oligonucleotide
uugauuugauauccuucu

SEQ ID NO: 58550 - RNA, 18 nt, Artificial Sequence
  Description of Artificial Sequence: Synthetic oligonucleotide
aguaauugauuugauauc

SEQ ID NO: 58551 - RNA, 18 nt, Artificial Sequence
  Description of Artificial Sequence: Synthetic oligonucleotide
uucacgauggguccccac

SEQ ID NO: 58552 - RNA, 18 nt, Artificial Sequence
  Description of Artificial Sequence: Synthetic oligonucleotide
ccaucuucacgauggguc

SEQ ID NO: 58553 - RNA, 18 nt, Artificial Sequence
  Description of Artificial Sequence: Synthetic oligonucleotide
ccacgccaucuucacgau

SEQ ID NO: 58554 - RNA, 18 nt, Artificial Sequence
  Description of Artificial Sequence: Synthetic oligonucleotide
cagggccacgccaucuuc

SEQ ID NO: 58555 - RNA, 18 nt, Artificial Sequence
  Description of Artificial Sequence: Synthetic oligonucleotide
ccucucagggccacgcca

SEQ ID NO: 58556 - RNA, 18 nt, Artificial Sequence
  Description of Artificial Sequence: Synthetic oligonucleotide
ggcugccucucagggcca

SEQ ID NO: 58557 - RNA, 18 nt, Artificial Sequence
  Description of Artificial Sequence: Synthetic oligonucleotide
agaauggcugccucucag

SEQ ID NO: 58558 - RNA, 18 nt, Artificial Sequence
  Description of Artificial Sequence: Synthetic oligonucleotide
agaagagaauggcugccu

SEQ ID NO: 58559 - RNA, 18 nt, Artificial Sequence
  Description of Artificial Sequence: Synthetic oligonucleotide
uuggcagaagagaauggc

SEQ ID NO: 58560 - RNA, 18 nt, Artificial Sequence
  Description of Artificial Sequence: Synthetic oligonucleotide
cugguuuggcagaagaga

SEQ ID NO: 58561 - RNA, 18 nt, Artificial Sequence
  Description of Artificial Sequence: Synthetic oligonucleotide
ggaaccugguuuggcaga

SEQ ID NO: 58562 - RNA, 18 nt, Artificial Sequence
  Description of Artificial Sequence: Synthetic oligonucleotide
gaaccggaaccugguuug

SEQ ID NO: 58563 - RNA, 18 nt, Artificial Sequence
  Description of Artificial Sequence: Synthetic oligonucleotide
cuguggaaccggaaccug

SEQ ID NO: 58564 - RNA, 18 nt, Artificial Sequence
  Description of Artificial Sequence: Synthetic oligonucleotide
ggaagcuguggaaccgga

SEQ ID NO: 58565 - RNA, 18 nt, Artificial Sequence
  Description of Artificial Sequence: Synthetic oligonucleotide
ggacaggaagcuguggaa

SEQ ID NO: 58566 - RNA, 18 nt, Artificial Sequence
  Description of Artificial Sequence: Synthetic oligonucleotide
agacuggacaggaagcug

SEQ ID NO: 58567 - RNA, 18 nt, Artificial Sequence
  Description of Artificial Sequence: Synthetic oligonucleotide
gucgcagacuggacagga

SEQ ID NO: 58568 - RNA, 18 nt, Artificial Sequence
  Description of Artificial Sequence: Synthetic oligonucleotide
gggaagucgcagacugga

SEQ ID NO: 58569 - RNA, 18 nt, Artificial Sequence
  Description of Artificial Sequence: Synthetic oligonucleotide
gguggguucaggucaggg

SEQ ID NO: 58570 - RNA, 18 nt, Artificial Sequence
  Description of Artificial Sequence: Synthetic oligonucleotide
ggguggguucaggucagg

SEQ ID NO: 58571 - RNA, 18 nt, Artificial Sequence
  Description of Artificial Sequence: Synthetic oligonucleotide
cucuguaaggguccuggg

SEQ ID NO: 58572 - RNA, 18 nt, Artificial Sequence
  Description of Artificial Sequence: Synthetic oligonucleotide
gugcccuggugaggccaa

SEQ ID NO: 58573 - RNA, 18 nt, Artificial Sequence
  Description of Artificial Sequence: Synthetic oligonucleotide
cagaagugcccuggugag

SEQ ID NO: 58574 - RNA, 18 nt, Artificial Sequence
  Description of Artificial Sequence: Synthetic oligonucleotide
gaggucagaagugcccug

SEQ ID NO: 58575 - RNA, 18 nt, Artificial Sequence
  Description of Artificial Sequence: Synthetic oligonucleotide
aaagugaggucagaagug

SEQ ID NO: 58576 - RNA, 18 nt, Artificial Sequence
  Description of Artificial Sequence: Synthetic oligonucleotide
uugugaaagugaggucag

SEQ ID NO: 58577 - RNA, 18 nt, Artificial Sequence
  Description of Artificial Sequence: Synthetic oligonucleotide
uccuauugugaaagugag

SEQ ID NO: 58578 - RNA, 18 nt, Artificial Sequence
  Description of Artificial Sequence: Synthetic oligonucleotide
acugguccuauugugaaa

SEQ ID NO: 58579 - RNA, 18 nt, Artificial Sequence
  Description of Artificial Sequence: Synthetic oligonucleotide
ucaacacugguccuauug

SEQ ID NO: 58580 - RNA, 18 nt, Artificial Sequence
  Description of Artificial Sequence: Synthetic oligonucleotide
ggguaucaacacuggucc

SEQ ID NO: 58581 - RNA, 18 nt, Artificial Sequence
  Description of Artificial Sequence: Synthetic oligonucleotide
aggcuggguaucaacacu

SEQ ID NO: 58582 - RNA, 18 nt, Artificial Sequence
  Description of Artificial Sequence: Synthetic oligonucleotide
ccaagaggcuggguauca

SEQ ID NO: 58583 - RNA, 18 nt, Artificial Sequence
  Description of Artificial Sequence: Synthetic oligonucleotide
gaacaccaagaggcuggg

SEQ ID NO: 58584 - RNA, 18 nt, Artificial Sequence
  Description of Artificial Sequence: Synthetic oligonucleotide
gggaugaacaccaagagg

SEQ ID NO: 58585 - RNA, 18 nt, Artificial Sequence
  Description of Artificial Sequence: Synthetic oligonucleotide
cuugagggaugaacacca

SEQ ID NO: 58586 - RNA, 18 nt, Artificial Sequence
  Description of Artificial Sequence: Synthetic oligonucleotide
ugcuucuugagggaugaa

SEQ ID NO: 58587 - RNA, 18 nt, Artificial Sequence
  Description of Artificial Sequence: Synthetic oligonucleotide
gccagugcuucuugaggg

SEQ ID NO: 58588 - RNA, 18 nt, Artificial Sequence
  Description of Artificial Sequence: Synthetic oligonucleotide
uuucugccagugcuucuu

SEQ ID NO: 58589 - RNA, 18 nt, Artificial Sequence
  Description of Artificial Sequence: Synthetic oligonucleotide
cuggguuucugccagugc

SEQ ID NO: 58590 - RNA, 18 nt, Artificial Sequence
  Description of Artificial Sequence: Synthetic oligonucleotide
gauuccuggguuucugcc

SEQ ID NO: 58591 - RNA, 18 nt, Artificial Sequence
  Description of Artificial Sequence: Synthetic oligonucleotide
aauuugauuccuggguuu

SEQ ID NO: 58592 - RNA, 18 nt, Artificial Sequence
  Description of Artificial Sequence: Synthetic oligonucleotide
ugcccaauuugauuccug

SEQ ID NO: 58593 - RNA, 18 nt, Artificial Sequence
  Description of Artificial Sequence: Synthetic oligonucleotide
uuuugugcccaauuugau

SEQ ID NO: 58594 - RNA, 18 nt, Artificial Sequence
  Description of Artificial Sequence: Synthetic oligonucleotide
accauuuuugugcccaau

SEQ ID NO: 58595 - RNA, 18 nt, Artificial Sequence
  Description of Artificial Sequence: Synthetic oligonucleotide
uccuuaccauuuuugugc

SEQ ID NO: 58596 - RNA, 18 nt, Artificial Sequence
  Description of Artificial Sequence: Synthetic oligonucleotide
ccauuuccuuaccauuuu

SEQ ID NO: 58597 - RNA, 18 nt, Artificial Sequence
  Description of Artificial Sequence: Synthetic oligonucleotide
cuuugccauuuccuuacc

SEQ ID NO: 58598 - RNA, 18 nt, Artificial Sequence
  Description of Artificial Sequence: Synthetic oligonucleotide
aaauacuuugccauuucc

SEQ ID NO: 58599 - RNA, 18 nt, Artificial Sequence
  Description of Artificial Sequence: Synthetic oligonucleotide
guucuaaauacuuugcca

SEQ ID NO: 58600 - RNA, 18 nt, Artificial Sequence
  Description of Artificial Sequence: Synthetic oligonucleotide
gcgaaguucuaaauacuu

SEQ ID NO: 58601 - RNA, 18 nt, Artificial Sequence
  Description of Artificial Sequence: Synthetic oligonucleotide
agcgggcgaaguucuaaa

SEQ ID NO: 58602 - RNA, 18 nt, Artificial Sequence
  Description of Artificial Sequence: Synthetic oligonucleotide
caauuagcgggcgaaguu

SEQ ID NO: 58603 - RNA, 18 nt, Artificial Sequence
  Description of Artificial Sequence: Synthetic oligonucleotide
aaacacaauuagcgggcg

SEQ ID NO: 58604 - RNA, 18 nt, Artificial Sequence
  Description of Artificial Sequence: Synthetic oligonucleotide
uggagaaacacaauuagc

SEQ ID NO: 58605 - RNA, 18 nt, Artificial Sequence
  Description of Artificial Sequence: Synthetic oligonucleotide
gucccuggagaaacacaa

SEQ ID NO: 58606 - RNA, 18 nt, Artificial Sequence
  Description of Artificial Sequence: Synthetic oligonucleotide
aaacagucccuggagaaa

SEQ ID NO: 58607 - RNA, 18 nt, Artificial Sequence
  Description of Artificial Sequence: Synthetic oligonucleotide
gaggaaaacagucccugg

SEQ ID NO: 58608 - RNA, 18 nt, Artificial Sequence
  Description of Artificial Sequence: Synthetic oligonucleotide
uguuugaggaaaacaguc

SEQ ID NO: 58609 - RNA, 18 nt, Artificial Sequence
  Description of Artificial Sequence: Synthetic oligonucleotide
gaggauguuugaggaaaa

SEQ ID NO: 58610 - RNA, 18 nt, Artificial Sequence
  Description of Artificial Sequence: Synthetic oligonucleotide
uuucagaggauguuugag

SEQ ID NO: 58611 - RNA, 18 nt, Artificial Sequence
  Description of Artificial Sequence: Synthetic oligonucleotide
caggauuucagaggaugu

SEQ ID NO: 58612 - RNA, 18 nt, Artificial Sequence
  Description of Artificial Sequence: Synthetic oligonucleotide
aggaccaggauuucagag

SEQ ID NO: 58613 - RNA, 18 nt, Artificial Sequence
  Description of Artificial Sequence: Synthetic oligonucleotide
gauauaggaccaggauuu

SEQ ID NO: 58614 - RNA, 18 nt, Artificial Sequence
  Description of Artificial Sequence: Synthetic oligonucleotide
cugcugauauaggaccag

SEQ ID NO: 58615 - RNA, 18 nt, Artificial Sequence
  Description of Artificial Sequence: Synthetic oligonucleotide
auucccugcugauauagg

SEQ ID NO: 58616 - RNA, 18 nt, Artificial Sequence
  Description of Artificial Sequence: Synthetic oligonucleotide
gccucauucccugcugau

SEQ ID NO: 58617 - RNA, 18 nt, Artificial Sequence
  Description of Artificial Sequence: Synthetic oligonucleotide
cuguggccucauucccug

SEQ ID NO: 58618 - RNA, 18 nt, Artificial Sequence
  Description of Artificial Sequence: Synthetic oligonucleotide
ucagucuguggccucauu

SEQ ID NO: 58619 - RNA, 18 nt, Artificial Sequence
  Description of Artificial Sequence: Synthetic oligonucleotide
ucucaucagucuguggcc

SEQ ID NO: 58620 - RNA, 18 nt, Artificial Sequence
  Description of Artificial Sequence: Synthetic oligonucleotide
uuuccucucaucagucug

SEQ ID NO: 58621 - RNA, 18 nt, Artificial Sequence
  Description of Artificial Sequence: Synthetic oligonucleotide
uaaaauuuccucucauca

SEQ ID NO: 58622 - RNA, 18 nt, Artificial Sequence
  Description of Artificial Sequence: Synthetic oligonucleotide
uaaaauaaaauuuccucu

SEQ ID NO: 58623 - RNA, 18 nt, Artificial Sequence
  Description of Artificial Sequence: Synthetic oligonucleotide
auagcuaaaauaaaauuu

SEQ ID NO: 58624 - RNA, 18 nt, Artificial Sequence
  Description of Artificial Sequence: Synthetic oligonucleotide
uggaaauagcuaaaauaa

SEQ ID NO: 58625 - RNA, 18 nt, Artificial Sequence
  Description of Artificial Sequence: Synthetic oligonucleotide
aaauguggaaauagcuaa

SEQ ID NO: 58626 - RNA, 18 nt, Artificial Sequence
  Description of Artificial Sequence: Synthetic oligonucleotide
gagaaaaauguggaaaua

SEQ ID NO: 58627 - RNA, 18 nt, Artificial Sequence
  Description of Artificial Sequence: Synthetic oligonucleotide
ugaaugagaaaaaugugg

SEQ ID NO: 58628 - RNA, 18 nt, Artificial Sequence
  Description of Artificial Sequence: Synthetic oligonucleotide
ggaccugaaugagaaaaa

SEQ ID NO: 58629 - RNA, 18 nt, Artificial Sequence
  Description of Artificial Sequence: Synthetic oligonucleotide
uuagaggaccugaaugag

SEQ ID NO: 58630 - RNA, 18 nt, Artificial Sequence
  Description of Artificial Sequence: Synthetic oligonucleotide
ccacauuagaggaccuga

SEQ ID NO: 58631 - RNA, 18 nt, Artificial Sequence
  Description of Artificial Sequence: Synthetic oligonucleotide
acuaaccacauuagagga

SEQ ID NO: 58632 - RNA, 18 nt, Artificial Sequence
  Description of Artificial Sequence: Synthetic oligonucleotide
ccacaacuaaccacauua

SEQ ID NO: 58633 - RNA, 18 nt, Artificial Sequence
  Description of Artificial Sequence: Synthetic oligonucleotide
ucaggccacaacuaacca

SEQ ID NO: 58634 - RNA, 18 nt, Artificial Sequence
  Description of Artificial Sequence: Synthetic oligonucleotide
cauuuucaggccacaacu

SEQ ID NO: 58635 - RNA, 18 nt, Artificial Sequence
  Description of Artificial Sequence: Synthetic oligonucleotide
aauaucauuuucaggcca

SEQ ID NO: 58636 - RNA, 18 nt, Artificial Sequence
  Description of Artificial Sequence: Synthetic oligonucleotide
uuggaaauaucauuuuca

SEQ ID NO: 58637 - RNA, 18 nt, Artificial Sequence
  Description of Artificial Sequence: Synthetic oligonucleotide
uucauuuggaaauaucau

SEQ ID NO: 58638 - RNA, 18 nt, Artificial Sequence
  Description of Artificial Sequence: Synthetic oligonucleotide
uccuauucauuuggaaau

SEQ ID NO: 58639 - RNA, 18 nt, Artificial Sequence
  Description of Artificial Sequence: Synthetic oligonucleotide
uuccuuccuauucauuug

SEQ ID NO: 58640 - RNA, 18 nt, Artificial Sequence
  Description of Artificial Sequence: Synthetic oligonucleotide
uuuccuuccuuccuauuc

SEQ ID NO: 58641 - RNA, 18 nt, Artificial Sequence
  Description of Artificial Sequence: Synthetic oligonucleotide
aacaauuuccuuccuucc

SEQ ID NO: 58642 - RNA, 18 nt, Artificial Sequence
  Description of Artificial Sequence: Synthetic oligonucleotide
acaaaaacaauuuccuuc

SEQ ID NO: 58643 - RNA, 18 nt, Artificial Sequence
  Description of Artificial Sequence: Synthetic oligonucleotide
aaacaacaaaaacaauuu

SEQ ID NO: 58644 - RNA, 18 nt, Artificial Sequence
  Description of Artificial Sequence: Synthetic oligonucleotide
aucuuaaacaacaaaaac

SEQ ID NO: 58645 - RNA, 18 nt, Artificial Sequence
  Description of Artificial Sequence: Synthetic oligonucleotide
cuuccaucuuaaacaaca

SEQ ID NO: 58646 - RNA, 18 nt, Artificial Sequence
  Description of Artificial Sequence: Synthetic oligonucleotide
auuuccuuccaucuuaaa

SEQ ID NO: 58647 - RNA, 18 nt, Artificial Sequence
  Description of Artificial Sequence: Synthetic oligonucleotide
ccuauauuuccuuccauc

SEQ ID NO: 58648 - RNA, 18 nt, Artificial Sequence
  Description of Artificial Sequence: Synthetic oligonucleotide
augcaccuauauuuccuu

SEQ ID NO: 58649 - RNA, 18 nt, Artificial Sequence
  Description of Artificial Sequence: Synthetic oligonucleotide
uuuaaaugcaccuauauu

SEQ ID NO: 58650 - RNA, 18 nt, Artificial Sequence
  Description of Artificial Sequence: Synthetic oligonucleotide
cauuuuuuaaaugcaccu

SEQ ID NO: 58651 - RNA, 18 nt, Artificial Sequence
  Description of Artificial Sequence: Synthetic oligonucleotide
agcuccauuuuuuaaaug

SEQ ID NO: 58652 - RNA, 18 nt, Artificial Sequence
  Description of Artificial Sequence: Synthetic oligonucleotide
aaccaagcuccauuuuuu

SEQ ID NO: 58653 - RNA, 18 nt, Artificial Sequence
  Description of Artificial Sequence: Synthetic oligonucleotide
caugcaaccaagcuccau

SEQ ID NO: 58654 - RNA, 18 nt, Artificial Sequence
  Description of Artificial Sequence: Synthetic oligonucleotide
aaaaucaugcaaccaagc

SEQ ID NO: 58655 - RNA, 18 nt, Artificial Sequence
  Description of Artificial Sequence: Synthetic oligonucleotide
gagcgaaaaucaugcaac

SEQ ID NO: 58656 - RNA, 18 nt, Artificial Sequence
  Description of Artificial Sequence: Synthetic oligonucleotide
cucaagagcgaaaaucau

SEQ ID NO: 58657 - RNA, 18 nt, Artificial Sequence
  Description of Artificial Sequence: Synthetic oligonucleotide
gaugacucaagagcgaaa

SEQ ID NO: 58658 - RNA, 18 nt, Artificial Sequence
  Description of Artificial Sequence: Synthetic oligonucleotide
ggcuagaugacucaagag

SEQ ID NO: 58659 - RNA, 18 nt, Artificial Sequence
  Description of Artificial Sequence: Synthetic oligonucleotide
uagagggcuagaugacuc

SEQ ID NO: 58660 - RNA, 18 nt, Artificial Sequence
  Description of Artificial Sequence: Synthetic oligonucleotide
aucauuagagggcuagau

SEQ ID NO: 58661 - RNA, 18 nt, Artificial Sequence
  Description of Artificial Sequence: Synthetic oligonucleotide
aggcaaucauuagagggc

SEQ ID NO: 58662 - RNA, 18 nt, Artificial Sequence
  Description of Artificial Sequence: Synthetic oligonucleotide
guaugaggcaaucauuag

SEQ ID NO: 58663 - RNA, 18 nt, Artificial Sequence
  Description of Artificial Sequence: Synthetic oligonucleotide
caccgguaugaggcaauc

SEQ ID NO: 58664 - RNA, 18 nt, Artificial Sequence
  Description of Artificial Sequence: Synthetic oligonucleotide
guaaucaccgguaugagg

SEQ ID NO: 58665 - RNA, 18 nt, Artificial Sequence
  Description of Artificial Sequence: Synthetic oligonucleotide
cgcucguaaucaccggua

SEQ ID NO: 58666 - RNA, 18 nt, Artificial Sequence
  Description of Artificial Sequence: Synthetic oligonucleotide
aaagccgcucguaaucac

SEQ ID NO: 58667 - RNA, 18 nt, Artificial Sequence
  Description of Artificial Sequence: Synthetic oligonucleotide
caugaaaagccgcucgua

SEQ ID NO: 58668 - RNA, 18 nt, Artificial Sequence
  Description of Artificial Sequence: Synthetic oligonucleotide
gggucaugaaaagccgcu

SEQ ID NO: 58669 - RNA, 18 nt, Artificial Sequence
  Description of Artificial Sequence: Synthetic oligonucleotide
aaaugguacauauggaag

SEQ ID NO: 58670 - RNA, 18 nt, Artificial Sequence
  Description of Artificial Sequence: Synthetic oligonucleotide
uuuuaaaaugguacauau

SEQ ID NO: 58671 - RNA, 18 nt, Artificial Sequence
  Description of Artificial Sequence: Synthetic oligonucleotide
cagcauuuuaaaauggua

SEQ ID NO: 58672 - RNA, 18 nt, Artificial Sequence
  Description of Artificial Sequence: Synthetic oligonucleotide
guaaucagcauuuuaaaa

SEQ ID NO: 58673 - RNA, 18 nt, Artificial Sequence
  Description of Artificial Sequence: Synthetic oligonucleotide
aagaaguaaucagcauuu

SEQ ID NO: 58674 - RNA, 18 nt, Artificial Sequence
  Description of Artificial Sequence: Synthetic oligonucleotide
uucucaagaaguaaucag

SEQ ID NO: 58675 - RNA, 18 nt, Artificial Sequence
  Description of Artificial Sequence: Synthetic oligonucleotide
ucuuauucucaagaagua

SEQ ID NO: 58676 - RNA, 18 nt, Artificial Sequence
  Description of Artificial Sequence: Synthetic oligonucleotide
gcuucucuuauucucaag

SEQ ID NO: 58677 - RNA, 18 nt, Artificial Sequence
  Description of Artificial Sequence: Synthetic oligonucleotide
auuaggcuucucuuauuc

SEQ ID NO: 58678 - RNA, 18 nt, Artificial Sequence
  Description of Artificial Sequence: Synthetic oligonucleotide
cugaaauuaggcuucucu

SEQ ID NO: 58679 - RNA, 18 nt, Artificial Sequence
  Description of Artificial Sequence: Synthetic oligonucleotide
auauucugaaauuaggcu

SEQ ID NO: 58680 - RNA, 18 nt, Artificial Sequence
  Description of Artificial Sequence: Synthetic oligonucleotide
uaaugauauucugaaauu

SEQ ID NO: 58681 - RNA, 18 nt, Artificial Sequence
  Description of Artificial Sequence: Synthetic oligonucleotide
uacccuaaugauauucug

SEQ ID NO: 58682 - RNA, 18 nt, Artificial Sequence
  Description of Artificial Sequence: Synthetic oligonucleotide
auagguacccuaaugaua

SEQ ID NO: 58683 - RNA, 18 nt, Artificial Sequence
  Description of Artificial Sequence: Synthetic oligonucleotide
cuucaauagguacccuaa

SEQ ID NO: 58684 - RNA, 18 nt, Artificial Sequence
  Description of Artificial Sequence: Synthetic oligonucleotide
caagacuucaauagguac

SEQ ID NO: 58685 - RNA, 18 nt, Artificial Sequence
  Description of Artificial Sequence: Synthetic oligonucleotide
gcagucaagacuucaaua

SEQ ID NO: 58686 - RNA, 18 nt, Artificial Sequence
  Description of Artificial Sequence: Synthetic oligonucleotide
uaugugcagucaagacuu

SEQ ID NO: 58687 - RNA, 18 nt, Artificial Sequence
  Description of Artificial Sequence: Synthetic oligonucleotide
cuaaauaugugcagucaa

SEQ ID NO: 58688 - RNA, 18 nt, Artificial Sequence
  Description of Artificial Sequence: Synthetic oligonucleotide
guaugcuaaauaugugca

SEQ ID NO: 58689 - RNA, 18 nt, Artificial Sequence
  Description of Artificial Sequence: Synthetic oligonucleotide
agggaguaugcuaaauau

SEQ ID NO: 58690 - RNA, 18 nt, Artificial Sequence
  Description of Artificial Sequence: Synthetic oligonucleotide
uucccagggaguaugcua

SEQ ID NO: 58691 - RNA, 18 nt, Artificial Sequence
  Description of Artificial Sequence: Synthetic oligonucleotide
uauaauucccagggagua

SEQ ID NO: 58692 - RNA, 18 nt, Artificial Sequence
  Description of Artificial Sequence: Synthetic oligonucleotide
uaaaauauaauucccagg

SEQ ID NO: 58693 - RNA, 18 nt, Artificial Sequence
  Description of Artificial Sequence: Synthetic oligonucleotide
guccuuaaaauauaauuc

SEQ ID NO: 58694 - RNA, 18 nt, Artificial Sequence
  Description of Artificial Sequence: Synthetic oligonucleotide
aaaauguccuuaaaauau

SEQ ID NO: 58695 - RNA, 18 nt, Artificial Sequence
  Description of Artificial Sequence: Synthetic oligonucleotide
auagaaaaauguccuuaa

SEQ ID NO: 58696 - RNA, 18 nt, Artificial Sequence
  Description of Artificial Sequence: Synthetic oligonucleotide
auuuaauagaaaaauguc

SEQ ID NO: 58697 - RNA, 18 nt, Artificial Sequence
  Description of Artificial Sequence: Synthetic oligonucleotide
caaugauuuaauagaaaa

SEQ ID NO: 58698 - RNA, 18 nt, Artificial Sequence
  Description of Artificial Sequence: Synthetic oligonucleotide
auaugcaaugauuuaaua

SEQ ID NO: 58699 - RNA, 18 nt, Artificial Sequence
  Description of Artificial Sequence: Synthetic oligonucleotide
cuuccauaugcaaugauu

SEQ ID NO: 58700 - RNA, 18 nt, Artificial Sequence
  Description of Artificial Sequence: Synthetic oligonucleotide
aguuucuuccauaugcaa

SEQ ID NO: 58701 - RNA, 18 nt, Artificial Sequence
  Description of Artificial Sequence: Synthetic oligonucleotide
uauugaguuucuuccaua

SEQ ID NO: 58702 - RNA, 18 nt, Artificial Sequence
  Description of Artificial Sequence: Synthetic oligonucleotide
uauuauauugaguuucuu

SEQ ID NO: 58703 - RNA, 18 nt, Artificial Sequence
  Description of Artificial Sequence: Synthetic oligonucleotide
ucagcuauuauauugagu

SEQ ID NO: 58704 - RNA, 18 nt, Artificial Sequence
  Description of Artificial Sequence: Synthetic oligonucleotide
aaauaucagcuauuauau

SEQ ID NO: 58705 - RNA, 18 nt, Artificial Sequence
  Description of Artificial Sequence: Synthetic oligonucleotide
caaguaaauaucagcuau

SEQ ID NO: 58706 - RNA, 18 nt, Artificial Sequence
  Description of Artificial Sequence: Synthetic oligonucleotide
gaacccaaguaaauauca

SEQ ID NO: 58707 - RNA, 18 nt, Artificial Sequence
  Description of Artificial Sequence: Synthetic oligonucleotide
auuaagaacccaaguaaa

SEQ ID NO: 58708 - RNA, 18 nt, Artificial Sequence
  Description of Artificial Sequence: Synthetic oligonucleotide
uucugauuaagaacccaa

SEQ ID NO: 58709 - RNA, 18 nt, Artificial Sequence
  Description of Artificial Sequence: Synthetic oligonucleotide
caauguucugauuaagaa

SEQ ID NO: 58710 - RNA, 18 nt, Artificial Sequence
  Description of Artificial Sequence: Synthetic oligonucleotide
acagccaauguucugauu

SEQ ID NO: 58711 - RNA, 18 nt, Artificial Sequence
  Description of Artificial Sequence: Synthetic oligonucleotide
aucacacagccaauguuc

SEQ ID NO: 58712 - RNA, 18 nt, Artificial Sequence
  Description of Artificial Sequence: Synthetic oligonucleotide
ugaaaaucacacagccaa

SEQ ID NO: 58713 - RNA, 18 nt, Artificial Sequence
  Description of Artificial Sequence: Synthetic oligonucleotide
aaucaugaaaaucacaca

SEQ ID NO: 58714 - RNA, 18 nt, Artificial Sequence
  Description of Artificial Sequence: Synthetic oligonucleotide
aucauaaucaugaaaauc

SEQ ID NO: 58715 - RNA, 18 nt, Artificial Sequence
  Description of Artificial Sequence: Synthetic oligonucleotide
ugaaaaucauaaucauga

SEQ ID NO: 58716 - RNA, 18 nt, Artificial Sequence
  Description of Artificial Sequence: Synthetic oligonucleotide
ugcaaugaaaaucauaau

SEQ ID NO: 58717 - RNA, 18 nt, Artificial Sequence
  Description of Artificial Sequence: Synthetic oligonucleotide
uuaauugcaaugaaaauc

SEQ ID NO: 58718 - RNA, 18 nt, Artificial Sequence
  Description of Artificial Sequence: Synthetic oligonucleotide
ucaacuuaauugcaauga

SEQ ID NO: 58719 - RNA, 18 nt, Artificial Sequence
  Description of Artificial Sequence: Synthetic oligonucleotide
aaacaucaacuuaauugc

SEQ ID NO: 58720 - RNA, 18 nt, Artificial Sequence
  Description of Artificial Sequence: Synthetic oligonucleotide
cuacaaaacaucaacuua

SEQ ID NO: 58721 - RNA, 18 nt, Artificial Sequence
  Description of Artificial Sequence: Synthetic oligonucleotide
acugucuacaaaacauca

SEQ ID NO: 58722 - RNA, 18 nt, Artificial Sequence
  Description of Artificial Sequence: Synthetic oligonucleotide
auuucacugucuacaaaa

SEQ ID NO: 58723 - RNA, 18 nt, Artificial Sequence
  Description of Artificial Sequence: Synthetic oligonucleotide
ugguaauuucacugucua

SEQ ID NO: 58724 - RNA, 18 nt, Artificial Sequence
  Description of Artificial Sequence: Synthetic oligonucleotide
guagaugguaauuucacu

SEQ ID NO: 58725 - RNA, 18 nt, Artificial Sequence
  Description of Artificial Sequence: Synthetic oligonucleotide
uuggaguagaugguaauu

SEQ ID NO: 58726 - RNA, 18 nt, Artificial Sequence
  Description of Artificial Sequence: Synthetic oligonucleotide
aucuuuuggaguagaugg

SEQ ID NO: 58727 - RNA, 18 nt, Artificial Sequence
  Description of Artificial Sequence: Synthetic oligonucleotide
uugcaaucuuuuggagua

SEQ ID NO: 58728 - RNA, 18 nt, Artificial Sequence
  Description of Artificial Sequence: Synthetic oligonucleotide
cuauuuugcaaucuuuug

SEQ ID NO: 58729 - RNA, 18 nt, Artificial Sequence
  Description of Artificial Sequence: Synthetic oligonucleotide
aaauucuauuuugcaauc

SEQ ID NO: 58730 - RNA, 18 nt, Artificial Sequence
  Description of Artificial Sequence: Synthetic oligonucleotide
agguuaaauucuauuuug

SEQ ID NO: 58731 - RNA, 18 nt, Artificial Sequence
  Description of Artificial Sequence: Synthetic oligonucleotide
cucuaagguuaaauucua

SEQ ID NO: 58732 - RNA, 18 nt, Artificial Sequence
  Description of Artificial Sequence: Synthetic oligonucleotide
auuggcucuaagguuaaa

SEQ ID NO: 58733 - RNA, 18 nt, Artificial Sequence
  Description of Artificial Sequence: Synthetic oligonucleotide
ccugcauuggcucuaagg

SEQ ID NO: 58734 - RNA, 18 nt, Artificial Sequence
  Description of Artificial Sequence: Synthetic oligonucleotide
uuuucccugcauuggcuc

SEQ ID NO: 58735 - RNA, 18 nt, Artificial Sequence
  Description of Artificial Sequence: Synthetic oligonucleotide
acaaguuuucccugcauu

SEQ ID NO: 58736 - RNA, 18 nt, Artificial Sequence
  Description of Artificial Sequence: Synthetic oligonucleotide
cagaaacaaguuuucccu

SEQ ID NO: 58737 - RNA, 18 nt, Artificial Sequence
  Description of Artificial Sequence: Synthetic oligonucleotide
accugcagaaacaaguuu

SEQ ID NO: 58738 - RNA, 18 nt, Artificial Sequence
  Description of Artificial Sequence: Synthetic oligonucleotide
aaugcaccugcagaaaca

SEQ ID NO: 58739 - RNA, 18 nt, Artificial Sequence
  Description of Artificial Sequence: Synthetic oligonucleotide
caaaaaaugcaccugcag

SEQ ID NO: 58740 - RNA, 18 nt, Artificial Sequence
  Description of Artificial Sequence: Synthetic oligonucleotide
aguuucaaaaaaugcacc

SEQ ID NO: 58741 - RNA, 18 nt, Artificial Sequence
  Description of Artificial Sequence: Synthetic oligonucleotide
guugaaguuucaaaaaau

SEQ ID NO: 58742 - RNA, 18 nt, Artificial Sequence
  Description of Artificial Sequence: Synthetic oligonucleotide
uaucuguugaaguuucaa

SEQ ID NO: 58743 - RNA, 18 nt, Artificial Sequence
  Description of Artificial Sequence: Synthetic oligonucleotide
ccugcuaucuguugaagu

SEQ ID NO: 58744 - RNA, 18 nt, Artificial Sequence
  Description of Artificial Sequence: Synthetic oligonucleotide
uucccccugcuaucuguu

SEQ ID NO: 58745 - RNA, 18 nt, Artificial Sequence
  Description of Artificial Sequence: Synthetic oligonucleotide
uuuuuuucccccugcuau

SEQ ID NO: 58746 - RNA, 18 nt, Artificial Sequence
  Description of Artificial Sequence: Synthetic oligonucleotide
ucacuuuuuuuucccccu

SEQ ID NO: 58747 - RNA, 18 nt, Artificial Sequence
  Description of Artificial Sequence: Synthetic oligonucleotide
uucugucacuuuuuuuuc

SEQ ID NO: 58748 - RNA, 18 nt, Artificial Sequence
  Description of Artificial Sequence: Synthetic oligonucleotide
gauccuucugucacuuuu

SEQ ID NO: 58749 - RNA, 18 nt, Artificial Sequence
  Description of Artificial Sequence: Synthetic oligonucleotide
acugugauccuucuguca

SEQ ID NO: 58750 - RNA, 18 nt, Artificial Sequence
  Description of Artificial Sequence: Synthetic oligonucleotide
gcugaacugugauccuuc

SEQ ID NO: 58751 - RNA, 18 nt, Artificial Sequence
  Description of Artificial Sequence: Synthetic oligonucleotide
auacugcugaacugugau

SEQ ID NO: 58752 - RNA, 18 nt, Artificial Sequence
  Description of Artificial Sequence: Synthetic oligonucleotide
aauucauacugcugaacu

SEQ ID NO: 58753 - RNA, 18 nt, Artificial Sequence
  Description of Artificial Sequence: Synthetic oligonucleotide
cagacaauucauacugcu

SEQ ID NO: 58754 - RNA, 18 nt, Artificial Sequence
  Description of Artificial Sequence: Synthetic oligonucleotide
gccagcagacaauucaua

SEQ ID NO: 58755 - RNA, 18 nt, Artificial Sequence
  Description of Artificial Sequence: Synthetic oligonucleotide
aggcugccagcagacaau

SEQ ID NO: 58756 - RNA, 18 nt, Artificial Sequence
  Description of Artificial Sequence: Synthetic oligonucleotide
uugcaaggcugccagcag

SEQ ID NO: 58757 - RNA, 18 nt, Artificial Sequence
  Description of Artificial Sequence: Synthetic oligonucleotide
ccagauugcaaggcugcc

SEQ ID NO: 58758 - RNA, 18 nt, Artificial Sequence
  Description of Artificial Sequence: Synthetic oligonucleotide
gcacaccagauugcaagg

SEQ ID NO: 58759 - RNA, 18 nt, Artificial Sequence
  Description of Artificial Sequence: Synthetic oligonucleotide
ugccugcacaccagauug

SEQ ID NO: 58760 - RNA, 18 nt, Artificial Sequence
  Description of Artificial Sequence: Synthetic oligonucleotide
cucacugccugcacacca

SEQ ID NO: 58761 - RNA, 18 nt, Artificial Sequence
  Description of Artificial Sequence: Synthetic oligonucleotide
acaaucucacugccugca

SEQ ID NO: 58762 - RNA, 18 nt, Artificial Sequence
  Description of Artificial Sequence: Synthetic oligonucleotide
acaccacaaucucacugc

SEQ ID NO: 58763 - RNA, 18 nt, Artificial Sequence
  Description of Artificial Sequence: Synthetic oligonucleotide
cauguacaccacaaucuc

SEQ ID NO: 58764 - RNA, 18 nt, Artificial Sequence
  Description of Artificial Sequence: Synthetic oligonucleotide
ggugacauguacaccaca

SEQ ID NO: 58765 - RNA, 18 nt, Artificial Sequence
  Description of Artificial Sequence: Synthetic oligonucleotide
aaucaggugacauguaca

SEQ ID NO: 58766 - RNA, 18 nt, Artificial Sequence
  Description of Artificial Sequence: Synthetic oligonucleotide
uguaguccugguggcaug

SEQ ID NO: 58767 - RNA, 18 nt, Artificial Sequence
  Description of Artificial Sequence: Synthetic oligonucleotide
gccccuguaguccuggug

SEQ ID NO: 58768 - RNA, 18 nt, Artificial Sequence
  Description of Artificial Sequence: Synthetic oligonucleotide
acucugccccuguagucc

SEQ ID NO: 58769 - RNA, 18 nt, Artificial Sequence
  Description of Artificial Sequence: Synthetic oligonucleotide
gagacacucugccccugu

SEQ ID NO: 58770 - RNA, 18 nt, Artificial Sequence
  Description of Artificial Sequence: Synthetic oligonucleotide
cagaggagacacucugcc

SEQ ID NO: 58771 - RNA, 18 nt, Artificial Sequence
  Description of Artificial Sequence: Synthetic oligonucleotide
gcugccagaggagacacu

SEQ ID NO: 58772 - RNA, 18 nt, Artificial Sequence
  Description of Artificial Sequence: Synthetic oligonucleotide
ucagagcugccagaggag

SEQ ID NO: 58773 - RNA, 18 nt, Artificial Sequence
  Description of Artificial Sequence: Synthetic oligonucleotide
ugaucucagagcugccag

SEQ ID NO: 58774 - RNA, 18 nt, Artificial Sequence
  Description of Artificial Sequence: Synthetic oligonucleotide
ggauuugaucucagagcu

SEQ ID NO: 58775 - RNA, 18 nt, Artificial Sequence
  Description of Artificial Sequence: Synthetic oligonucleotide
ucaucggauuugaucuca

SEQ ID NO: 58776 - RNA, 18 nt, Artificial Sequence
  Description of Artificial Sequence: Synthetic oligonucleotide
ccucgucaucggauuuga

SEQ ID NO: 58777 - RNA, 18 nt, Artificial Sequence
  Description of Artificial Sequence: Synthetic oligonucleotide
aucacccucgucaucgga

SEQ ID NO: 58778 - RNA, 18 nt, Artificial Sequence
  Description of Artificial Sequence: Synthetic oligonucleotide
uucucaucacccucguca

SEQ ID NO: 58779 - RNA, 18 nt, Artificial Sequence
  Description of Artificial Sequence: Synthetic oligonucleotide
gcagguucucaucacccu

SEQ ID NO: 58780 - RNA, 18 nt, Artificial Sequence
  Description of Artificial Sequence: Synthetic oligonucleotide
gucuugcagguucucauc

SEQ ID NO: 58781 - RNA, 18 nt, Artificial Sequence
  Description of Artificial Sequence: Synthetic oligonucleotide
uucgugucuugcagguuc

SEQ ID NO: 58782 - RNA, 18 nt, Artificial Sequence
  Description of Artificial Sequence: Synthetic oligonucleotide
aagauuucgugucuugca

SEQ ID NO: 58783 - RNA, 18 nt, Artificial Sequence
  Description of Artificial Sequence: Synthetic oligonucleotide
cuccgaagauuucguguc

SEQ ID NO: 58784 - RNA, 18 nt, Artificial Sequence
  Description of Artificial Sequence: Synthetic oligonucleotide
uuguccuccgaagauuuc

SEQ ID NO: 58785 - RNA, 18 nt, Artificial Sequence
  Description of Artificial Sequence: Synthetic oligonucleotide
auuucuuguccuccgaag

SEQ ID NO: 58786 - RNA, 18 nt, Artificial Sequence
  Description of Artificial Sequence: Synthetic oligonucleotide
aucuaauuucuuguccuc

SEQ ID NO: 58787 - RNA, 18 nt, Artificial Sequence
  Description of Artificial Sequence: Synthetic oligonucleotide
ucgucaucuaauuucuug

SEQ ID NO: 58788 - RNA, 18 nt, Artificial Sequence
  Description of Artificial Sequence: Synthetic oligonucleotide
ucuugucgucaucuaauu

SEQ ID NO: 58789 - RNA, 18 nt, Artificial Sequence
  Description of Artificial Sequence: Synthetic oligonucleotide
auccuucuugucgucauc

SEQ ID NO: 58790 - RNA, 18 nt, Artificial Sequence
  Description of Artificial Sequence: Synthetic oligonucleotide
uugauauccuucuugucg

SEQ ID NO: 58791 - RNA, 18 nt, Artificial Sequence
  Description of Artificial Sequence: Synthetic oligonucleotide
uugauuugauauccuucu

SEQ ID NO: 58792 - RNA, 18 nt, Artificial Sequence
  Description of Artificial Sequence: Synthetic oligonucleotide
aguaauugauuugauauc

SEQ ID NO: 58793 - RNA, 18 nt, Artificial Sequence
  Description of Artificial Sequence: Synthetic oligonucleotide
gaccuaguaauugauuug

SEQ ID NO: 58794 - RNA, 18 nt, Artificial Sequence
  Description of Artificial Sequence: Synthetic oligonucleotide
aucuugaccuaguaauug

SEQ ID NO: 58795 - RNA, 18 nt, Artificial Sequence
  Description of Artificial Sequence: Synthetic oligonucleotide
uucacgauggguccccac

SEQ ID NO: 58796 - RNA, 18 nt, Artificial Sequence
  Description of Artificial Sequence: Synthetic oligonucleotide
ccaucuucacgauggguc

SEQ ID NO: 58797 - RNA, 18 nt, Artificial Sequence
  Description of Artificial Sequence: Synthetic oligonucleotide
ccacgccaucuucacgau

SEQ ID NO: 58798 - RNA, 18 nt, Artificial Sequence
  Description of Artificial Sequence: Synthetic oligonucleotide
cagggccacgccaucuuc

SEQ ID NO: 58799 - RNA, 18 nt, Artificial Sequence
  Description of Artificial Sequence: Synthetic oligonucleotide
ccucucagggccacgcca

SEQ ID NO: 58800 - RNA, 18 nt, Artificial Sequence
  Description of Artificial Sequence: Synthetic oligonucleotide
ggcugccucucagggcca

SEQ ID NO: 58801 - RNA, 18 nt, Artificial Sequence
  Description of Artificial Sequence: Synthetic oligonucleotide
agaauggcugccucucag

SEQ ID NO: 58802 - RNA, 18 nt, Artificial Sequence
  Description of Artificial Sequence: Synthetic oligonucleotide
agaagagaauggcugccu

SEQ ID NO: 58803 - RNA, 18 nt, Artificial Sequence
  Description of Artificial Sequence: Synthetic oligonucleotide
uuggcagaagagaauggc

SEQ ID NO: 58804 - RNA, 18 nt, Artificial Sequence
  Description of Artificial Sequence: Synthetic oligonucleotide
cugguuuggcagaagaga

SEQ ID NO: 58805 - RNA, 18 nt, Artificial Sequence
  Description of Artificial Sequence: Synthetic oligonucleotide
ggaaccugguuuggcaga

SEQ ID NO: 58806 - RNA, 18 nt, Artificial Sequence
  Description of Artificial Sequence: Synthetic oligonucleotide
gaaccggaaccugguuug

SEQ ID NO: 58807 - RNA, 18 nt, Artificial Sequence
  Description of Artificial Sequence: Synthetic oligonucleotide
cuguggaaccggaaccug

SEQ ID NO: 58808 - RNA, 18 nt, Artificial Sequence
  Description of Artificial Sequence: Synthetic oligonucleotide
ggaagcuguggaaccgga

SEQ ID NO: 58809 - RNA, 18 nt, Artificial Sequence
  Description of Artificial Sequence: Synthetic oligonucleotide
ggacaggaagcuguggaa

SEQ ID NO: 58810 - RNA, 18 nt, Artificial Sequence
  Description of Artificial Sequence: Synthetic oligonucleotide
agacuggacaggaagcug

SEQ ID NO: 58811 - RNA, 18 nt, Artificial Sequence
  Description of Artificial Sequence: Synthetic oligonucleotide
gucgcagacuggacagga

SEQ ID NO: 58812 - RNA, 18 nt, Artificial Sequence
  Description of Artificial Sequence: Synthetic oligonucleotide
gggaagucgcagacugga

SEQ ID NO: 58813 - RNA, 18 nt, Artificial Sequence
  Description of Artificial Sequence: Synthetic oligonucleotide
gguggguucaggucaggg

SEQ ID NO: 58814 - RNA, 18 nt, Artificial Sequence
  Description of Artificial Sequence: Synthetic oligonucleotide
ggguggguucaggucagg

SEQ ID NO: 58815 - RNA, 18 nt, Artificial Sequence
  Description of Artificial Sequence: Synthetic oligonucleotide
cucuguaaggguccuggg

SEQ ID NO: 58816 - RNA, 18 nt, Artificial Sequence
  Description of Artificial Sequence: Synthetic oligonucleotide
gugcccuggugaggccaa

SEQ ID NO: 58817 - RNA, 18 nt, Artificial Sequence
  Description of Artificial Sequence: Synthetic oligonucleotide
cagaagugcccuggugag

SEQ ID NO: 58818 - RNA, 18 nt, Artificial Sequence
  Description of Artificial Sequence: Synthetic oligonucleotide
gaggucagaagugcccug

SEQ ID NO: 58819 - RNA, 18 nt, Artificial Sequence
  Description of Artificial Sequence: Synthetic oligonucleotide
aaagugaggucagaagug

SEQ ID NO: 58820 - RNA, 18 nt, Artificial Sequence
  Description of Artificial Sequence: Synthetic oligonucleotide
uugugaaagugaggucag

SEQ ID NO: 58821 - RNA, 18 nt, Artificial Sequence
  Description of Artificial Sequence: Synthetic oligonucleotide
uccuauugugaaagugag

SEQ ID NO: 58822 - RNA, 18 nt, Artificial Sequence
  Description of Artificial Sequence: Synthetic oligonucleotide
acugguccuauugugaaa

SEQ ID NO: 58823 - RNA, 18 nt, Artificial Sequence
  Description of Artificial Sequence: Synthetic oligonucleotide
ucaacacugguccuauug

SEQ ID NO: 58824 - RNA, 18 nt, Artificial Sequence
  Description of Artificial Sequence: Synthetic oligonucleotide
ggguaucaacacuggucc

SEQ ID NO: 58825 - RNA, 18 nt, Artificial Sequence
  Description of Artificial Sequence: Synthetic oligonucleotide
aggcuggguaucaacacu

SEQ ID NO: 58826 - RNA, 18 nt, Artificial Sequence
  Description of Artificial Sequence: Synthetic oligonucleotide
ccaagaggcuggguauca

SEQ ID NO: 58827 - RNA, 18 nt, Artificial Sequence
  Description of Artificial Sequence: Synthetic oligonucleotide
gaacaccaagaggcuggg

SEQ ID NO: 58828 - RNA, 18 nt, Artificial Sequence
  Description of Artificial Sequence: Synthetic oligonucleotide
gggaugaacaccaagagg

SEQ ID NO: 58829 - RNA, 18 nt, Artificial Sequence
  Description of Artificial Sequence: Synthetic oligonucleotide
cuugagggaugaacacca

SEQ ID NO: 58830 - RNA, 18 nt, Artificial Sequence
  Description of Artificial Sequence: Synthetic oligonucleotide
ugcuucuugagggaugaa

SEQ ID NO: 58831 - RNA, 18 nt, Artificial Sequence
  Description of Artificial Sequence: Synthetic oligonucleotide
gccagugcuucuugaggg

SEQ ID NO: 58832 - RNA, 18 nt, Artificial Sequence
  Description of Artificial Sequence: Synthetic oligonucleotide
uuucugccagugcuucuu

SEQ ID NO: 58833 - RNA, 18 nt, Artificial Sequence
  Description of Artificial Sequence: Synthetic oligonucleotide
cuggguuucugccagugc

SEQ ID NO: 58834 - RNA, 18 nt, Artificial Sequence
  Description of Artificial Sequence: Synthetic oligonucleotide
gauuccuggguuucugcc

SEQ ID NO: 58835 - RNA, 18 nt, Artificial Sequence
  Description of Artificial Sequence: Synthetic oligonucleotide
aauuugauuccuggguuu

SEQ ID NO: 58836 - RNA, 18 nt, Artificial Sequence
  Description of Artificial Sequence: Synthetic oligonucleotide
ugcccaauuugauuccug

SEQ ID NO: 58837 - RNA, 18 nt, Artificial Sequence
  Description of Artificial Sequence: Synthetic oligonucleotide
uuuugugcccaauuugau

SEQ ID NO: 58838 - RNA, 18 nt, Artificial Sequence
  Description of Artificial Sequence: Synthetic oligonucleotide
accauuuuugugcccaau

SEQ ID NO: 58839 - RNA, 18 nt, Artificial Sequence
  Description of Artificial Sequence: Synthetic oligonucleotide
uccuuaccauuuuugugc

SEQ ID NO: 58840 - RNA, 18 nt, Artificial Sequence
  Description of Artificial Sequence: Synthetic oligonucleotide
ccauuuccuuaccauuuu

SEQ ID NO: 58841 - RNA, 18 nt, Artificial Sequence
  Description of Artificial Sequence: Synthetic oligonucleotide
cuuugccauuuccuuacc

SEQ ID NO: 58842 - RNA, 18 nt, Artificial Sequence
  Description of Artificial Sequence: Synthetic oligonucleotide
aaauacuuugccauuucc

SEQ ID NO: 58843 - RNA, 18 nt, Artificial Sequence
  Description of Artificial Sequence: Synthetic oligonucleotide
guucuaaauacuuugcca

SEQ ID NO: 58844 - RNA, 18 nt, Artificial Sequence
  Description of Artificial Sequence: Synthetic oligonucleotide
gcgaaguucuaaauacuu

SEQ ID NO: 58845 - RNA, 18 nt, Artificial Sequence
  Description of Artificial Sequence: Synthetic oligonucleotide
agcgggcgaaguucuaaa

SEQ ID NO: 58846 - RNA, 18 nt, Artificial Sequence
  Description of Artificial Sequence: Synthetic oligonucleotide
caauuagcgggcgaaguu

SEQ ID NO: 58847 - RNA, 18 nt, Artificial Sequence
  Description of Artificial Sequence: Synthetic oligonucleotide
aaacacaauuagcgggcg

SEQ ID NO: 58848 - RNA, 18 nt, Artificial Sequence
  Description of Artificial Sequence: Synthetic oligonucleotide
uggagaaacacaauuagc

SEQ ID NO: 58849 - RNA, 18 nt, Artificial Sequence
  Description of Artificial Sequence: Synthetic oligonucleotide
gucccuggagaaacacaa

SEQ ID NO: 58850 - RNA, 18 nt, Artificial Sequence
  Description of Artificial Sequence: Synthetic oligonucleotide
aaacagucccuggagaaa

SEQ ID NO: 58851 - RNA, 18 nt, Artificial Sequence
  Description of Artificial Sequence: Synthetic oligonucleotide
gaggaaaacagucccugg

SEQ ID NO: 58852 - RNA, 18 nt, Artificial Sequence
  Description of Artificial Sequence: Synthetic oligonucleotide
uguuugaggaaaacaguc

SEQ ID NO: 58853 - RNA, 18 nt, Artificial Sequence
  Description of Artificial Sequence: Synthetic oligonucleotide
gaggauguuugaggaaaa

SEQ ID NO: 58854 - RNA, 18 nt, Artificial Sequence
  Description of Artificial Sequence: Synthetic oligonucleotide
uuucagaggauguuugag

SEQ ID NO: 58855 - RNA, 18 nt, Artificial Sequence
  Description of Artificial Sequence: Synthetic oligonucleotide
caggauuucagaggaugu

SEQ ID NO: 58856 - RNA, 18 nt, Artificial Sequence
  Description of Artificial Sequence: Synthetic oligonucleotide
aggaccaggauuucagag

SEQ ID NO: 58857 - RNA, 18 nt, Artificial Sequence
  Description of Artificial Sequence: Synthetic oligonucleotide
gauauaggaccaggauuu

SEQ ID NO: 58858 - RNA, 18 nt, Artificial Sequence
  Description of Artificial Sequence: Synthetic oligonucleotide
cugcugauauaggaccag

SEQ ID NO: 58859 - RNA, 18 nt, Artificial Sequence
  Description of Artificial Sequence: Synthetic oligonucleotide
auucccugcugauauagg

SEQ ID NO: 58860 - RNA, 18 nt, Artificial Sequence
  Description of Artificial Sequence: Synthetic oligonucleotide
gccucauucccugcugau

SEQ ID NO: 58861 - RNA, 18 nt, Artificial Sequence
  Description of Artificial Sequence: Synthetic oligonucleotide
cuguggccucauucccug

SEQ ID NO: 58862 - RNA, 18 nt, Artificial Sequence
  Description of Artificial Sequence: Synthetic oligonucleotide
ucagucuguggccucauu

SEQ ID NO: 58863 - RNA, 18 nt, Artificial Sequence
  Description of Artificial Sequence: Synthetic oligonucleotide
ucucaucagucuguggcc

SEQ ID NO: 58864 - RNA, 18 nt, Artificial Sequence
  Description of Artificial Sequence: Synthetic oligonucleotide
uuuccucucaucagucug

SEQ ID NO: 58865 - RNA, 18 nt, Artificial Sequence
  Description of Artificial Sequence: Synthetic oligonucleotide
uaaaauuuccucucauca

SEQ ID NO: 58866 - RNA, 18 nt, Artificial Sequence
  Description of Artificial Sequence: Synthetic oligonucleotide
uaaaauaaaauuuccucu

SEQ ID NO: 58867 - RNA, 18 nt, Artificial Sequence
  Description of Artificial Sequence: Synthetic oligonucleotide
auagcuaaaauaaaauuu

SEQ ID NO: 58868 - RNA, 18 nt, Artificial Sequence
  Description of Artificial Sequence: Synthetic oligonucleotide
uggaaauagcuaaaauaa

SEQ ID NO: 58869 - RNA, 18 nt, Artificial Sequence
  Description of Artificial Sequence: Synthetic oligonucleotide
aaauguggaaauagcuaa

SEQ ID NO: 58870 - RNA, 18 nt, Artificial Sequence
  Description of Artificial Sequence: Synthetic oligonucleotide
gagaaaaauguggaaaua

SEQ ID NO: 58871 - RNA, 18 nt, Artificial Sequence
  Description of Artificial Sequence: Synthetic oligonucleotide
ugaaugagaaaaaugugg

SEQ ID NO: 58872 - RNA, 18 nt, Artificial Sequence
  Description of Artificial Sequence: Synthetic oligonucleotide
ggaccugaaugagaaaaa

SEQ ID NO: 58873 - RNA, 18 nt, Artificial Sequence
  Description of Artificial Sequence: Synthetic oligonucleotide
uuagaggaccugaaugag

SEQ ID NO: 58874 - RNA, 18 nt, Artificial Sequence
  Description of Artificial Sequence: Synthetic oligonucleotide
ccacauuagaggaccuga

SEQ ID NO: 58875 - RNA, 18 nt, Artificial Sequence
  Description of Artificial Sequence: Synthetic oligonucleotide
acuaaccacauuagagga

SEQ ID NO: 58876 - RNA, 18 nt, Artificial Sequence
  Description of Artificial Sequence: Synthetic oligonucleotide
ccacaacuaaccacauua

SEQ ID NO: 58877 - RNA, 18 nt, Artificial Sequence
  Description of Artificial Sequence: Synthetic oligonucleotide
ucaggccacaacuaacca

SEQ ID NO: 58878 - RNA, 18 nt, Artificial Sequence
  Description of Artificial Sequence: Synthetic oligonucleotide
cauuuucaggccacaacu

SEQ ID NO: 58879 - RNA, 18 nt, Artificial Sequence
  Description of Artificial Sequence: Synthetic oligonucleotide
aauaucauuuucaggcca

SEQ ID NO: 58880 - RNA, 18 nt, Artificial Sequence
  Description of Artificial Sequence: Synthetic oligonucleotide
uuggaaauaucauuuuca

SEQ ID NO: 58881 - RNA, 18 nt, Artificial Sequence
  Description of Artificial Sequence: Synthetic oligonucleotide
uucauuuggaaauaucau

SEQ ID NO: 58882 - RNA, 18 nt, Artificial Sequence
  Description of Artificial Sequence: Synthetic oligonucleotide
uccuauucauuuggaaau

SEQ ID NO: 58883 - RNA, 18 nt, Artificial Sequence
  Description of Artificial Sequence: Synthetic oligonucleotide
uuccuuccuauucauuug

SEQ ID NO: 58884 - RNA, 18 nt, Artificial Sequence
  Description of Artificial Sequence: Synthetic oligonucleotide
uuuccuuccuuccuauuc

SEQ ID NO: 58885 - RNA, 18 nt, Artificial Sequence
  Description of Artificial Sequence: Synthetic oligonucleotide
aacaauuuccuuccuucc

SEQ ID NO: 58886 - RNA, 18 nt, Artificial Sequence
  Description of Artificial Sequence: Synthetic oligonucleotide
acaaaaacaauuuccuuc

SEQ ID NO: 58887 - RNA, 18 nt, Artificial Sequence
  Description of Artificial Sequence: Synthetic oligonucleotide
aaacaacaaaaacaauuu

SEQ ID NO: 58888 - RNA, 18 nt, Artificial Sequence
  Description of Artificial Sequence: Synthetic oligonucleotide
aucuuaaacaacaaaaac

SEQ ID NO: 58889 - RNA, 18 nt, Artificial Sequence
  Description of Artificial Sequence: Synthetic oligonucleotide
cuuccaucuuaaacaaca

SEQ ID NO: 58890 - RNA, 18 nt, Artificial Sequence
  Description of Artificial Sequence: Synthetic oligonucleotide
auuuccuuccaucuuaaa

SEQ ID NO: 58891 - RNA, 18 nt, Artificial Sequence
  Description of Artificial Sequence: Synthetic oligonucleotide
ccuauauuuccuuccauc

SEQ ID NO: 58892 - RNA, 18 nt, Artificial Sequence
  Description of Artificial Sequence: Synthetic oligonucleotide
augcaccuauauuuccuu

SEQ ID NO: 58893 - RNA, 18 nt, Artificial Sequence
  Description of Artificial Sequence: Synthetic oligonucleotide
uuuaaaugcaccuauauu

SEQ ID NO: 58894 - RNA, 18 nt, Artificial Sequence
  Description of Artificial Sequence: Synthetic oligonucleotide
cauuuuuuaaaugcaccu

SEQ ID NO: 58895 - RNA, 18 nt, Artificial Sequence
  Description of Artificial Sequence: Synthetic oligonucleotide
agcuccauuuuuuaaaug

SEQ ID NO: 58896 - RNA, 18 nt, Artificial Sequence
  Description of Artificial Sequence: Synthetic oligonucleotide
aaccaagcuccauuuuuu

SEQ ID NO: 58897 - RNA, 18 nt, Artificial Sequence
  Description of Artificial Sequence: Synthetic oligonucleotide
caugcaaccaagcuccau

SEQ ID NO: 58898 - RNA, 18 nt, Artificial Sequence
  Description of Artificial Sequence: Synthetic oligonucleotide
aaaaucaugcaaccaagc

SEQ ID NO: 58899 - RNA, 18 nt, Artificial Sequence
  Description of Artificial Sequence: Synthetic oligonucleotide
gagcgaaaaucaugcaac

SEQ ID NO: 58900 - RNA, 18 nt, Artificial Sequence
  Description of Artificial Sequence: Synthetic oligonucleotide
cucaagagcgaaaaucau

SEQ ID NO: 58901 - RNA, 18 nt, Artificial Sequence
  Description of Artificial Sequence: Synthetic oligonucleotide
gaugacucaagagcgaaa

SEQ ID NO: 58902 - RNA, 18 nt, Artificial Sequence
  Description of Artificial Sequence: Synthetic oligonucleotide
ggcuagaugacucaagag

SEQ ID NO: 58903 - RNA, 18 nt, Artificial Sequence
  Description of Artificial Sequence: Synthetic oligonucleotide
uagagggcuagaugacuc

SEQ ID NO: 58904 - RNA, 18 nt, Artificial Sequence
  Description of Artificial Sequence: Synthetic oligonucleotide
aucauuagagggcuagau

SEQ ID NO: 58905 - RNA, 18 nt, Artificial Sequence
  Description of Artificial Sequence: Synthetic oligonucleotide
aggcaaucauuagagggc

SEQ ID NO: 58906 - RNA, 18 nt, Artificial Sequence
  Description of Artificial Sequence: Synthetic oligonucleotide
guaugaggcaaucauuag

SEQ ID NO: 58907 - RNA, 18 nt, Artificial Sequence
  Description of Artificial Sequence: Synthetic oligonucleotide
caccgguaugaggcaauc

SEQ ID NO: 58908 - RNA, 18 nt, Artificial Sequence
  Description of Artificial Sequence: Synthetic oligonucleotide
guaaucaccgguaugagg

SEQ ID NO: 58909 - RNA, 18 nt, Artificial Sequence
  Description of Artificial Sequence: Synthetic oligonucleotide
cgcucguaaucaccggua

SEQ ID NO: 58910 - RNA, 18 nt, Artificial Sequence
  Description of Artificial Sequence: Synthetic oligonucleotide
aaagccgcucguaaucac

SEQ ID NO: 58911 - RNA, 18 nt, Artificial Sequence
  Description of Artificial Sequence: Synthetic oligonucleotide
caugaaaagccgcucgua

SEQ ID NO: 58912 - RNA, 18 nt, Artificial Sequence
  Description of Artificial Sequence: Synthetic oligonucleotide
gggucaugaaaagccgcu

SEQ ID NO: 58913 - RNA, 18 nt, Artificial Sequence
  Description of Artificial Sequence: Synthetic oligonucleotide
aaaugguacauauggaag

SEQ ID NO: 58914 - RNA, 18 nt, Artificial Sequence
  Description of Artificial Sequence: Synthetic oligonucleotide
uuuuaaaaugguacauau

SEQ ID NO: 58915 - RNA, 18 nt, Artificial Sequence
  Description of Artificial Sequence: Synthetic oligonucleotide
cagcauuuuaaaauggua

SEQ ID NO: 58916 - RNA, 18 nt, Artificial Sequence
  Description of Artificial Sequence: Synthetic oligonucleotide
guaaucagcauuuuaaaa

SEQ ID NO: 58917 - RNA, 18 nt, Artificial Sequence
  Description of Artificial Sequence: Synthetic oligonucleotide
aagaaguaaucagcauuu

SEQ ID NO: 58918 - RNA, 18 nt, Artificial Sequence
  Description of Artificial Sequence: Synthetic oligonucleotide
uucucaagaaguaaucag

SEQ ID NO: 58919 - RNA, 18 nt, Artificial Sequence
  Description of Artificial Sequence: Synthetic oligonucleotide
ucuuauucucaagaagua

SEQ ID NO: 58920 - RNA, 18 nt, Artificial Sequence
  Description of Artificial Sequence: Synthetic oligonucleotide
gcuucucuuauucucaag

SEQ ID NO: 58921 - RNA, 18 nt, Artificial Sequence
  Description of Artificial Sequence: Synthetic oligonucleotide
auuaggcuucucuuauuc

SEQ ID NO: 58922 - RNA, 18 nt, Artificial Sequence
  Description of Artificial Sequence: Synthetic oligonucleotide
cugaaauuaggcuucucu

SEQ ID NO: 58923 - RNA, 18 nt, Artificial Sequence
  Description of Artificial Sequence: Synthetic oligonucleotide
auauucugaaauuaggcu

SEQ ID NO: 58924 - RNA, 18 nt, Artificial Sequence
  Description of Artificial Sequence: Synthetic oligonucleotide
uaaugauauucugaaauu

SEQ ID NO: 58925 - RNA, 18 nt, Artificial Sequence
  Description of Artificial Sequence: Synthetic oligonucleotide
uacccuaaugauauucug

SEQ ID NO: 58926 - RNA, 18 nt, Artificial Sequence
  Description of Artificial Sequence: Synthetic oligonucleotide
auagguacccuaaugaua

SEQ ID NO: 58927 - RNA, 18 nt, Artificial Sequence
  Description of Artificial Sequence: Synthetic oligonucleotide
cuucaauagguacccuaa

SEQ ID NO: 58928 - RNA, 18 nt, Artificial Sequence
  Description of Artificial Sequence: Synthetic oligonucleotide
caagacuucaauagguac

SEQ ID NO: 58929 - RNA, 18 nt, Artificial Sequence
  Description of Artificial Sequence: Synthetic oligonucleotide
gcagucaagacuucaaua

SEQ ID NO: 58930 - RNA, 18 nt, Artificial Sequence
  Description of Artificial Sequence: Synthetic oligonucleotide
uaugugcagucaagacuu

SEQ ID NO: 58931 - RNA, 18 nt, Artificial Sequence
  Description of Artificial Sequence: Synthetic oligonucleotide
cuaaauaugugcagucaa

SEQ ID NO: 58932 - RNA, 18 nt, Artificial Sequence
  Description of Artificial Sequence: Synthetic oligonucleotide
guaugcuaaauaugugca

SEQ ID NO: 58933 - RNA, 18 nt, Artificial Sequence
  Description of Artificial Sequence: Synthetic oligonucleotide
agggaguaugcuaaauau

SEQ ID NO: 58934 - RNA, 18 nt, Artificial Sequence
  Description of Artificial Sequence: Synthetic oligonucleotide
uucccagggaguaugcua

SEQ ID NO: 58935 - RNA, 18 nt, Artificial Sequence
  Description of Artificial Sequence: Synthetic oligonucleotide
uauaauucccagggagua

SEQ ID NO: 58936 - RNA, 18 nt, Artificial Sequence
  Description of Artificial Sequence: Synthetic oligonucleotide
uaaaauauaauucccagg

SEQ ID NO: 58937 - RNA, 18 nt, Artificial Sequence
  Description of Artificial Sequence: Synthetic oligonucleotide
guccuuaaaauauaauuc

SEQ ID NO: 58938 - RNA, 18 nt, Artificial Sequence
  Description of Artificial Sequence: Synthetic oligonucleotide
aaaauguccuuaaaauau

SEQ ID NO: 58939 - RNA, 18 nt, Artificial Sequence
  Description of Artificial Sequence: Synthetic oligonucleotide
auagaaaaauguccuuaa

SEQ ID NO: 58940 - RNA, 18 nt, Artificial Sequence
  Description of Artificial Sequence: Synthetic oligonucleotide
auuuaauagaaaaauguc

SEQ ID NO: 58941 - RNA, 18 nt, Artificial Sequence
  Description of Artificial Sequence: Synthetic oligonucleotide
caaugauuuaauagaaaa

SEQ ID NO: 58942 - RNA, 18 nt, Artificial Sequence
  Description of Artificial Sequence: Synthetic oligonucleotide
auaugcaaugauuuaaua

SEQ ID NO: 58943 - RNA, 18 nt, Artificial Sequence
  Description of Artificial Sequence: Synthetic oligonucleotide
cuuccauaugcaaugauu

SEQ ID NO: 58944 - RNA, 18 nt, Artificial Sequence
  Description of Artificial Sequence: Synthetic oligonucleotide
aguuucuuccauaugcaa

SEQ ID NO: 58945 - RNA, 18 nt, Artificial Sequence
  Description of Artificial Sequence: Synthetic oligonucleotide
uauugaguuucuuccaua

SEQ ID NO: 58946 - RNA, 18 nt, Artificial Sequence
  Description of Artificial Sequence: Synthetic oligonucleotide
uauuauauugaguuucuu

SEQ ID NO: 58947 - RNA, 18 nt, Artificial Sequence
  Description of Artificial Sequence: Synthetic oligonucleotide
ucagcuauuauauugagu

SEQ ID NO: 58948 - RNA, 18 nt, Artificial Sequence
  Description of Artificial Sequence: Synthetic oligonucleotide
aaauaucagcuauuauau

SEQ ID NO: 58949 - RNA, 18 nt, Artificial Sequence
  Description of Artificial Sequence: Synthetic oligonucleotide
caaguaaauaucagcuau

SEQ ID NO: 58950 - RNA, 18 nt, Artificial Sequence
  Description of Artificial Sequence: Synthetic oligonucleotide
gaacccaaguaaauauca

SEQ ID NO: 58951 - RNA, 18 nt, Artificial Sequence
  Description of Artificial Sequence: Synthetic oligonucleotide
auuaagaacccaaguaaa

SEQ ID NO: 58952 - RNA, 18 nt, Artificial Sequence
  Description of Artificial Sequence: Synthetic oligonucleotide
uucugauuaagaacccaa

SEQ ID NO: 58953 - RNA, 18 nt, Artificial Sequence
  Description of Artificial Sequence: Synthetic oligonucleotide
caauguucugauuaagaa

SEQ ID NO: 58954 - RNA, 18 nt, Artificial Sequence
  Description of Artificial Sequence: Synthetic oligonucleotide
acagccaauguucugauu

SEQ ID NO: 58955 - RNA, 18 nt, Artificial Sequence
  Description of Artificial Sequence: Synthetic oligonucleotide
aucacacagccaauguuc

SEQ ID NO: 58956 - RNA, 18 nt, Artificial Sequence
  Description of Artificial Sequence: Synthetic oligonucleotide
ugaaaaucacacagccaa

SEQ ID NO: 58957 - RNA, 18 nt, Artificial Sequence
  Description of Artificial Sequence: Synthetic oligonucleotide
aaucaugaaaaucacaca

SEQ ID NO: 58958 - RNA, 18 nt, Artificial Sequence
  Description of Artificial Sequence: Synthetic oligonucleotide
aucauaaucaugaaaauc

SEQ ID NO: 58959 - RNA, 18 nt, Artificial Sequence
  Description of Artificial Sequence: Synthetic oligonucleotide
ugaaaaucauaaucauga

SEQ ID NO: 58960 - RNA, 18 nt, Artificial Sequence
  Description of Artificial Sequence: Synthetic oligonucleotide
ugcaaugaaaaucauaau

SEQ ID NO: 58961 - RNA, 18 nt, Artificial Sequence
  Description of Artificial Sequence: Synthetic oligonucleotide
uuaauugcaaugaaaauc

SEQ ID NO: 58962 - RNA, 18 nt, Artificial Sequence
  Description of Artificial Sequence: Synthetic oligonucleotide
ucaacuuaauugcaauga

SEQ ID NO: 58963 - RNA, 18 nt, Artificial Sequence
  Description of Artificial Sequence: Synthetic oligonucleotide
aaacaucaacuuaauugc

SEQ ID NO: 58964 - RNA, 18 nt, Artificial Sequence
  Description of Artificial Sequence: Synthetic oligonucleotide
cuacaaaacaucaacuua

SEQ ID NO: 58965 - RNA, 18 nt, Artificial Sequence
  Description of Artificial Sequence: Synthetic oligonucleotide
acugucuacaaaacauca

SEQ ID NO: 58966 - RNA, 18 nt, Artificial Sequence
  Description of Artificial Sequence: Synthetic oligonucleotide
auuucacugucuacaaaa

SEQ ID NO: 58967 - RNA, 18 nt, Artificial Sequence
  Description of Artificial Sequence: Synthetic oligonucleotide
ugguaauuucacugucua

SEQ ID NO: 58968 - RNA, 18 nt, Artificial Sequence
  Description of Artificial Sequence: Synthetic oligonucleotide
guagaugguaauuucacu

SEQ ID NO: 58969 - RNA, 18 nt, Artificial Sequence
  Description of Artificial Sequence: Synthetic oligonucleotide
uuggaguagaugguaauu

SEQ ID NO: 58970 - RNA, 18 nt, Artificial Sequence
  Description of Artificial Sequence: Synthetic oligonucleotide
aucuuuuggaguagaugg

SEQ ID NO: 58971 - RNA, 18 nt, Artificial Sequence
  Description of Artificial Sequence: Synthetic oligonucleotide
uugcaaucuuuuggagua

SEQ ID NO: 58972 - RNA, 18 nt, Artificial Sequence
  Description of Artificial Sequence: Synthetic oligonucleotide
cuauuuugcaaucuuuug

SEQ ID NO: 58973 - RNA, 18 nt, Artificial Sequence
  Description of Artificial Sequence: Synthetic oligonucleotide
aaauucuauuuugcaauc

SEQ ID NO: 58974 - RNA, 18 nt, Artificial Sequence
  Description of Artificial Sequence: Synthetic oligonucleotide
agguuaaauucuauuuug

SEQ ID NO: 58975 - RNA, 18 nt, Artificial Sequence
  Description of Artificial Sequence: Synthetic oligonucleotide
cucuaagguuaaauucua

SEQ ID NO: 58976 - RNA, 18 nt, Artificial Sequence
  Description of Artificial Sequence: Synthetic oligonucleotide
auuggcucuaagguuaaa

SEQ ID NO: 58977 - RNA, 18 nt, Artificial Sequence
  Description of Artificial Sequence: Synthetic oligonucleotide
ccugcauuggcucuaagg

SEQ ID NO: 58978 - RNA, 18 nt, Artificial Sequence
  Description of Artificial Sequence: Synthetic oligonucleotide
uuuucccugcauuggcuc

SEQ ID NO: 58979 - RNA, 18 nt, Artificial Sequence
  Description of Artificial Sequence: Synthetic oligonucleotide
acaaguuuucccugcauu

SEQ ID NO: 58980 - RNA, 18 nt, Artificial Sequence
  Description of Artificial Sequence: Synthetic oligonucleotide
cagaaacaaguuuucccu

SEQ ID NO: 58981 - RNA, 18 nt, Artificial Sequence
  Description of Artificial Sequence: Synthetic oligonucleotide
accugcagaaacaaguuu

SEQ ID NO: 58982 - RNA, 18 nt, Artificial Sequence
  Description of Artificial Sequence: Synthetic oligonucleotide
aaugcaccugcagaaaca

SEQ ID NO: 58983 - RNA, 18 nt, Artificial Sequence
  Description of Artificial Sequence: Synthetic oligonucleotide
caaaaaaugcaccugcag

SEQ ID NO: 58984 - RNA, 18 nt, Artificial Sequence
  Description of Artificial Sequence: Synthetic oligonucleotide
aguuucaaaaaaugcacc

SEQ ID NO: 58985 - RNA, 18 nt, Artificial Sequence
  Description of Artificial Sequence: Synthetic oligonucleotide
guugaaguuucaaaaaau

SEQ ID NO: 58986 - RNA, 18 nt, Artificial Sequence
  Description of Artificial Sequence: Synthetic oligonucleotide
uaucuguugaaguuucaa

SEQ ID NO: 58987 - RNA, 18 nt, Artificial Sequence
  Description of Artificial Sequence: Synthetic oligonucleotide
ccugcuaucuguugaagu

SEQ ID NO: 58988 - RNA, 18 nt, Artificial Sequence
  Description of Artificial Sequence: Synthetic oligonucleotide
uucccccugcuaucuguu

SEQ ID NO: 58989 - RNA, 18 nt, Artificial Sequence
  Description of Artificial Sequence: Synthetic oligonucleotide
uuuuuuucccccugcuau

SEQ ID NO: 58990 - RNA, 18 nt, Artificial Sequence
  Description of Artificial Sequence: Synthetic oligonucleotide
ucacuuuuuuuucccccu

SEQ ID NO: 58991 - RNA, 18 nt, Artificial Sequence
  Description of Artificial Sequence: Synthetic oligonucleotide
uucugucacuuuuuuuuc

SEQ ID NO: 58992 - RNA, 18 nt, Artificial Sequence
  Description of Artificial Sequence: Synthetic oligonucleotide
gauccuucugucacuuuu

SEQ ID NO: 58993 - RNA, 18 nt, Artificial Sequence
  Description of Artificial Sequence: Synthetic oligonucleotide
acugugauccuucuguca

SEQ ID NO: 58994 - RNA, 18 nt, Artificial Sequence
  Description of Artificial Sequence: Synthetic oligonucleotide
gcugaacugugauccuuc

SEQ ID NO: 58995 - RNA, 18 nt, Artificial Sequence
  Description of Artificial Sequence: Synthetic oligonucleotide
auacugcugaacugugau

SEQ ID NO: 58996 - RNA, 18 nt, Artificial Sequence
  Description of Artificial Sequence: Synthetic oligonucleotide
aauucauacugcugaacu

SEQ ID NO: 58997 - RNA, 18 nt, Artificial Sequence
  Description of Artificial Sequence: Synthetic oligonucleotide
cagacaauucauacugcu

SEQ ID NO: 58998 - RNA, 18 nt, Artificial Sequence
  Description of Artificial Sequence: Synthetic oligonucleotide
gccagcagacaauucaua

SEQ ID NO: 58999 - RNA, 18 nt, Artificial Sequence
  Description of Artificial Sequence: Synthetic oligonucleotide
aggcugccagcagacaau

SEQ ID NO: 59000 - RNA, 18 nt, Artificial Sequence
  Description of Artificial Sequence: Synthetic oligonucleotide
uugcaaggcugccagcag

SEQ ID NO: 59001 - RNA, 18 nt, Artificial Sequence
  Description of Artificial Sequence: Synthetic oligonucleotide
ccagauugcaaggcugcc

SEQ ID NO: 59002 - RNA, 18 nt, Artificial Sequence
  Description of Artificial Sequence: Synthetic oligonucleotide
gcacaccagauugcaagg

SEQ ID NO: 59003 - RNA, 18 nt, Artificial Sequence
  Description of Artificial Sequence: Synthetic oligonucleotide
ugccugcacaccagauug

SEQ ID NO: 59004 - RNA, 18 nt, Artificial Sequence
  Description of Artificial Sequence: Synthetic oligonucleotide
cucacugccugcacacca

SEQ ID NO: 59005 - RNA, 18 nt, Artificial Sequence
  Description of Artificial Sequence: Synthetic oligonucleotide
acaaucucacugccugca

SEQ ID NO: 59006 - RNA, 18 nt, Artificial Sequence
  Description of Artificial Sequence: Synthetic oligonucleotide
acaccacaaucucacugc

SEQ ID NO: 59007 - RNA, 18 nt, Artificial Sequence
  Description of Artificial Sequence: Synthetic oligonucleotide
cauguacaccacaaucuc

SEQ ID NO: 59008 - RNA, 18 nt, Artificial Sequence
  Description of Artificial Sequence: Synthetic oligonucleotide
ggugacauguacaccaca

SEQ ID NO: 59009 - RNA, 18 nt, Artificial Sequence
  Description of Artificial Sequence: Synthetic oligonucleotide
aaucaggugacauguaca

SEQ ID NO: 59010 - RNA, 18 nt, Artificial Sequence
  Description of Artificial Sequence: Synthetic oligonucleotide
uguaguccugguggcaug

SEQ ID NO: 59011 - RNA, 18 nt, Artificial Sequence
  Description of Artificial Sequence: Synthetic oligonucleotide
gccccuguaguccuggug

SEQ ID NO: 59012 - RNA, 18 nt, Artificial Sequence
  Description of Artificial Sequence: Synthetic oligonucleotide
acucugccccuguagucc

SEQ ID NO: 59013 - RNA, 18 nt, Artificial Sequence
  Description of Artificial Sequence: Synthetic oligonucleotide
gagacacucugccccugu

SEQ ID NO: 59014 - RNA, 18 nt, Artificial Sequence
  Description of Artificial Sequence: Synthetic oligonucleotide
cagaggagacacucugcc

SEQ ID NO: 59015 - RNA, 18 nt, Artificial Sequence
  Description of Artificial Sequence: Synthetic oligonucleotide
gcugccagaggagacacu

SEQ ID NO: 59016 - RNA, 18 nt, Artificial Sequence
  Description of Artificial Sequence: Synthetic oligonucleotide
ucagagcugccagaggag

SEQ ID NO: 59017 - RNA, 18 nt, Artificial Sequence
  Description of Artificial Sequence: Synthetic oligonucleotide
ugaucucagagcugccag

SEQ ID NO: 59018 - RNA, 18 nt, Artificial Sequence
  Description of Artificial Sequence: Synthetic oligonucleotide
ggauuugaucucagagcu

SEQ ID NO: 59019 - RNA, 18 nt, Artificial Sequence
  Description of Artificial Sequence: Synthetic oligonucleotide
ucaucggauuugaucuca

SEQ ID NO: 59020 - RNA, 18 nt, Artificial Sequence
  Description of Artificial Sequence: Synthetic oligonucleotide
ccucgucaucggauuuga

SEQ ID NO: 59021 - RNA, 18 nt, Artificial Sequence
  Description of Artificial Sequence: Synthetic oligonucleotide
aucacccucgucaucgga

SEQ ID NO: 59022 - RNA, 18 nt, Artificial Sequence
  Description of Artificial Sequence: Synthetic oligonucleotide
uucucaucacccucguca

SEQ ID NO: 59023 - RNA, 18 nt, Artificial Sequence
  Description of Artificial Sequence: Synthetic oligonucleotide
gcagguucucaucacccu

SEQ ID NO: 59024 - RNA, 18 nt, Artificial Sequence
  Description of Artificial Sequence: Synthetic oligonucleotide
gucuugcagguucucauc

SEQ ID NO: 59025 - RNA, 18 nt, Artificial Sequence
  Description of Artificial Sequence: Synthetic oligonucleotide
uucgugucuugcagguuc

SEQ ID NO: 59026 - RNA, 18 nt, Artificial Sequence
  Description of Artificial Sequence: Synthetic oligonucleotide
aagauuucgugucuugca

SEQ ID NO: 59027 - RNA, 18 nt, Artificial Sequence
  Description of Artificial Sequence: Synthetic oligonucleotide
cuccgaagauuucguguc

SEQ ID NO: 59028 - RNA, 18 nt, Artificial Sequence
  Description of Artificial Sequence: Synthetic oligonucleotide
uuguccuccgaagauuuc

SEQ ID NO: 59029 - RNA, 18 nt, Artificial Sequence
  Description of Artificial Sequence: Synthetic oligonucleotide
auuucuuguccuccgaag

SEQ ID NO: 59030 - RNA, 18 nt, Artificial Sequence
  Description of Artificial Sequence: Synthetic oligonucleotide
aucuaauuucuuguccuc

SEQ ID NO: 59031 - RNA, 18 nt, Artificial Sequence
  Description of Artificial Sequence: Synthetic oligonucleotide
ucgucaucuaauuucuug

SEQ ID NO: 59032 - RNA, 18 nt, Artificial Sequence
  Description of Artificial Sequence: Synthetic oligonucleotide
ucuugucgucaucuaauu

SEQ ID NO: 59033 - RNA, 18 nt, Artificial Sequence
  Description of Artificial Sequence: Synthetic oligonucleotide
auccuucuugucgucauc

SEQ ID NO: 59034 - RNA, 18 nt, Artificial Sequence
  Description of Artificial Sequence: Synthetic oligonucleotide
uugauauccuucuugucg

SEQ ID NO: 59035 - RNA, 18 nt, Artificial Sequence
  Description of Artificial Sequence: Synthetic oligonucleotide
uugauuugauauccuucu

SEQ ID NO: 59036 - RNA, 18 nt, Artificial Sequence
  Description of Artificial Sequence: Synthetic oligonucleotide
aguaauugauuugauauc

SEQ ID NO: 59037 - RNA, 18 nt, Artificial Sequence
  Description of Artificial Sequence: Synthetic oligonucleotide
gaccuaguaauugauuug

SEQ ID NO: 59038 - RNA, 18 nt, Artificial Sequence
  Description of Artificial Sequence: Synthetic oligonucleotide
aucuugaccuaguaauug

SEQ ID NO: 59039 - RNA, 18 nt, Artificial Sequence
  Description of Artificial Sequence: Synthetic oligonucleotide
uucacgauggguccccac

SEQ ID NO: 59040 - RNA, 18 nt, Artificial Sequence
  Description of Artificial Sequence: Synthetic oligonucleotide
ccaucuucacgauggguc

SEQ ID NO: 59041 - RNA, 18 nt, Artificial Sequence
  Description of Artificial Sequence: Synthetic oligonucleotide
ccacgccaucuucacgau

SEQ ID NO: 59042 - RNA, 18 nt, Artificial Sequence
  Description of Artificial Sequence: Synthetic oligonucleotide
cagggccacgccaucuuc

SEQ ID NO: 59043 - RNA, 18 nt, Artificial Sequence
  Description of Artificial Sequence: Synthetic oligonucleotide
ccucucagggccacgcca

SEQ ID NO: 59044 - RNA, 18 nt, Artificial Sequence
  Description of Artificial Sequence: Synthetic oligonucleotide
ggcugccucucagggcca

SEQ ID NO: 59045 - RNA, 18 nt, Artificial Sequence
  Description of Artificial Sequence: Synthetic oligonucleotide
agaauggcugccucucag

SEQ ID NO: 59046 - RNA, 18 nt, Artificial Sequence
  Description of Artificial Sequence: Synthetic oligonucleotide
agaagagaauggcugccu

SEQ ID NO: 59047 - RNA, 18 nt, Artificial Sequence
  Description of Artificial Sequence: Synthetic oligonucleotide
uuggcagaagagaauggc

SEQ ID NO: 59048 - RNA, 18 nt, Artificial Sequence
  Description of Artificial Sequence: Synthetic oligonucleotide
cugguuuggcagaagaga

SEQ ID NO: 59049 - RNA, 18 nt, Artificial Sequence
  Description of Artificial Sequence: Synthetic oligonucleotide
ggaaccugguuuggcaga

SEQ ID NO: 59050 - RNA, 18 nt, Artificial Sequence
  Description of Artificial Sequence: Synthetic oligonucleotide
gaaccggaaccugguuug

SEQ ID NO: 59051 - RNA, 18 nt, Artificial Sequence
  Description of Artificial Sequence: Synthetic oligonucleotide
cuguggaaccggaaccug

SEQ ID NO: 59052 - RNA, 18 nt, Artificial Sequence
  Description of Artificial Sequence: Synthetic oligonucleotide
ggaagcuguggaaccgga

SEQ ID NO: 59053 - RNA, 18 nt, Artificial Sequence
  Description of Artificial Sequence: Synthetic oligonucleotide
ggacaggaagcuguggaa

SEQ ID NO: 59054 - RNA, 18 nt, Artificial Sequence
  Description of Artificial Sequence: Synthetic oligonucleotide
agacuggacaggaagcug

SEQ ID NO: 59055 - RNA, 18 nt, Artificial Sequence
  Description of Artificial Sequence: Synthetic oligonucleotide
gucgcagacuggacagga

SEQ ID NO: 59056 - RNA, 18 nt, Artificial Sequence
  Description of Artificial Sequence: Synthetic oligonucleotide
gggaagucgcagacugga

SEQ ID NO: 59057 - RNA, 18 nt, Artificial Sequence
  Description of Artificial Sequence: Synthetic oligonucleotide
gguggguucaggucaggg

SEQ ID NO: 59058 - RNA, 18 nt, Artificial Sequence
  Description of Artificial Sequence: Synthetic oligonucleotide
ggguggguucaggucagg

SEQ ID NO: 59059 - RNA, 18 nt, Artificial Sequence
  Description of Artificial Sequence: Synthetic oligonucleotide
cucuguaaggguccuggg

SEQ ID NO: 59060 - RNA, 18 nt, Artificial Sequence
  Description of Artificial Sequence: Synthetic oligonucleotide
gugcccuggugaggccaa

SEQ ID NO: 59061 - RNA, 18 nt, Artificial Sequence
  Description of Artificial Sequence: Synthetic oligonucleotide
cagaagugcccuggugag

SEQ ID NO: 59062 - RNA, 18 nt, Artificial Sequence
  Description of Artificial Sequence: Synthetic oligonucleotide
gaggucagaagugcccug

SEQ ID NO: 59063 - RNA, 18 nt, Artificial Sequence
  Description of Artificial Sequence: Synthetic oligonucleotide
aaagugaggucagaagug

SEQ ID NO: 59064 - RNA, 18 nt, Artificial Sequence
  Description of Artificial Sequence: Synthetic oligonucleotide
uugugaaagugaggucag

SEQ ID NO: 59065 - RNA, 18 nt, Artificial Sequence
  Description of Artificial Sequence: Synthetic oligonucleotide
uccuauugugaaagugag

SEQ ID NO: 59066 - RNA, 18 nt, Artificial Sequence
  Description of Artificial Sequence: Synthetic oligonucleotide
acugguccuauugugaaa

SEQ ID NO: 59067 - RNA, 18 nt, Artificial Sequence
  Description of Artificial Sequence: Synthetic oligonucleotide
ucaacacugguccuauug

SEQ ID NO: 59068 - RNA, 18 nt, Artificial Sequence
  Description of Artificial Sequence: Synthetic oligonucleotide
ggguaucaacacuggucc

SEQ ID NO: 59069 - RNA, 18 nt, Artificial Sequence
  Description of Artificial Sequence: Synthetic oligonucleotide
aggcuggguaucaacacu

SEQ ID NO: 59070 - RNA, 18 nt, Artificial Sequence
  Description of Artificial Sequence: Synthetic oligonucleotide
ccaagaggcuggguauca

SEQ ID NO: 59071 - RNA, 18 nt, Artificial Sequence
  Description of Artificial Sequence: Synthetic oligonucleotide
gaacaccaagaggcuggg

SEQ ID NO: 59072 - RNA, 18 nt, Artificial Sequence
  Description of Artificial Sequence: Synthetic oligonucleotide
gggaugaacaccaagagg

SEQ ID NO: 59073 - RNA, 18 nt, Artificial Sequence
  Description of Artificial Sequence: Synthetic oligonucleotide
cuugagggaugaacacca

SEQ ID NO: 59074 - RNA, 18 nt, Artificial Sequence
  Description of Artificial Sequence: Synthetic oligonucleotide
ugcuucuugagggaugaa

SEQ ID NO: 59075 - RNA, 18 nt, Artificial Sequence
  Description of Artificial Sequence: Synthetic oligonucleotide
gccagugcuucuugaggg

SEQ ID NO: 59076 - RNA, 18 nt, Artificial Sequence
  Description of Artificial Sequence: Synthetic oligonucleotide
uuucugccagugcuucuu

SEQ ID NO: 59077 - RNA, 18 nt, Artificial Sequence
  Description of Artificial Sequence: Synthetic oligonucleotide
cuggguuucugccagugc

SEQ ID NO: 59078 - RNA, 18 nt, Artificial Sequence
  Description of Artificial Sequence: Synthetic oligonucleotide
gauuccuggguuucugcc

SEQ ID NO: 59079 - RNA, 18 nt, Artificial Sequence
  Description of Artificial Sequence: Synthetic oligonucleotide
aauuugauuccuggguuu

SEQ ID NO: 59080 - RNA, 18 nt, Artificial Sequence
  Description of Artificial Sequence: Synthetic oligonucleotide
ugcccaauuugauuccug

SEQ ID NO: 59081 - RNA, 18 nt, Artificial Sequence
  Description of Artificial Sequence: Synthetic oligonucleotide
uuuugugcccaauuugau

SEQ ID NO: 59082 - RNA, 18 nt, Artificial Sequence
  Description of Artificial Sequence: Synthetic oligonucleotide
accauuuuugugcccaau

SEQ ID NO: 59083 - RNA, 18 nt, Artificial Sequence
  Description of Artificial Sequence: Synthetic oligonucleotide
uccuuaccauuuuugugc

SEQ ID NO: 59084 - RNA, 18 nt, Artificial Sequence
  Description of Artificial Sequence: Synthetic oligonucleotide
ccauuuccuuaccauuuu

SEQ ID NO: 59085 - RNA, 18 nt, Artificial Sequence
  Description of Artificial Sequence: Synthetic oligonucleotide
cuuugccauuuccuuacc

SEQ ID NO: 59086 - RNA, 18 nt, Artificial Sequence
  Description of Artificial Sequence: Synthetic oligonucleotide
aaauacuuugccauuucc

SEQ ID NO: 59087 - RNA, 18 nt, Artificial Sequence
  Description of Artificial Sequence: Synthetic oligonucleotide
guucuaaauacuuugcca

SEQ ID NO: 59088 - RNA, 18 nt, Artificial Sequence
  Description of Artificial Sequence: Synthetic oligonucleotide
gcgaaguucuaaauacuu

SEQ ID NO: 59089 - RNA, 18 nt, Artificial Sequence
  Description of Artificial Sequence: Synthetic oligonucleotide
agcgggcgaaguucuaaa

SEQ ID NO: 59090 - RNA, 18 nt, Artificial Sequence
  Description of Artificial Sequence: Synthetic oligonucleotide
caauuagcgggcgaaguu

SEQ ID NO: 59091 - RNA, 18 nt, Artificial Sequence
  Description of Artificial Sequence: Synthetic oligonucleotide
aaacacaauuagcgggcg

SEQ ID NO: 59092 - RNA, 18 nt, Artificial Sequence
  Description of Artificial Sequence: Synthetic oligonucleotide
uggagaaacacaauuagc

SEQ ID NO: 59093 - RNA, 18 nt, Artificial Sequence
  Description of Artificial Sequence: Synthetic oligonucleotide
gucccuggagaaacacaa

SEQ ID NO: 59094 - RNA, 18 nt, Artificial Sequence
  Description of Artificial Sequence: Synthetic oligonucleotide
aaacagucccuggagaaa

SEQ ID NO: 59095 - RNA, 18 nt, Artificial Sequence
  Description of Artificial Sequence: Synthetic oligonucleotide
gaggaaaacagucccugg

SEQ ID NO: 59096 - RNA, 18 nt, Artificial Sequence
  Description of Artificial Sequence: Synthetic oligonucleotide
uguuugaggaaaacaguc

SEQ ID NO: 59097 - RNA, 18 nt, Artificial Sequence
  Description of Artificial Sequence: Synthetic oligonucleotide
gaggauguuugaggaaaa

SEQ ID NO: 59098 - RNA, 18 nt, Artificial Sequence
  Description of Artificial Sequence: Synthetic oligonucleotide
uuucagaggauguuugag

SEQ ID NO: 59099 - RNA, 18 nt, Artificial Sequence
  Description of Artificial Sequence: Synthetic oligonucleotide
caggauuucagaggaugu

SEQ ID NO: 59100 - RNA, 18 nt, Artificial Sequence
  Description of Artificial Sequence: Synthetic oligonucleotide
aggaccaggauuucagag

SEQ ID NO: 59101 - RNA, 18 nt, Artificial Sequence
  Description of Artificial Sequence: Synthetic oligonucleotide
gauauaggaccaggauuu

SEQ ID NO: 59102 - RNA, 18 nt, Artificial Sequence
  Description of Artificial Sequence: Synthetic oligonucleotide
cugcugauauaggaccag

SEQ ID NO: 59103 - RNA, 18 nt, Artificial Sequence
  Description of Artificial Sequence: Synthetic oligonucleotide
auucccugcugauauagg

SEQ ID NO: 59104 - RNA, 18 nt, Artificial Sequence
  Description of Artificial Sequence: Synthetic oligonucleotide
gccucauucccugcugau

SEQ ID NO: 59105 - RNA, 18 nt, Artificial Sequence
  Description of Artificial Sequence: Synthetic oligonucleotide
cuguggccucauucccug

SEQ ID NO: 59106 - RNA, 18 nt, Artificial Sequence
  Description of Artificial Sequence: Synthetic oligonucleotide
ucagucuguggccucauu

SEQ ID NO: 59107 - RNA, 18 nt, Artificial Sequence
  Description of Artificial Sequence: Synthetic oligonucleotide
ucucaucagucuguggcc

SEQ ID NO: 59108 - RNA, 18 nt, Artificial Sequence
  Description of Artificial Sequence: Synthetic oligonucleotide
uuuccucucaucagucug

SEQ ID NO: 59109 - RNA, 18 nt, Artificial Sequence
  Description of Artificial Sequence: Synthetic oligonucleotide
uaaaauuuccucucauca

SEQ ID NO: 59110 - RNA, 18 nt, Artificial Sequence
  Description of Artificial Sequence: Synthetic oligonucleotide
uaaaauaaaauuuccucu

SEQ ID NO: 59111 - RNA, 18 nt, Artificial Sequence
  Description of Artificial Sequence: Synthetic oligonucleotide
auagcuaaaauaaaauuu

SEQ ID NO: 59112 - RNA, 18 nt, Artificial Sequence
  Description of Artificial Sequence: Synthetic oligonucleotide
uggaaauagcuaaaauaa

SEQ ID NO: 59113 - RNA, 18 nt, Artificial Sequence
  Description of Artificial Sequence: Synthetic oligonucleotide
aaauguggaaauagcuaa

SEQ ID NO: 59114 - RNA, 18 nt, Artificial Sequence
  Description of Artificial Sequence: Synthetic oligonucleotide
gagaaaaauguggaaaua

SEQ ID NO: 59115 - RNA, 18 nt, Artificial Sequence
  Description of Artificial Sequence: Synthetic oligonucleotide
ugaaugagaaaaaugugg

SEQ ID NO: 59116 - RNA, 18 nt, Artificial Sequence
  Description of Artificial Sequence: Synthetic oligonucleotide
ggaccugaaugagaaaaa

SEQ ID NO: 59117 - RNA, 18 nt, Artificial Sequence
  Description of Artificial Sequence: Synthetic oligonucleotide
uuagaggaccugaaugag

SEQ ID NO: 59118 - RNA, 18 nt, Artificial Sequence
  Description of Artificial Sequence: Synthetic oligonucleotide
ccacauuagaggaccuga

SEQ ID NO: 59119 - RNA, 18 nt, Artificial Sequence
  Description of Artificial Sequence: Synthetic oligonucleotide
acuaaccacauuagagga

SEQ ID NO: 59120 - RNA, 18 nt, Artificial Sequence
  Description of Artificial Sequence: Synthetic oligonucleotide
ccacaacuaaccacauua

SEQ ID NO: 59121 - RNA, 18 nt, Artificial Sequence
  Description of Artificial Sequence: Synthetic oligonucleotide
ucaggccacaacuaacca

SEQ ID NO: 59122 - RNA, 18 nt, Artificial Sequence
  Description of Artificial Sequence: Synthetic oligonucleotide
cauuuucaggccacaacu

SEQ ID NO: 59123 - RNA, 18 nt, Artificial Sequence
  Description of Artificial Sequence: Synthetic oligonucleotide
aauaucauuuucaggcca

SEQ ID NO: 59124 - RNA, 18 nt, Artificial Sequence
  Description of Artificial Sequence: Synthetic oligonucleotide
uuggaaauaucauuuuca

SEQ ID NO: 59125 - RNA, 18 nt, Artificial Sequence
  Description of Artificial Sequence: Synthetic oligonucleotide
uucauuuggaaauaucau

SEQ ID NO: 59126 - RNA, 18 nt, Artificial Sequence
  Description of Artificial Sequence: Synthetic oligonucleotide
uccuauucauuuggaaau

SEQ ID NO: 59127 - RNA, 18 nt, Artificial Sequence
  Description of Artificial Sequence: Synthetic oligonucleotide
uuccuuccuauucauuug

SEQ ID NO: 59128 - RNA, 18 nt, Artificial Sequence
  Description of Artificial Sequence: Synthetic oligonucleotide
uuuccuuccuuccuauuc

SEQ ID NO: 59129 - RNA, 18 nt, Artificial Sequence
  Description of Artificial Sequence: Synthetic oligonucleotide
aacaauuuccuuccuucc

SEQ ID NO: 59130 - RNA, 18 nt, Artificial Sequence
  Description of Artificial Sequence: Synthetic oligonucleotide
acaaaaacaauuuccuuc

SEQ ID NO: 59131 - RNA, 18 nt, Artificial Sequence
  Description of Artificial Sequence: Synthetic oligonucleotide
aaacaacaaaaacaauuu

SEQ ID NO: 59132 - RNA, 18 nt, Artificial Sequence
  Description of Artificial Sequence: Synthetic oligonucleotide
aucuuaaacaacaaaaac

SEQ ID NO: 59133 - RNA, 18 nt, Artificial Sequence
  Description of Artificial Sequence: Synthetic oligonucleotide
cuuccaucuuaaacaaca

SEQ ID NO: 59134 - RNA, 18 nt, Artificial Sequence
  Description of Artificial Sequence: Synthetic oligonucleotide
auuuccuuccaucuuaaa

SEQ ID NO: 59135 - RNA, 18 nt, Artificial Sequence
  Description of Artificial Sequence: Synthetic oligonucleotide
ccuauauuuccuuccauc

SEQ ID NO: 59136 - RNA, 18 nt, Artificial Sequence
  Description of Artificial Sequence: Synthetic oligonucleotide
augcaccuauauuuccuu

SEQ ID NO: 59137 - RNA, 18 nt, Artificial Sequence
  Description of Artificial Sequence: Synthetic oligonucleotide
uuuaaaugcaccuauauu

SEQ ID NO: 59138 - RNA, 18 nt, Artificial Sequence
  Description of Artificial Sequence: Synthetic oligonucleotide
cauuuuuuaaaugcaccu

SEQ ID NO: 59139 - RNA, 18 nt, Artificial Sequence
  Description of Artificial Sequence: Synthetic oligonucleotide
agcuccauuuuuuaaaug

SEQ ID NO: 59140 - RNA, 18 nt, Artificial Sequence
  Description of Artificial Sequence: Synthetic oligonucleotide
aaccaagcuccauuuuuu

SEQ ID NO: 59141 - RNA, 18 nt, Artificial Sequence
  Description of Artificial Sequence: Synthetic oligonucleotide
caugcaaccaagcuccau

SEQ ID NO: 59142 - RNA, 18 nt, Artificial Sequence
  Description of Artificial Sequence: Synthetic oligonucleotide
aaaaucaugcaaccaagc

SEQ ID NO: 59143 - RNA, 18 nt, Artificial Sequence
  Description of Artificial Sequence: Synthetic oligonucleotide
gagcgaaaaucaugcaac

SEQ ID NO: 59144 - RNA, 18 nt, Artificial Sequence
  Description of Artificial Sequence: Synthetic oligonucleotide
cucaagagcgaaaaucau

SEQ ID NO: 59145 - RNA, 18 nt, Artificial Sequence
  Description of Artificial Sequence: Synthetic oligonucleotide
gaugacucaagagcgaaa

SEQ ID NO: 59146 - RNA, 18 nt, Artificial Sequence
  Description of Artificial Sequence: Synthetic oligonucleotide
ggcuagaugacucaagag

SEQ ID NO: 59147 - RNA, 18 nt, Artificial Sequence
  Description of Artificial Sequence: Synthetic oligonucleotide
uagagggcuagaugacuc

SEQ ID NO: 59148 - RNA, 18 nt, Artificial Sequence
  Description of Artificial Sequence: Synthetic oligonucleotide
aucauuagagggcuagau

SEQ ID NO: 59149 - RNA, 18 nt, Artificial Sequence
  Description of Artificial Sequence: Synthetic oligonucleotide
aggcaaucauuagagggc

SEQ ID NO: 59150 - RNA, 18 nt, Artificial Sequence
  Description of Artificial Sequence: Synthetic oligonucleotide
guaugaggcaaucauuag

SEQ ID NO: 59151 - RNA, 18 nt, Artificial Sequence
  Description of Artificial Sequence: Synthetic oligonucleotide
caccgguaugaggcaauc

SEQ ID NO: 59152 - RNA, 18 nt, Artificial Sequence
  Description of Artificial Sequence: Synthetic oligonucleotide
guaaucaccgguaugagg

SEQ ID NO: 59153 - RNA, 18 nt, Artificial Sequence
  Description of Artificial Sequence: Synthetic oligonucleotide
cgcucguaaucaccggua

SEQ ID NO: 59154 - RNA, 18 nt, Artificial Sequence
  Description of Artificial Sequence: Synthetic oligonucleotide
aaagccgcucguaaucac

SEQ ID NO: 59155 - RNA, 18 nt, Artificial Sequence
  Description of Artificial Sequence: Synthetic oligonucleotide
caugaaaagccgcucgua

SEQ ID NO: 59156 - RNA, 18 nt, Artificial Sequence
  Description of Artificial Sequence: Synthetic oligonucleotide
gggucaugaaaagccgcu

SEQ ID NO: 59157 - RNA, 18 nt, Artificial Sequence
  Description of Artificial Sequence: Synthetic oligonucleotide
aaaugguacauauggaag

SEQ ID NO: 59158 - RNA, 18 nt, Artificial Sequence
  Description of Artificial Sequence: Synthetic oligonucleotide
uuuuaaaaugguacauau

SEQ ID NO: 59159 - RNA, 18 nt, Artificial Sequence
  Description of Artificial Sequence: Synthetic oligonucleotide
cagcauuuuaaaauggua

SEQ ID NO: 59160 - RNA, 18 nt, Artificial Sequence
  Description of Artificial Sequence: Synthetic oligonucleotide
guaaucagcauuuuaaaa

SEQ ID NO: 59161 - RNA, 18 nt, Artificial Sequence
  Description of Artificial Sequence: Synthetic oligonucleotide
aagaaguaaucagcauuu

SEQ ID NO: 59162 - RNA, 18 nt, Artificial Sequence
  Description of Artificial Sequence: Synthetic oligonucleotide
uucucaagaaguaaucag

SEQ ID NO: 59163 - RNA, 18 nt, Artificial Sequence
  Description of Artificial Sequence: Synthetic oligonucleotide
ucuuauucucaagaagua

SEQ ID NO: 59164 - RNA, 18 nt, Artificial Sequence
  Description of Artificial Sequence: Synthetic oligonucleotide
gcuucucuuauucucaag

SEQ ID NO: 59165 - RNA, 18 nt, Artificial Sequence
  Description of Artificial Sequence: Synthetic oligonucleotide
auuaggcuucucuuauuc

SEQ ID NO: 59166 - RNA, 18 nt, Artificial Sequence
  Description of Artificial Sequence: Synthetic oligonucleotide
cugaaauuaggcuucucu

SEQ ID NO: 59167 - RNA, 18 nt, Artificial Sequence
  Description of Artificial Sequence: Synthetic oligonucleotide
auauucugaaauuaggcu

SEQ ID NO: 59168 - RNA, 18 nt, Artificial Sequence
  Description of Artificial Sequence: Synthetic oligonucleotide
uaaugauauucugaaauu

SEQ ID NO: 59169 - RNA, 18 nt, Artificial Sequence
  Description of Artificial Sequence: Synthetic oligonucleotide
uacccuaaugauauucug

SEQ ID NO: 59170 - RNA, 18 nt, Artificial Sequence
  Description of Artificial Sequence: Synthetic oligonucleotide
auagguacccuaaugaua

SEQ ID NO: 59171 - RNA, 18 nt, Artificial Sequence
  Description of Artificial Sequence: Synthetic oligonucleotide
cuucaauagguacccuaa

SEQ ID NO: 59172 - RNA, 18 nt, Artificial Sequence
  Description of Artificial Sequence: Synthetic oligonucleotide
caagacuucaauagguac

SEQ ID NO: 59173 - RNA, 18 nt, Artificial Sequence
  Description of Artificial Sequence: Synthetic oligonucleotide
gcagucaagacuucaaua

SEQ ID NO: 59174 - RNA, 18 nt, Artificial Sequence
  Description of Artificial Sequence: Synthetic oligonucleotide
uaugugcagucaagacuu

SEQ ID NO: 59175 - RNA, 18 nt, Artificial Sequence
  Description of Artificial Sequence: Synthetic oligonucleotide
cuaaauaugugcagucaa

SEQ ID NO: 59176 - RNA, 18 nt, Artificial Sequence
  Description of Artificial Sequence: Synthetic oligonucleotide
guaugcuaaauaugugca

SEQ ID NO: 59177 - RNA, 18 nt, Artificial Sequence
  Description of Artificial Sequence: Synthetic oligonucleotide
agggaguaugcuaaauau

SEQ ID NO: 59178 - RNA, 18 nt, Artificial Sequence
  Description of Artificial Sequence: Synthetic oligonucleotide
uucccagggaguaugcua

SEQ ID NO: 59179 - RNA, 18 nt, Artificial Sequence
  Description of Artificial Sequence: Synthetic oligonucleotide
uauaauucccagggagua

SEQ ID NO: 59180 - RNA, 18 nt, Artificial Sequence
  Description of Artificial Sequence: Synthetic oligonucleotide
uaaaauauaauucccagg

SEQ ID NO: 59181 - RNA, 18 nt, Artificial Sequence
  Description of Artificial Sequence: Synthetic oligonucleotide
guccuuaaaauauaauuc

SEQ ID NO: 59182 - RNA, 18 nt, Artificial Sequence
  Description of Artificial Sequence: Synthetic oligonucleotide
aaaauguccuuaaaauau

SEQ ID NO: 59183 - RNA, 18 nt, Artificial Sequence
  Description of Artificial Sequence: Synthetic oligonucleotide
auagaaaaauguccuuaa

SEQ ID NO: 59184 - RNA, 18 nt, Artificial Sequence
  Description of Artificial Sequence: Synthetic oligonucleotide
auuuaauagaaaaauguc

SEQ ID NO: 59185 - RNA, 18 nt, Artificial Sequence
  Description of Artificial Sequence: Synthetic oligonucleotide
caaugauuuaauagaaaa

SEQ ID NO: 59186 - RNA, 18 nt, Artificial Sequence
  Description of Artificial Sequence: Synthetic oligonucleotide
auaugcaaugauuuaaua

SEQ ID NO: 59187 - RNA, 18 nt, Artificial Sequence
  Description of Artificial Sequence: Synthetic oligonucleotide
cuuccauaugcaaugauu

SEQ ID NO: 59188 - RNA, 18 nt, Artificial Sequence
  Description of Artificial Sequence: Synthetic oligonucleotide
aguuucuuccauaugcaa

SEQ ID NO: 59189 - RNA, 18 nt, Artificial Sequence
  Description of Artificial Sequence: Synthetic oligonucleotide
uauugaguuucuuccaua

SEQ ID NO: 59190 - RNA, 18 nt, Artificial Sequence
  Description of Artificial Sequence: Synthetic oligonucleotide
uauuauauugaguuucuu

SEQ ID NO: 59191 - RNA, 18 nt, Artificial Sequence
  Description of Artificial Sequence: Synthetic oligonucleotide
ucagcuauuauauugagu

SEQ ID NO: 59192 - RNA, 18 nt, Artificial Sequence
  Description of Artificial Sequence: Synthetic oligonucleotide
aaauaucagcuauuauau

SEQ ID NO: 59193 - RNA, 18 nt, Artificial Sequence
  Description of Artificial Sequence: Synthetic oligonucleotide
caaguaaauaucagcuau

SEQ ID NO: 59194 - RNA, 18 nt, Artificial Sequence
  Description of Artificial Sequence: Synthetic oligonucleotide
gaacccaaguaaauauca

SEQ ID NO: 59195 - RNA, 18 nt, Artificial Sequence
  Description of Artificial Sequence: Synthetic oligonucleotide
auuaagaacccaaguaaa

SEQ ID NO: 59196 - RNA, 18 nt, Artificial Sequence
  Description of Artificial Sequence: Synthetic oligonucleotide
uucugauuaagaacccaa

SEQ ID NO: 59197 - RNA, 18 nt, Artificial Sequence
  Description of Artificial Sequence: Synthetic oligonucleotide
caauguucugauuaagaa

SEQ ID NO: 59198 - RNA, 18 nt, Artificial Sequence
  Description of Artificial Sequence: Synthetic oligonucleotide
acagccaauguucugauu

SEQ ID NO: 59199 - RNA, 18 nt, Artificial Sequence
  Description of Artificial Sequence: Synthetic oligonucleotide
aucacacagccaauguuc

SEQ ID NO: 59200 - RNA, 18 nt, Artificial Sequence
  Description of Artificial Sequence: Synthetic oligonucleotide
ugaaaaucacacagccaa

SEQ ID NO: 59201 - RNA, 18 nt, Artificial Sequence
  Description of Artificial Sequence: Synthetic oligonucleotide
aaucaugaaaaucacaca

SEQ ID NO: 59202 - RNA, 18 nt, Artificial Sequence
  Description of Artificial Sequence: Synthetic oligonucleotide
aucauaaucaugaaaauc

SEQ ID NO: 59203 - RNA, 18 nt, Artificial Sequence
  Description of Artificial Sequence: Synthetic oligonucleotide
ugaaaaucauaaucauga

SEQ ID NO: 59204 - RNA, 18 nt, Artificial Sequence
  Description of Artificial Sequence: Synthetic oligonucleotide
ugcaaugaaaaucauaau

SEQ ID NO: 59205 - RNA, 18 nt, Artificial Sequence
  Description of Artificial Sequence: Synthetic oligonucleotide
uuaauugcaaugaaaauc

SEQ ID NO: 59206 - RNA, 18 nt, Artificial Sequence
  Description of Artificial Sequence: Synthetic oligonucleotide
ucaacuuaauugcaauga

SEQ ID NO: 59207 - RNA, 18 nt, Artificial Sequence
  Description of Artificial Sequence: Synthetic oligonucleotide
aaacaucaacuuaauugc

SEQ ID NO: 59208 - RNA, 18 nt, Artificial Sequence
  Description of Artificial Sequence: Synthetic oligonucleotide
cuacaaaacaucaacuua

SEQ ID NO: 59209 - RNA, 18 nt, Artificial Sequence
  Description of Artificial Sequence: Synthetic oligonucleotide
acugucuacaaaacauca

SEQ ID NO: 59210 - RNA, 18 nt, Artificial Sequence
  Description of Artificial Sequence: Synthetic oligonucleotide
auuucacugucuacaaaa

SEQ ID NO: 59211 - RNA, 18 nt, Artificial Sequence
  Description of Artificial Sequence: Synthetic oligonucleotide
ugguaauuucacugucua

SEQ ID NO: 59212 - RNA, 18 nt, Artificial Sequence
  Description of Artificial Sequence: Synthetic oligonucleotide
guagaugguaauuucacu

SEQ ID NO: 59213 - RNA, 18 nt, Artificial Sequence
  Description of Artificial Sequence: Synthetic oligonucleotide
uuggaguagaugguaauu

SEQ ID NO: 59214 - RNA, 18 nt, Artificial Sequence
  Description of Artificial Sequence: Synthetic oligonucleotide
aucuuuuggaguagaugg

SEQ ID NO: 59215 - RNA, 18 nt, Artificial Sequence
  Description of Artificial Sequence: Synthetic oligonucleotide
uugcaaucuuuuggagua

SEQ ID NO: 59216 - RNA, 18 nt, Artificial Sequence
  Description of Artificial Sequence: Synthetic oligonucleotide
cuauuuugcaaucuuuug

SEQ ID NO: 59217 - RNA, 18 nt, Artificial Sequence
  Description of Artificial Sequence: Synthetic oligonucleotide
aaauucuauuuugcaauc

SEQ ID NO: 59218 - RNA, 18 nt, Artificial Sequence
  Description of Artificial Sequence: Synthetic oligonucleotide
agguuaaauucuauuuug

SEQ ID NO: 59219 - RNA, 18 nt, Artificial Sequence
  Description of Artificial Sequence: Synthetic oligonucleotide
cucuaagguuaaauucua

SEQ ID NO: 59220 - RNA, 18 nt, Artificial Sequence
  Description of Artificial Sequence: Synthetic oligonucleotide
auuggcucuaagguuaaa

SEQ ID NO: 59221 - RNA, 18 nt, Artificial Sequence
  Description of Artificial Sequence: Synthetic oligonucleotide
ccugcauuggcucuaagg

SEQ ID NO: 59222 - RNA, 18 nt, Artificial Sequence
  Description of Artificial Sequence: Synthetic oligonucleotide
uuuucccugcauuggcuc

SEQ ID NO: 59223 - RNA, 18 nt, Artificial Sequence
  Description of Artificial Sequence: Synthetic oligonucleotide
acaaguuuucccugcauu

SEQ ID NO: 59224 - RNA, 18 nt, Artificial Sequence
  Description of Artificial Sequence: Synthetic oligonucleotide
cagaaacaaguuuucccu

SEQ ID NO: 59225 - RNA, 18 nt, Artificial Sequence
  Description of Artificial Sequence: Synthetic oligonucleotide
accugcagaaacaaguuu

SEQ ID NO: 59226 - RNA, 18 nt, Artificial Sequence
  Description of Artificial Sequence: Synthetic oligonucleotide
aaugcaccugcagaaaca

SEQ ID NO: 59227 - RNA, 18 nt, Artificial Sequence
  Description of Artificial Sequence: Synthetic oligonucleotide
caaaaaaugcaccugcag

SEQ ID NO: 59228 - RNA, 18 nt, Artificial Sequence
  Description of Artificial Sequence: Synthetic oligonucleotide
aguuucaaaaaaugcacc

SEQ ID NO: 59229 - RNA, 18 nt, Artificial Sequence
  Description of Artificial Sequence: Synthetic oligonucleotide
guugaaguuucaaaaaau

SEQ ID NO: 59230 - RNA, 18 nt, Artificial Sequence
  Description of Artificial Sequence: Synthetic oligonucleotide
uaucuguugaaguuucaa

SEQ ID NO: 59231 - RNA, 18 nt, Artificial Sequence
  Description of Artificial Sequence: Synthetic oligonucleotide
ccugcuaucuguugaagu

SEQ ID NO: 59232 - RNA, 18 nt, Artificial Sequence
  Description of Artificial Sequence: Synthetic oligonucleotide
uucccccugcuaucuguu

SEQ ID NO: 59233 - RNA, 18 nt, Artificial Sequence
  Description of Artificial Sequence: Synthetic oligonucleotide
uuuuuuucccccugcuau

SEQ ID NO: 59234 - RNA, 18 nt, Artificial Sequence
  Description of Artificial Sequence: Synthetic oligonucleotide
ucacuuuuuuuucccccu

SEQ ID NO: 59235 - RNA, 18 nt, Artificial Sequence
  Description of Artificial Sequence: Synthetic oligonucleotide
uucugucacuuuuuuuuc

SEQ ID NO: 59236 - RNA, 18 nt, Artificial Sequence
  Description of Artificial Sequence: Synthetic oligonucleotide
gauccuucugucacuuuu

SEQ ID NO: 59237 - RNA, 18 nt, Artificial Sequence
  Description of Artificial Sequence: Synthetic oligonucleotide
acugugauccuucuguca

SEQ ID NO: 59238 - RNA, 18 nt, Artificial Sequence
  Description of Artificial Sequence: Synthetic oligonucleotide
gcugaacugugauccuuc

SEQ ID NO: 59239 - RNA, 18 nt, Artificial Sequence
  Description of Artificial Sequence: Synthetic oligonucleotide
auacugcugaacugugau

SEQ ID NO: 59240 - RNA, 18 nt, Artificial Sequence
  Description of Artificial Sequence: Synthetic oligonucleotide
aauucauacugcugaacu

SEQ ID NO: 59241 - RNA, 18 nt, Artificial Sequence
  Description of Artificial Sequence: Synthetic oligonucleotide
cagacaauucauacugcu

SEQ ID NO: 59242 - RNA, 18 nt, Artificial Sequence
  Description of Artificial Sequence: Synthetic oligonucleotide
gccagcagacaauucaua

SEQ ID NO: 59243 - RNA, 18 nt, Artificial Sequence
  Description of Artificial Sequence: Synthetic oligonucleotide
aggcugccagcagacaau

SEQ ID NO: 59244 - RNA, 18 nt, Artificial Sequence
  Description of Artificial Sequence: Synthetic oligonucleotide
uugcaaggcugccagcag

SEQ ID NO: 59245 - RNA, 18 nt, Artificial Sequence
  Description of Artificial Sequence: Synthetic oligonucleotide
ccagauugcaaggcugcc

SEQ ID NO: 59246 - RNA, 18 nt, Artificial Sequence
  Description of Artificial Sequence: Synthetic oligonucleotide
gcacaccagauugcaagg

SEQ ID NO: 59247 - RNA, 18 nt, Artificial Sequence
  Description of Artificial Sequence: Synthetic oligonucleotide
ugccugcacaccagauug

SEQ ID NO: 59248 - RNA, 18 nt, Artificial Sequence
  Description of Artificial Sequence: Synthetic oligonucleotide
cucacugccugcacacca

SEQ ID NO: 59249 - RNA, 18 nt, Artificial Sequence
  Description of Artificial Sequence: Synthetic oligonucleotide
acaaucucacugccugca

SEQ ID NO: 59250 - RNA, 18 nt, Artificial Sequence
  Description of Artificial Sequence: Synthetic oligonucleotide
acaccacaaucucacugc

SEQ ID NO: 59251 - RNA, 18 nt, Artificial Sequence
  Description of Artificial Sequence: Synthetic oligonucleotide
cauguacaccacaaucuc

SEQ ID NO: 59252 - RNA, 18 nt, Artificial Sequence
  Description of Artificial Sequence: Synthetic oligonucleotide
ggugacauguacaccaca

SEQ ID NO: 59253 - RNA, 18 nt, Artificial Sequence
  Description of Artificial Sequence: Synthetic oligonucleotide
aaucaggugacauguaca

SEQ ID NO: 59254 - RNA, 18 nt, Artificial Sequence
  Description of Artificial Sequence: Synthetic oligonucleotide
uguaguccugguggcaug

SEQ ID NO: 59255 - RNA, 18 nt, Artificial Sequence
  Description of Artificial Sequence: Synthetic oligonucleotide
gccccuguaguccuggug

SEQ ID NO: 59256 - RNA, 18 nt, Artificial Sequence
  Description of Artificial Sequence: Synthetic oligonucleotide
acucugccccuguagucc

SEQ ID NO: 59257 - RNA, 18 nt, Artificial Sequence
  Description of Artificial Sequence: Synthetic oligonucleotide
gagacacucugccccugu

SEQ ID NO: 59258 - RNA, 18 nt, Artificial Sequence
  Description of Artificial Sequence: Synthetic oligonucleotide
cagaggagacacucugcc

SEQ ID NO: 59259 - RNA, 18 nt, Artificial Sequence
  Description of Artificial Sequence: Synthetic oligonucleotide
gcugccagaggagacacu

SEQ ID NO: 59260 - RNA, 18 nt, Artificial Sequence
  Description of Artificial Sequence: Synthetic oligonucleotide
ucagagcugccagaggag

SEQ ID NO: 59261 - RNA, 18 nt, Artificial Sequence
  Description of Artificial Sequence: Synthetic oligonucleotide
ugaucucagagcugccag

SEQ ID NO: 59262 - RNA, 18 nt, Artificial Sequence
  Description of Artificial Sequence: Synthetic oligonucleotide
ggauuugaucucagagcu

SEQ ID NO: 59263 - RNA, 18 nt, Artificial Sequence
  Description of Artificial Sequence: Synthetic oligonucleotide
ucaucggauuugaucuca

SEQ ID NO: 59264 - RNA, 18 nt, Artificial Sequence
  Description of Artificial Sequence: Synthetic oligonucleotide
ccucgucaucggauuuga

SEQ ID NO: 59265 - RNA, 18 nt, Artificial Sequence
  Description of Artificial Sequence: Synthetic oligonucleotide
aucacccucgucaucgga

SEQ ID NO: 59266 - RNA, 18 nt, Artificial Sequence
  Description of Artificial Sequence: Synthetic oligonucleotide
uucucaucacccucguca

SEQ ID NO: 59267 - RNA, 18 nt, Artificial Sequence
  Description of Artificial Sequence: Synthetic oligonucleotide
gcagguucucaucacccu

SEQ ID NO: 59268 - RNA, 18 nt, Artificial Sequence
  Description of Artificial Sequence: Synthetic oligonucleotide
gucuugcagguucucauc

SEQ ID NO: 59269 - RNA, 18 nt, Artificial Sequence
  Description of Artificial Sequence: Synthetic oligonucleotide
uucgugucuugcagguuc

SEQ ID NO: 59270 - RNA, 18 nt, Artificial Sequence
  Description of Artificial Sequence: Synthetic oligonucleotide
aagauuucgugucuugca

SEQ ID NO: 59271 - RNA, 18 nt, Artificial Sequence
  Description of Artificial Sequence: Synthetic oligonucleotide
cuccgaagauuucguguc

SEQ ID NO: 59272 - RNA, 18 nt, Artificial Sequence
  Description of Artificial Sequence: Synthetic oligonucleotide
uuguccuccgaagauuuc

SEQ ID NO: 59273 - RNA, 18 nt, Artificial Sequence
  Description of Artificial Sequence: Synthetic oligonucleotide
auuucuuguccuccgaag

SEQ ID NO: 59274 - RNA, 18 nt, Artificial Sequence
  Description of Artificial Sequence: Synthetic oligonucleotide
aucuaauuucuuguccuc

SEQ ID NO: 59275 - RNA, 18 nt, Artificial Sequence
  Description of Artificial Sequence: Synthetic oligonucleotide
ucgucaucuaauuucuug

SEQ ID NO: 59276 - RNA, 18 nt, Artificial Sequence
  Description of Artificial Sequence: Synthetic oligonucleotide
ucuugucgucaucuaauu

SEQ ID NO: 59277 - RNA, 18 nt, Artificial Sequence
  Description of Artificial Sequence: Synthetic oligonucleotide
auccuucuugucgucauc

SEQ ID NO: 59278 - RNA, 18 nt, Artificial Sequence
  Description of Artificial Sequence: Synthetic oligonucleotide
uugauauccuucuugucg

SEQ ID NO: 59279 - RNA, 18 nt, Artificial Sequence
  Description of Artificial Sequence: Synthetic oligonucleotide
uugauuugauauccuucu

SEQ ID NO: 59280 - RNA, 18 nt, Artificial Sequence
  Description of Artificial Sequence: Synthetic oligonucleotide
aguaauugauuugauauc

SEQ ID NO: 59281 - RNA, 18 nt, Artificial Sequence
  Description of Artificial Sequence: Synthetic oligonucleotide
gaccuaguaauugauuug

SEQ ID NO: 59282 - RNA, 18 nt, Artificial Sequence
  Description of Artificial Sequence: Synthetic oligonucleotide
aucuugaccuaguaauug

SEQ ID NO: 59283 - RNA, 18 nt, Artificial Sequence
  Description of Artificial Sequence: Synthetic oligonucleotide
uucacgauggguccccac

SEQ ID NO: 59284 - RNA, 18 nt, Artificial Sequence
  Description of Artificial Sequence: Synthetic oligonucleotide
ccaucuucacgauggguc

SEQ ID NO: 59285 - RNA, 18 nt, Artificial Sequence
  Description of Artificial Sequence: Synthetic oligonucleotide
ccacgccaucuucacgau

SEQ ID NO: 59286 - RNA, 18 nt, Artificial Sequence
  Description of Artificial Sequence: Synthetic oligonucleotide
cagggccacgccaucuuc

SEQ ID NO: 59287 - RNA, 18 nt, Artificial Sequence
  Description of Artificial Sequence: Synthetic oligonucleotide
ccucucagggccacgcca

SEQ ID NO: 59288 - RNA, 18 nt, Artificial Sequence
  Description of Artificial Sequence: Synthetic oligonucleotide
ggcugccucucagggcca

SEQ ID NO: 59289 - RNA, 18 nt, Artificial Sequence
  Description of Artificial Sequence: Synthetic oligonucleotide
agaauggcugccucucag

SEQ ID NO: 59290 - RNA, 18 nt, Artificial Sequence
  Description of Artificial Sequence: Synthetic oligonucleotide
agaagagaauggcugccu

SEQ ID NO: 59291 - RNA, 18 nt, Artificial Sequence
  Description of Artificial Sequence: Synthetic oligonucleotide
uuggcagaagagaauggc

SEQ ID NO: 59292 - RNA, 18 nt, Artificial Sequence
  Description of Artificial Sequence: Synthetic oligonucleotide
cugguuuggcagaagaga

SEQ ID NO: 59293 - RNA, 18 nt, Artificial Sequence
  Description of Artificial Sequence: Synthetic oligonucleotide
ggaaccugguuuggcaga

SEQ ID NO: 59294 - RNA, 18 nt, Artificial Sequence
  Description of Artificial Sequence: Synthetic oligonucleotide
gaaccggaaccugguuug

SEQ ID NO: 59295 - RNA, 18 nt, Artificial Sequence
  Description of Artificial Sequence: Synthetic oligonucleotide
cuguggaaccggaaccug

SEQ ID NO: 59296 - RNA, 18 nt, Artificial Sequence
  Description of Artificial Sequence: Synthetic oligonucleotide
ggaagcuguggaaccgga

SEQ ID NO: 59297 - RNA, 18 nt, Artificial Sequence
  Description of Artificial Sequence: Synthetic oligonucleotide
ggacaggaagcuguggaa

SEQ ID NO: 59298 - RNA, 18 nt, Artificial Sequence
  Description of Artificial Sequence: Synthetic oligonucleotide
agacuggacaggaagcug

SEQ ID NO: 59299 - RNA, 18 nt, Artificial Sequence
  Description of Artificial Sequence: Synthetic oligonucleotide
gucgcagacuggacagga

SEQ ID NO: 59300 - RNA, 18 nt, Artificial Sequence
  Description of Artificial Sequence: Synthetic oligonucleotide
gggaagucgcagacugga

SEQ ID NO: 59301 - RNA, 18 nt, Artificial Sequence
  Description of Artificial Sequence: Synthetic oligonucleotide
gguggguucaggucaggg

SEQ ID NO: 59302 - RNA, 18 nt, Artificial Sequence
  Description of Artificial Sequence: Synthetic oligonucleotide
ggguggguucaggucagg

SEQ ID NO: 59303 - RNA, 18 nt, Artificial Sequence
  Description of Artificial Sequence: Synthetic oligonucleotide
cucuguaaggguccuggg

SEQ ID NO: 59304 - RNA, 18 nt, Artificial Sequence
  Description of Artificial Sequence: Synthetic oligonucleotide
gugcccuggugaggccaa

SEQ ID NO: 59305 - RNA, 18 nt, Artificial Sequence
  Description of Artificial Sequence: Synthetic oligonucleotide
cagaagugcccuggugag

SEQ ID NO: 59306 - RNA, 18 nt, Artificial Sequence
  Description of Artificial Sequence: Synthetic oligonucleotide
gaggucagaagugcccug

SEQ ID NO: 59307 - RNA, 18 nt, Artificial Sequence
  Description of Artificial Sequence: Synthetic oligonucleotide
aaagugaggucagaagug

SEQ ID NO: 59308 - RNA, 18 nt, Artificial Sequence
  Description of Artificial Sequence: Synthetic oligonucleotide
uugugaaagugaggucag

SEQ ID NO: 59309 - RNA, 18 nt, Artificial Sequence
  Description of Artificial Sequence: Synthetic oligonucleotide
uccuauugugaaagugag

SEQ ID NO: 59310 - RNA, 18 nt, Artificial Sequence
  Description of Artificial Sequence: Synthetic oligonucleotide
acugguccuauugugaaa

SEQ ID NO: 59311 - RNA, 18 nt, Artificial Sequence
  Description of Artificial Sequence: Synthetic oligonucleotide
ucaacacugguccuauug

SEQ ID NO: 59312 - RNA, 18 nt, Artificial Sequence
  Description of Artificial Sequence: Synthetic oligonucleotide
ggguaucaacacuggucc

SEQ ID NO: 59313 - RNA, 18 nt, Artificial Sequence
  Description of Artificial Sequence: Synthetic oligonucleotide
aggcuggguaucaacacu

SEQ ID NO: 59314 - RNA, 18 nt, Artificial Sequence
  Description of Artificial Sequence: Synthetic oligonucleotide
ccaagaggcuggguauca

SEQ ID NO: 59315 - RNA, 18 nt, Artificial Sequence
  Description of Artificial Sequence: Synthetic oligonucleotide
gaacaccaagaggcuggg

SEQ ID NO: 59316 - RNA, 18 nt, Artificial Sequence
  Description of Artificial Sequence: Synthetic oligonucleotide
gggaugaacaccaagagg

SEQ ID NO: 59317 - RNA, 18 nt, Artificial Sequence
  Description of Artificial Sequence: Synthetic oligonucleotide
cuugagggaugaacacca

SEQ ID NO: 59318 - RNA, 18 nt, Artificial Sequence
  Description of Artificial Sequence: Synthetic oligonucleotide
ugcuucuugagggaugaa

SEQ ID NO: 59319 - RNA, 18 nt, Artificial Sequence
  Description of Artificial Sequence: Synthetic oligonucleotide
gccagugcuucuugaggg

SEQ ID NO: 59320 - RNA, 18 nt, Artificial Sequence
  Description of Artificial Sequence: Synthetic oligonucleotide
uuucugccagugcuucuu

SEQ ID NO: 59321 - RNA, 18 nt, Artificial Sequence
  Description of Artificial Sequence: Synthetic oligonucleotide
cuggguuucugccagugc

SEQ ID NO: 59322 - RNA, 18 nt, Artificial Sequence
  Description of Artificial Sequence: Synthetic oligonucleotide
gauuccuggguuucugcc

SEQ ID NO: 59323 - RNA, 18 nt, Artificial Sequence
  Description of Artificial Sequence: Synthetic oligonucleotide
aauuugauuccuggguuu

SEQ ID NO: 59324 - RNA, 18 nt, Artificial Sequence
  Description of Artificial Sequence: Synthetic oligonucleotide
ugcccaauuugauuccug

SEQ ID NO: 59325 - RNA, 18 nt, Artificial Sequence
  Description of Artificial Sequence: Synthetic oligonucleotide
uuuugugcccaauuugau

SEQ ID NO: 59326 - RNA, 18 nt, Artificial Sequence
  Description of Artificial Sequence: Synthetic oligonucleotide
accauuuuugugcccaau

SEQ ID NO: 59327 - RNA, 18 nt, Artificial Sequence
  Description of Artificial Sequence: Synthetic oligonucleotide
uccuuaccauuuuugugc

SEQ ID NO: 59328 - RNA, 18 nt, Artificial Sequence
  Description of Artificial Sequence: Synthetic oligonucleotide
ccauuuccuuaccauuuu

SEQ ID NO: 59329 - RNA, 18 nt, Artificial Sequence
  Description of Artificial Sequence: Synthetic oligonucleotide
cuuugccauuuccuuacc

SEQ ID NO: 59330 - RNA, 18 nt, Artificial Sequence
  Description of Artificial Sequence: Synthetic oligonucleotide
aaauacuuugccauuucc

SEQ ID NO: 59331 - RNA, 18 nt, Artificial Sequence
  Description of Artificial Sequence: Synthetic oligonucleotide
guucuaaauacuuugcca

SEQ ID NO: 59332 - RNA, 18 nt, Artificial Sequence
  Description of Artificial Sequence: Synthetic oligonucleotide
gcgaaguucuaaauacuu

SEQ ID NO: 59333 - RNA, 18 nt, Artificial Sequence
  Description of Artificial Sequence: Synthetic oligonucleotide
agcgggcgaaguucuaaa

SEQ ID NO: 59334 - RNA, 18 nt, Artificial Sequence
  Description of Artificial Sequence: Synthetic oligonucleotide
caauuagcgggcgaaguu

SEQ ID NO: 59335 - RNA, 18 nt, Artificial Sequence
  Description of Artificial Sequence: Synthetic oligonucleotide
aaacacaauuagcgggcg

SEQ ID NO: 59336 - RNA, 18 nt, Artificial Sequence
  Description of Artificial Sequence: Synthetic oligonucleotide
uggagaaacacaauuagc

SEQ ID NO: 59337 - RNA, 18 nt, Artificial Sequence
  Description of Artificial Sequence: Synthetic oligonucleotide
gucccuggagaaacacaa

SEQ ID NO: 59338 - RNA, 18 nt, Artificial Sequence
  Description of Artificial Sequence: Synthetic oligonucleotide
aaacagucccuggagaaa

SEQ ID NO: 59339 - RNA, 18 nt, Artificial Sequence
  Description of Artificial Sequence: Synthetic oligonucleotide
gaggaaaacagucccugg

SEQ ID NO: 59340 - RNA, 18 nt, Artificial Sequence
  Description of Artificial Sequence: Synthetic oligonucleotide
uguuugaggaaaacaguc

SEQ ID NO: 59341 - RNA, 18 nt, Artificial Sequence
  Description of Artificial Sequence: Synthetic oligonucleotide
gaggauguuugaggaaaa

SEQ ID NO: 59342 - RNA, 18 nt, Artificial Sequence
  Description of Artificial Sequence: Synthetic oligonucleotide
uuucagaggauguuugag

SEQ ID NO: 59343 - RNA, 18 nt, Artificial Sequence
  Description of Artificial Sequence: Synthetic oligonucleotide
caggauuucagaggaugu

SEQ ID NO: 59344 - RNA, 18 nt, Artificial Sequence
  Description of Artificial Sequence: Synthetic oligonucleotide
aggaccaggauuucagag

SEQ ID NO: 59345 - RNA, 18 nt, Artificial Sequence
  Description of Artificial Sequence: Synthetic oligonucleotide
gauauaggaccaggauuu

SEQ ID NO: 59346 - RNA, 18 nt, Artificial Sequence
  Description of Artificial Sequence: Synthetic oligonucleotide
cugcugauauaggaccag

SEQ ID NO: 59347 - RNA, 18 nt, Artificial Sequence
  Description of Artificial Sequence: Synthetic oligonucleotide
auucccugcugauauagg

SEQ ID NO: 59348 - RNA, 18 nt, Artificial Sequence
  Description of Artificial Sequence: Synthetic oligonucleotide
gccucauucccugcugau

SEQ ID NO: 59349 - RNA, 18 nt, Artificial Sequence
  Description of Artificial Sequence: Synthetic oligonucleotide
cuguggccucauucccug

SEQ ID NO: 59350 - RNA, 18 nt, Artificial Sequence
  Description of Artificial Sequence: Synthetic oligonucleotide
ucagucuguggccucauu

SEQ ID NO: 59351 - RNA, 18 nt, Artificial Sequence
  Description of Artificial Sequence: Synthetic oligonucleotide
ucucaucagucuguggcc

SEQ ID NO: 59352 - RNA, 18 nt, Artificial Sequence
  Description of Artificial Sequence: Synthetic oligonucleotide
uuuccucucaucagucug

SEQ ID NO: 59353 - RNA, 18 nt, Artificial Sequence
  Description of Artificial Sequence: Synthetic oligonucleotide
uaaaauuuccucucauca

SEQ ID NO: 59354 - RNA, 18 nt, Artificial Sequence
  Description of Artificial Sequence: Synthetic oligonucleotide
uaaaauaaaauuuccucu

SEQ ID NO: 59355 - RNA, 18 nt, Artificial Sequence
  Description of Artificial Sequence: Synthetic oligonucleotide
auagcuaaaauaaaauuu

SEQ ID NO: 59356 - RNA, 18 nt, Artificial Sequence
  Description of Artificial Sequence: Synthetic oligonucleotide
uggaaauagcuaaaauaa

SEQ ID NO: 59357 - RNA, 18 nt, Artificial Sequence
  Description of Artificial Sequence: Synthetic oligonucleotide
aaauguggaaauagcuaa

SEQ ID NO: 59358 - RNA, 18 nt, Artificial Sequence
  Description of Artificial Sequence: Synthetic oligonucleotide
gagaaaaauguggaaaua

SEQ ID NO: 59359 - RNA, 18 nt, Artificial Sequence
  Description of Artificial Sequence: Synthetic oligonucleotide
ugaaugagaaaaaugugg

SEQ ID NO: 59360 - RNA, 18 nt, Artificial Sequence
  Description of Artificial Sequence: Synthetic oligonucleotide
ggaccugaaugagaaaaa

SEQ ID NO: 59361 - RNA, 18 nt, Artificial Sequence
  Description of Artificial Sequence: Synthetic oligonucleotide
uuagaggaccugaaugag

SEQ ID NO: 59362 - RNA, 18 nt, Artificial Sequence
  Description of Artificial Sequence: Synthetic oligonucleotide
ccacauuagaggaccuga

SEQ ID NO: 59363 - RNA, 18 nt, Artificial Sequence
  Description of Artificial Sequence: Synthetic oligonucleotide
acuaaccacauuagagga

SEQ ID NO: 59364 - RNA, 18 nt, Artificial Sequence
  Description of Artificial Sequence: Synthetic oligonucleotide
ccacaacuaaccacauua

SEQ ID NO: 59365 - RNA, 18 nt, Artificial Sequence
  Description of Artificial Sequence: Synthetic oligonucleotide
ucaggccacaacuaacca

SEQ ID NO: 59366 - RNA, 18 nt, Artificial Sequence
  Description of Artificial Sequence: Synthetic oligonucleotide
cauuuucaggccacaacu

SEQ ID NO: 59367 - RNA, 18 nt, Artificial Sequence
  Description of Artificial Sequence: Synthetic oligonucleotide
aauaucauuuucaggcca

SEQ ID NO: 59368 - RNA, 18 nt, Artificial Sequence
  Description of Artificial Sequence: Synthetic oligonucleotide
uuggaaauaucauuuuca

SEQ ID NO: 59369 - RNA, 18 nt, Artificial Sequence
  Description of Artificial Sequence: Synthetic oligonucleotide
uucauuuggaaauaucau

SEQ ID NO: 59370 - RNA, 18 nt, Artificial Sequence
  Description of Artificial Sequence: Synthetic oligonucleotide
uccuauucauuuggaaau

SEQ ID NO: 59371 - RNA, 18 nt, Artificial Sequence
  Description of Artificial Sequence: Synthetic oligonucleotide
uuccuuccuauucauuug

SEQ ID NO: 59372 - RNA, 18 nt, Artificial Sequence
  Description of Artificial Sequence: Synthetic oligonucleotide
uuuccuuccuuccuauuc

SEQ ID NO: 59373 - RNA, 18 nt, Artificial Sequence
  Description of Artificial Sequence: Synthetic oligonucleotide
aacaauuuccuuccuucc

SEQ ID NO: 59374 - RNA, 18 nt, Artificial Sequence
  Description of Artificial Sequence: Synthetic oligonucleotide
acaaaaacaauuuccuuc

SEQ ID NO: 59375 - RNA, 18 nt, Artificial Sequence
  Description of Artificial Sequence: Synthetic oligonucleotide
aaacaacaaaaacaauuu

SEQ ID NO: 59376 - RNA, 18 nt, Artificial Sequence
  Description of Artificial Sequence: Synthetic oligonucleotide
aucuuaaacaacaaaaac

SEQ ID NO: 59377 - RNA, 18 nt, Artificial Sequence
  Description of Artificial Sequence: Synthetic oligonucleotide
cuuccaucuuaaacaaca

SEQ ID NO: 59378 - RNA, 18 nt, Artificial Sequence
  Description of Artificial Sequence: Synthetic oligonucleotide
auuuccuuccaucuuaaa

SEQ ID NO: 59379 - RNA, 18 nt, Artificial Sequence
  Description of Artificial Sequence: Synthetic oligonucleotide
ccuauauuuccuuccauc

SEQ ID NO: 59380 - RNA, 18 nt, Artificial Sequence
  Description of Artificial Sequence: Synthetic oligonucleotide
augcaccuauauuuccuu

SEQ ID NO: 59381 - RNA, 18 nt, Artificial Sequence
  Description of Artificial Sequence: Synthetic oligonucleotide
uuuaaaugcaccuauauu

SEQ ID NO: 59382 - RNA, 18 nt, Artificial Sequence
  Description of Artificial Sequence: Synthetic oligonucleotide
cauuuuuuaaaugcaccu

SEQ ID NO: 59383 - RNA, 18 nt, Artificial Sequence
  Description of Artificial Sequence: Synthetic oligonucleotide
agcuccauuuuuuaaaug

SEQ ID NO: 59384 - RNA, 18 nt, Artificial Sequence
  Description of Artificial Sequence: Synthetic oligonucleotide
aaccaagcuccauuuuuu

SEQ ID NO: 59385 - RNA, 18 nt, Artificial Sequence
  Description of Artificial Sequence: Synthetic oligonucleotide
caugcaaccaagcuccau

SEQ ID NO: 59386 - RNA, 18 nt, Artificial Sequence
  Description of Artificial Sequence: Synthetic oligonucleotide
aaaaucaugcaaccaagc

SEQ ID NO: 59387 - RNA, 18 nt, Artificial Sequence
  Description of Artificial Sequence: Synthetic oligonucleotide
gagcgaaaaucaugcaac

SEQ ID NO: 59388 - RNA, 18 nt, Artificial Sequence
  Description of Artificial Sequence: Synthetic oligonucleotide
cucaagagcgaaaaucau

SEQ ID NO: 59389 - RNA, 18 nt, Artificial Sequence
  Description of Artificial Sequence: Synthetic oligonucleotide
gaugacucaagagcgaaa

SEQ ID NO: 59390 - RNA, 18 nt, Artificial Sequence
  Description of Artificial Sequence: Synthetic oligonucleotide
ggcuagaugacucaagag

SEQ ID NO: 59391 - RNA, 18 nt, Artificial Sequence
  Description of Artificial Sequence: Synthetic oligonucleotide
uagagggcuagaugacuc

SEQ ID NO: 59392 - RNA, 18 nt, Artificial Sequence
  Description of Artificial Sequence: Synthetic oligonucleotide
aucauuagagggcuagau

SEQ ID NO: 59393 - RNA, 18 nt, Artificial Sequence
  Description of Artificial Sequence: Synthetic oligonucleotide
aggcaaucauuagagggc

SEQ ID NO: 59394 - RNA, 18 nt, Artificial Sequence
  Description of Artificial Sequence: Synthetic oligonucleotide
guaugaggcaaucauuag

SEQ ID NO: 59395 - RNA, 18 nt, Artificial Sequence
  Description of Artificial Sequence: Synthetic oligonucleotide
caccgguaugaggcaauc

SEQ ID NO: 59396 - RNA, 18 nt, Artificial Sequence
  Description of Artificial Sequence: Synthetic oligonucleotide
guaaucaccgguaugagg

SEQ ID NO: 59397 - RNA, 18 nt, Artificial Sequence
  Description of Artificial Sequence: Synthetic oligonucleotide
cgcucguaaucaccggua

SEQ ID NO: 59398 - RNA, 18 nt, Artificial Sequence
  Description of Artificial Sequence: Synthetic oligonucleotide
aaagccgcucguaaucac

SEQ ID NO: 59399 - RNA, 18 nt, Artificial Sequence
  Description of Artificial Sequence: Synthetic oligonucleotide
caugaaaagccgcucgua

SEQ ID NO: 59400 - RNA, 18 nt, Artificial Sequence
  Description of Artificial Sequence: Synthetic oligonucleotide
gggucaugaaaagccgcu

SEQ ID NO: 59401 - RNA, 18 nt, Artificial Sequence
  Description of Artificial Sequence: Synthetic oligonucleotide
aaaugguacauauggaag

SEQ ID NO: 59402 - RNA, 18 nt, Artificial Sequence
  Description of Artificial Sequence: Synthetic oligonucleotide
uuuuaaaaugguacauau

SEQ ID NO: 59403 - RNA, 18 nt, Artificial Sequence
  Description of Artificial Sequence: Synthetic oligonucleotide
cagcauuuuaaaauggua

SEQ ID NO: 59404 - RNA, 18 nt, Artificial Sequence
  Description of Artificial Sequence: Synthetic oligonucleotide
guaaucagcauuuuaaaa

SEQ ID NO: 59405 - RNA, 18 nt, Artificial Sequence
  Description of Artificial Sequence: Synthetic oligonucleotide
aagaaguaaucagcauuu

SEQ ID NO: 59406 - RNA, 18 nt, Artificial Sequence
  Description of Artificial Sequence: Synthetic oligonucleotide
uucucaagaaguaaucag

SEQ ID NO: 59407 - RNA, 18 nt, Artificial Sequence
  Description of Artificial Sequence: Synthetic oligonucleotide
ucuuauucucaagaagua

SEQ ID NO: 59408 - RNA, 18 nt, Artificial Sequence
  Description of Artificial Sequence: Synthetic oligonucleotide
gcuucucuuauucucaag

SEQ ID NO: 59409 - RNA, 18 nt, Artificial Sequence
  Description of Artificial Sequence: Synthetic oligonucleotide
auuaggcuucucuuauuc

SEQ ID NO: 59410 - RNA, 18 nt, Artificial Sequence
  Description of Artificial Sequence: Synthetic oligonucleotide
cugaaauuaggcuucucu

SEQ ID NO: 59411 - RNA, 18 nt, Artificial Sequence
  Description of Artificial Sequence: Synthetic oligonucleotide
auauucugaaauuaggcu

SEQ ID NO: 59412 - RNA, 18 nt, Artificial Sequence
  Description of Artificial Sequence: Synthetic oligonucleotide
uaaugauauucugaaauu

SEQ ID NO: 59413 - RNA, 18 nt, Artificial Sequence
  Description of Artificial Sequence: Synthetic oligonucleotide
uacccuaaugauauucug

SEQ ID NO: 59414 - RNA, 18 nt, Artificial Sequence
  Description of Artificial Sequence: Synthetic oligonucleotide
auagguacccuaaugaua

SEQ ID NO: 59415 - RNA, 18 nt, Artificial Sequence
  Description of Artificial Sequence: Synthetic oligonucleotide
cuucaauagguacccuaa

SEQ ID NO: 59416 - RNA, 18 nt, Artificial Sequence
  Description of Artificial Sequence: Synthetic oligonucleotide
caagacuucaauagguac

SEQ ID NO: 59417 - RNA, 18 nt, Artificial Sequence
  Description of Artificial Sequence: Synthetic oligonucleotide
gcagucaagacuucaaua

SEQ ID NO: 59418 - RNA, 18 nt, Artificial Sequence
  Description of Artificial Sequence: Synthetic oligonucleotide
uaugugcagucaagacuu

SEQ ID NO: 59419 - RNA, 18 nt, Artificial Sequence
  Description of Artificial Sequence: Synthetic oligonucleotide
cuaaauaugugcagucaa

SEQ ID NO: 59420 - RNA, 18 nt, Artificial Sequence
  Description of Artificial Sequence: Synthetic oligonucleotide
guaugcuaaauaugugca

SEQ ID NO: 59421 - RNA, 18 nt, Artificial Sequence
  Description of Artificial Sequence: Synthetic oligonucleotide
agggaguaugcuaaauau

SEQ ID NO: 59422 - RNA, 18 nt, Artificial Sequence
  Description of Artificial Sequence: Synthetic oligonucleotide
uucccagggaguaugcua

SEQ ID NO: 59423 - RNA, 18 nt, Artificial Sequence
  Description of Artificial Sequence: Synthetic oligonucleotide
uauaauucccagggagua

SEQ ID NO: 59424 - RNA, 18 nt, Artificial Sequence
  Description of Artificial Sequence: Synthetic oligonucleotide
uaaaauauaauucccagg

SEQ ID NO: 59425 - RNA, 18 nt, Artificial Sequence
  Description of Artificial Sequence: Synthetic oligonucleotide
guccuuaaaauauaauuc

SEQ ID NO: 59426 - RNA, 18 nt, Artificial Sequence
  Description of Artificial Sequence: Synthetic oligonucleotide
aaaauguccuuaaaauau

SEQ ID NO: 59427 - RNA, 18 nt, Artificial Sequence
  Description of Artificial Sequence: Synthetic oligonucleotide
auagaaaaauguccuuaa

SEQ ID NO: 59428 - RNA, 18 nt, Artificial Sequence
  Description of Artificial Sequence: Synthetic oligonucleotide
auuuaauagaaaaauguc

SEQ ID NO: 59429 - RNA, 18 nt, Artificial Sequence
  Description of Artificial Sequence: Synthetic oligonucleotide
caaugauuuaauagaaaa

SEQ ID NO: 59430 - RNA, 18 nt, Artificial Sequence
  Description of Artificial Sequence: Synthetic oligonucleotide
auaugcaaugauuuaaua

SEQ ID NO: 59431 - RNA, 18 nt, Artificial Sequence
  Description of Artificial Sequence: Synthetic oligonucleotide
cuuccauaugcaaugauu

SEQ ID NO: 59432 - RNA, 18 nt, Artificial Sequence
  Description of Artificial Sequence: Synthetic oligonucleotide
aguuucuuccauaugcaa

SEQ ID NO: 59433 - RNA, 18 nt, Artificial Sequence
  Description of Artificial Sequence: Synthetic oligonucleotide
uauugaguuucuuccaua

SEQ ID NO: 59434 - RNA, 18 nt, Artificial Sequence
  Description of Artificial Sequence: Synthetic oligonucleotide
uauuauauugaguuucuu

SEQ ID NO: 59435 - RNA, 18 nt, Artificial Sequence
  Description of Artificial Sequence: Synthetic oligonucleotide
ucagcuauuauauugagu

SEQ ID NO: 59436 - RNA, 18 nt, Artificial Sequence
  Description of Artificial Sequence: Synthetic oligonucleotide
aaauaucagcuauuauau

SEQ ID NO: 59437 - RNA, 18 nt, Artificial Sequence
  Description of Artificial Sequence: Synthetic oligonucleotide
caaguaaauaucagcuau

SEQ ID NO: 59438 - RNA, 18 nt, Artificial Sequence
  Description of Artificial Sequence: Synthetic oligonucleotide
gaacccaaguaaauauca

SEQ ID NO: 59439 - RNA, 18 nt, Artificial Sequence
  Description of Artificial Sequence: Synthetic oligonucleotide
auuaagaacccaaguaaa

SEQ ID NO: 59440 - RNA, 18 nt, Artificial Sequence
  Description of Artificial Sequence: Synthetic oligonucleotide
uucugauuaagaacccaa

SEQ ID NO: 59441 - RNA, 18 nt, Artificial Sequence
  Description of Artificial Sequence: Synthetic oligonucleotide
caauguucugauuaagaa

SEQ ID NO: 59442 - RNA, 18 nt, Artificial Sequence
  Description of Artificial Sequence: Synthetic oligonucleotide
acagccaauguucugauu

SEQ ID NO: 59443 - RNA, 18 nt, Artificial Sequence
  Description of Artificial Sequence: Synthetic oligonucleotide
aucacacagccaauguuc

SEQ ID NO: 59444 - RNA, 18 nt, Artificial Sequence
  Description of Artificial Sequence: Synthetic oligonucleotide
ugaaaaucacacagccaa

SEQ ID NO: 59445 - RNA, 18 nt, Artificial Sequence
  Description of Artificial Sequence: Synthetic oligonucleotide
aaucaugaaaaucacaca

SEQ ID NO: 59446 - RNA, 18 nt, Artificial Sequence
  Description of Artificial Sequence: Synthetic oligonucleotide
aucauaaucaugaaaauc

SEQ ID NO: 59447 - RNA, 18 nt, Artificial Sequence
  Description of Artificial Sequence: Synthetic oligonucleotide
ugaaaaucauaaucauga

SEQ ID NO: 59448 - RNA, 18 nt, Artificial Sequence
  Description of Artificial Sequence: Synthetic oligonucleotide
ugcaaugaaaaucauaau

SEQ ID NO: 59449 - RNA, 18 nt, Artificial Sequence
  Description of Artificial Sequence: Synthetic oligonucleotide
uuaauugcaaugaaaauc

SEQ ID NO: 59450 - RNA, 18 nt, Artificial Sequence
  Description of Artificial Sequence: Synthetic oligonucleotide
ucaacuuaauugcaauga

SEQ ID NO: 59451 - RNA, 18 nt, Artificial Sequence
  Description of Artificial Sequence: Synthetic oligonucleotide
aaacaucaacuuaauugc

SEQ ID NO: 59452 - RNA, 18 nt, Artificial Sequence
  Description of Artificial Sequence: Synthetic oligonucleotide
cuacaaaacaucaacuua

SEQ ID NO: 59453 - RNA, 18 nt, Artificial Sequence
  Description of Artificial Sequence: Synthetic oligonucleotide
acugucuacaaaacauca

SEQ ID NO: 59454 - RNA, 18 nt, Artificial Sequence
  Description of Artificial Sequence: Synthetic oligonucleotide
auuucacugucuacaaaa

SEQ ID NO: 59455 - RNA, 18 nt, Artificial Sequence
  Description of Artificial Sequence: Synthetic oligonucleotide
ugguaauuucacugucua

SEQ ID NO: 59456 - RNA, 18 nt, Artificial Sequence
  Description of Artificial Sequence: Synthetic oligonucleotide
guagaugguaauuucacu

SEQ ID NO: 59457 - RNA, 18 nt, Artificial Sequence
  Description of Artificial Sequence: Synthetic oligonucleotide
uuggaguagaugguaauu

SEQ ID NO: 59458 - RNA, 18 nt, Artificial Sequence
  Description of Artificial Sequence: Synthetic oligonucleotide
aucuuuuggaguagaugg

SEQ ID NO: 59459 - RNA, 18 nt, Artificial Sequence
  Description of Artificial Sequence: Synthetic oligonucleotide
uugcaaucuuuuggagua

SEQ ID NO: 59460 - RNA, 18 nt, Artificial Sequence
  Description of Artificial Sequence: Synthetic oligonucleotide
cuauuuugcaaucuuuug

SEQ ID NO: 59461 - RNA, 18 nt, Artificial Sequence
  Description of Artificial Sequence: Synthetic oligonucleotide
aaauucuauuuugcaauc

SEQ ID NO: 59462 - RNA, 18 nt, Artificial Sequence
  Description of Artificial Sequence: Synthetic oligonucleotide
agguuaaauucuauuuug

SEQ ID NO: 59463 - RNA, 18 nt, Artificial Sequence
  Description of Artificial Sequence: Synthetic oligonucleotide
cucuaagguuaaauucua

SEQ ID NO: 59464 - RNA, 18 nt, Artificial Sequence
  Description of Artificial Sequence: Synthetic oligonucleotide
auuggcucuaagguuaaa

SEQ ID NO: 59465 - RNA, 18 nt, Artificial Sequence
  Description of Artificial Sequence: Synthetic oligonucleotide
ccugcauuggcucuaagg

SEQ ID NO: 59466 - RNA, 18 nt, Artificial Sequence
  Description of Artificial Sequence: Synthetic oligonucleotide
uuuucccugcauuggcuc

SEQ ID NO: 59467 - RNA, 18 nt, Artificial Sequence
  Description of Artificial Sequence: Synthetic oligonucleotide
acaaguuuucccugcauu

SEQ ID NO: 59468 - RNA, 18 nt, Artificial Sequence
  Description of Artificial Sequence: Synthetic oligonucleotide
cagaaacaaguuuucccu

SEQ ID NO: 59469 - RNA, 18 nt, Artificial Sequence
  Description of Artificial Sequence: Synthetic oligonucleotide
accugcagaaacaaguuu

SEQ ID NO: 59470 - RNA, 18 nt, Artificial Sequence
  Description of Artificial Sequence: Synthetic oligonucleotide
aaugcaccugcagaaaca

SEQ ID NO: 59471 - RNA, 18 nt, Artificial Sequence
  Description of Artificial Sequence: Synthetic oligonucleotide
caaaaaaugcaccugcag

SEQ ID NO: 59472 - RNA, 18 nt, Artificial Sequence
  Description of Artificial Sequence: Synthetic oligonucleotide
aguuucaaaaaaugcacc

SEQ ID NO: 59473 - RNA, 18 nt, Artificial Sequence
  Description of Artificial Sequence: Synthetic oligonucleotide
guugaaguuucaaaaaau

SEQ ID NO: 59474 - RNA, 18 nt, Artificial Sequence
  Description of Artificial Sequence: Synthetic oligonucleotide
uaucuguugaaguuucaa

SEQ ID NO: 59475 - RNA, 18 nt, Artificial Sequence
  Description of Artificial Sequence: Synthetic oligonucleotide
ccugcuaucuguugaagu

SEQ ID NO: 59476 - RNA, 18 nt, Artificial Sequence
  Description of Artificial Sequence: Synthetic oligonucleotide
uucccccugcuaucuguu

SEQ ID NO: 59477 - RNA, 18 nt, Artificial Sequence
  Description of Artificial Sequence: Synthetic oligonucleotide
uuuuuuucccccugcuau

SEQ ID NO: 59478 - RNA, 18 nt, Artificial Sequence
  Description of Artificial Sequence: Synthetic oligonucleotide
ucacuuuuuuuucccccu

SEQ ID NO: 59479 - RNA, 18 nt, Artificial Sequence
  Description of Artificial Sequence: Synthetic oligonucleotide
uucugucacuuuuuuuuc

SEQ ID NO: 59480 - RNA, 18 nt, Artificial Sequence
  Description of Artificial Sequence: Synthetic oligonucleotide
gauccuucugucacuuuu

SEQ ID NO: 59481 - RNA, 18 nt, Artificial Sequence
  Description of Artificial Sequence: Synthetic oligonucleotide
acugugauccuucuguca

SEQ ID NO: 59482 - RNA, 18 nt, Artificial Sequence
  Description of Artificial Sequence: Synthetic oligonucleotide
gcugaacugugauccuuc

SEQ ID NO: 59483 - RNA, 18 nt, Artificial Sequence
  Description of Artificial Sequence: Synthetic oligonucleotide
auacugcugaacugugau

SEQ ID NO: 59484 - RNA, 18 nt, Artificial Sequence
  Description of Artificial Sequence: Synthetic oligonucleotide
aauucauacugcugaacu

SEQ ID NO: 59485 - RNA, 18 nt, Artificial Sequence
  Description of Artificial Sequence: Synthetic oligonucleotide
cagacaauucauacugcu

SEQ ID NO: 59486 - RNA, 18 nt, Artificial Sequence
  Description of Artificial Sequence: Synthetic oligonucleotide
gccagcagacaauucaua

SEQ ID NO: 59487 - RNA, 18 nt, Artificial Sequence
  Description of Artificial Sequence: Synthetic oligonucleotide
aggcugccagcagacaau

SEQ ID NO: 59488 - RNA, 18 nt, Artificial Sequence
  Description of Artificial Sequence: Synthetic oligonucleotide
uugcaaggcugccagcag

SEQ ID NO: 59489 - RNA, 18 nt, Artificial Sequence
  Description of Artificial Sequence: Synthetic oligonucleotide
ccagauugcaaggcugcc

SEQ ID NO: 59490 - RNA, 18 nt, Artificial Sequence
  Description of Artificial Sequence: Synthetic oligonucleotide
gcacaccagauugcaagg

SEQ ID NO: 59491 - RNA, 18 nt, Artificial Sequence
  Description of Artificial Sequence: Synthetic oligonucleotide
ugccugcacaccagauug

SEQ ID NO: 59492 - RNA, 18 nt, Artificial Sequence
  Description of Artificial Sequence: Synthetic oligonucleotide
cucacugccugcacacca

SEQ ID NO: 59493 - RNA, 18 nt, Artificial Sequence
  Description of Artificial Sequence: Synthetic oligonucleotide
acaaucucacugccugca

SEQ ID NO: 59494 - RNA, 18 nt, Artificial Sequence
  Description of Artificial Sequence: Synthetic oligonucleotide
acaccacaaucucacugc

SEQ ID NO: 59495 - RNA, 18 nt, Artificial Sequence
  Description of Artificial Sequence: Synthetic oligonucleotide
cauguacaccacaaucuc

SEQ ID NO: 59496 - RNA, 18 nt, Artificial Sequence
  Description of Artificial Sequence: Synthetic oligonucleotide
ggugacauguacaccaca

SEQ ID NO: 59497 - RNA, 18 nt, Artificial Sequence
  Description of Artificial Sequence: Synthetic oligonucleotide
aaucaggugacauguaca

SEQ ID NO: 59498 - RNA, 18 nt, Artificial Sequence
  Description of Artificial Sequence: Synthetic oligonucleotide
uguaguccugguggcaug

SEQ ID NO: 59499 - RNA, 18 nt, Artificial Sequence
  Description of Artificial Sequence: Synthetic oligonucleotide
gccccuguaguccuggug

SEQ ID NO: 59500 - RNA, 18 nt, Artificial Sequence
  Description of Artificial Sequence: Synthetic oligonucleotide
acucugccccuguagucc

SEQ ID NO: 59501 - RNA, 18 nt, Artificial Sequence
  Description of Artificial Sequence: Synthetic oligonucleotide
gagacacucugccccugu

SEQ ID NO: 59502 - RNA, 18 nt, Artificial Sequence
  Description of Artificial Sequence: Synthetic oligonucleotide
cagaggagacacucugcc

SEQ ID NO: 59503 - RNA, 18 nt, Artificial Sequence
  Description of Artificial Sequence: Synthetic oligonucleotide
gcugccagaggagacacu

SEQ ID NO: 59504 - RNA, 18 nt, Artificial Sequence
  Description of Artificial Sequence: Synthetic oligonucleotide
ucagagcugccagaggag

SEQ ID NO: 59505 - RNA, 18 nt, Artificial Sequence
  Description of Artificial Sequence: Synthetic oligonucleotide
ugaucucagagcugccag

SEQ ID NO: 59506 - RNA, 18 nt, Artificial Sequence
  Description of Artificial Sequence: Synthetic oligonucleotide
ggauuugaucucagagcu

SEQ ID NO: 59507 - RNA, 18 nt, Artificial Sequence
  Description of Artificial Sequence: Synthetic oligonucleotide
ucaucggauuugaucuca

SEQ ID NO: 59508 - RNA, 18 nt, Artificial Sequence
  Description of Artificial Sequence: Synthetic oligonucleotide
ccucgucaucggauuuga

SEQ ID NO: 59509 - RNA, 18 nt, Artificial Sequence
  Description of Artificial Sequence: Synthetic oligonucleotide
aucacccucgucaucgga

SEQ ID NO: 59510 - RNA, 18 nt, Artificial Sequence
  Description of Artificial Sequence: Synthetic oligonucleotide
uucucaucacccucguca

SEQ ID NO: 59511 - RNA, 18 nt, Artificial Sequence
  Description of Artificial Sequence: Synthetic oligonucleotide
gcagguucucaucacccu

SEQ ID NO: 59512 - RNA, 18 nt, Artificial Sequence
  Description of Artificial Sequence: Synthetic oligonucleotide
gucuugcagguucucauc

SEQ ID NO: 59513 - RNA, 18 nt, Artificial Sequence
  Description of Artificial Sequence: Synthetic oligonucleotide
uucgugucuugcagguuc

SEQ ID NO: 59514 - RNA, 18 nt, Artificial Sequence
  Description of Artificial Sequence: Synthetic oligonucleotide
aagauuucgugucuugca

SEQ ID NO: 59515 - RNA, 18 nt, Artificial Sequence
  Description of Artificial Sequence: Synthetic oligonucleotide
cuccgaagauuucguguc

SEQ ID NO: 59516 - RNA, 18 nt, Artificial Sequence
  Description of Artificial Sequence: Synthetic oligonucleotide
uuguccuccgaagauuuc

SEQ ID NO: 59517 - RNA, 18 nt, Artificial Sequence
  Description of Artificial Sequence: Synthetic oligonucleotide
auuucuuguccuccgaag

SEQ ID NO: 59518 - RNA, 18 nt, Artificial Sequence
  Description of Artificial Sequence: Synthetic oligonucleotide
aucuaauuucuuguccuc

SEQ ID NO: 59519 - RNA, 18 nt, Artificial Sequence
  Description of Artificial Sequence: Synthetic oligonucleotide
ucgucaucuaauuucuug

SEQ ID NO: 59520 - RNA, 18 nt, Artificial Sequence
  Description of Artificial Sequence: Synthetic oligonucleotide
ucuugucgucaucuaauu

SEQ ID NO: 59521 - RNA, 18 nt, Artificial Sequence
  Description of Artificial Sequence: Synthetic oligonucleotide
auccuucuugucgucauc

SEQ ID NO: 59522 - RNA, 18 nt, Artificial Sequence
  Description of Artificial Sequence: Synthetic oligonucleotide
uugauauccuucuugucg

SEQ ID NO: 59523 - RNA, 18 nt, Artificial Sequence
  Description of Artificial Sequence: Synthetic oligonucleotide
uugauuugauauccuucu

SEQ ID NO: 59524 - RNA, 18 nt, Artificial Sequence
  Description of Artificial Sequence: Synthetic oligonucleotide
aguaauugauuugauauc

SEQ ID NO: 59525 - RNA, 18 nt, Artificial Sequence
  Description of Artificial Sequence: Synthetic oligonucleotide
gaccuaguaauugauuug

SEQ ID NO: 59526 - RNA, 18 nt, Artificial Sequence
  Description of Artificial Sequence: Synthetic oligonucleotide
aucuugaccuaguaauug

SEQ ID NO: 59527 - RNA, 18 nt, Artificial Sequence
  Description of Artificial Sequence: Synthetic oligonucleotide
agacaucguugaagauga

SEQ ID NO: 59528 - RNA, 18 nt, Artificial Sequence
  Description of Artificial Sequence: Synthetic oligonucleotide
ugcauagacaucguugaa

SEQ ID NO: 59529 - RNA, 18 nt, Artificial Sequence
  Description of Artificial Sequence: Synthetic oligonucleotide
gaagcugcauagacaucg

SEQ ID NO: 59530 - RNA, 18 nt, Artificial Sequence
  Description of Artificial Sequence: Synthetic oligonucleotide
acuuggaagcugcauaga

SEQ ID NO: 59531 - RNA, 18 nt, Artificial Sequence
  Description of Artificial Sequence: Synthetic oligonucleotide
ggcgaacuuggaagcugc

SEQ ID NO: 59532 - RNA, 18 nt, Artificial Sequence
  Description of Artificial Sequence: Synthetic oligonucleotide
uccagggcgaacuuggaa

SEQ ID NO: 59533 - RNA, 18 nt, Artificial Sequence
  Description of Artificial Sequence: Synthetic oligonucleotide
aucccuccagggcgaacu

SEQ ID NO: 59534 - RNA, 18 nt, Artificial Sequence
  Description of Artificial Sequence: Synthetic oligonucleotide
gaagaaucccuccagggc

SEQ ID NO: 59535 - RNA, 18 nt, Artificial Sequence
  Description of Artificial Sequence: Synthetic oligonucleotide
cuuucgaagaaucccucc

SEQ ID NO: 59536 - RNA, 18 nt, Artificial Sequence
  Description of Artificial Sequence: Synthetic oligonucleotide
cgaggcuuucgaagaauc

SEQ ID NO: 59537 - RNA, 18 nt, Artificial Sequence
  Description of Artificial Sequence: Synthetic oligonucleotide
gauagcgaggcuuucgaa

SEQ ID NO: 59538 - RNA, 18 nt, Artificial Sequence
  Description of Artificial Sequence: Synthetic oligonucleotide
agcuggauagcgaggcuu

SEQ ID NO: 59539 - RNA, 18 nt, Artificial Sequence
  Description of Artificial Sequence: Synthetic oligonucleotide
gcagcagcuggauagcga

SEQ ID NO: 59540 - RNA, 18 nt, Artificial Sequence
  Description of Artificial Sequence: Synthetic oligonucleotide
gaacugcagcagcuggau

SEQ ID NO: 59541 - RNA, 18 nt, Artificial Sequence
  Description of Artificial Sequence: Synthetic oligonucleotide
auguugaacugcagcagc

SEQ ID NO: 59542 - RNA, 18 nt, Artificial Sequence
  Description of Artificial Sequence: Synthetic oligonucleotide
cucugcccacgugcccgc

SEQ ID NO: 59543 - RNA, 18 nt, Artificial Sequence
  Description of Artificial Sequence: Synthetic oligonucleotide
gcccccucugcccacgug

SEQ ID NO: 59544 - RNA, 18 nt, Artificial Sequence
  Description of Artificial Sequence: Synthetic oligonucleotide
uccaagcccccucugccc

SEQ ID NO: 59545 - RNA, 18 nt, Artificial Sequence
  Description of Artificial Sequence: Synthetic oligonucleotide
cuggcuccaagcccccuc

SEQ ID NO: 59546 - RNA, 18 nt, Artificial Sequence
  Description of Artificial Sequence: Synthetic oligonucleotide
caucacuggcuccaagcc

SEQ ID NO: 59547 - RNA, 18 nt, Artificial Sequence
  Description of Artificial Sequence: Synthetic oligonucleotide
cuccccaucacuggcucc

SEQ ID NO: 59548 - RNA, 18 nt, Artificial Sequence
  Description of Artificial Sequence: Synthetic oligonucleotide
gccaccuccccaucacug

SEQ ID NO: 59549 - RNA, 18 nt, Artificial Sequence
  Description of Artificial Sequence: Synthetic oligonucleotide
ucgaugccaccuccccau

SEQ ID NO: 59550 - RNA, 18 nt, Artificial Sequence
  Description of Artificial Sequence: Synthetic oligonucleotide
cccuuucgaugccaccuc

SEQ ID NO: 59551 - RNA, 18 nt, Artificial Sequence
  Description of Artificial Sequence: Synthetic oligonucleotide
ucucccccuuucgaugcc

SEQ ID NO: 59552 - RNA, 18 nt, Artificial Sequence
  Description of Artificial Sequence: Synthetic oligonucleotide
ucuccucucccccuuucg

SEQ ID NO: 59553 - RNA, 18 nt, Artificial Sequence
  Description of Artificial Sequence: Synthetic oligonucleotide
ucaucucuccucuccccc

SEQ ID NO: 59554 - RNA, 18 nt, Artificial Sequence
  Description of Artificial Sequence: Synthetic oligonucleotide
ugucuucaucucuccucu

SEQ ID NO: 59555 - RNA, 18 nt, Artificial Sequence
  Description of Artificial Sequence: Synthetic oligonucleotide
uucauugucuucaucucu

SEQ ID NO: 59556 - RNA, 18 nt, Artificial Sequence
  Description of Artificial Sequence: Synthetic oligonucleotide
ucagcuucauugucuuca

SEQ ID NO: 59557 - RNA, 18 nt, Artificial Sequence
  Description of Artificial Sequence: Synthetic oligonucleotide
ugcacucagcuucauugu

SEQ ID NO: 59558 - RNA, 18 nt, Artificial Sequence
  Description of Artificial Sequence: Synthetic oligonucleotide
gccacugcacucagcuuc

SEQ ID NO: 59559 - RNA, 18 nt, Artificial Sequence
  Description of Artificial Sequence: Synthetic oligonucleotide
ugugagccacugcacuca

SEQ ID NO: 59560 - RNA, 18 nt, Artificial Sequence
  Description of Artificial Sequence: Synthetic oligonucleotide
acaggugugagccacugc

SEQ ID NO: 59561 - RNA, 18 nt, Artificial Sequence
  Description of Artificial Sequence: Synthetic oligonucleotide
gacuuacaggugugagcc

SEQ ID NO: 59562 - RNA, 18 nt, Artificial Sequence
  Description of Artificial Sequence: Synthetic oligonucleotide
cgcuggacuuacaggugu

SEQ ID NO: 59563 - RNA, 18 nt, Artificial Sequence
  Description of Artificial Sequence: Synthetic oligonucleotide
caaaacgcuggacuuaca

SEQ ID NO: 59564 - RNA, 18 nt, Artificial Sequence
  Description of Artificial Sequence: Synthetic oligonucleotide
ccucucaaaacgcuggac

SEQ ID NO: 59565 - RNA, 18 nt, Artificial Sequence
  Description of Artificial Sequence: Synthetic oligonucleotide
uucagccucucaaaacgc

SEQ ID NO: 59566 - RNA, 18 nt, Artificial Sequence
  Description of Artificial Sequence: Synthetic oligonucleotide
cccauuucagccucucaa

SEQ ID NO: 59567 - RNA, 18 nt, Artificial Sequence
  Description of Artificial Sequence: Synthetic oligonucleotide
auccucccauuucagccu

SEQ ID NO: 59568 - RNA, 18 nt, Artificial Sequence
  Description of Artificial Sequence: Synthetic oligonucleotide
aagcgauccucccauuuc

SEQ ID NO: 59569 - RNA, 18 nt, Artificial Sequence
  Description of Artificial Sequence: Synthetic oligonucleotide
accucaagcgauccuccc

SEQ ID NO: 59570 - RNA, 18 nt, Artificial Sequence
  Description of Artificial Sequence: Synthetic oligonucleotide
gccugaccucaagcgauc

SEQ ID NO: 59571 - RNA, 18 nt, Artificial Sequence
  Description of Artificial Sequence: Synthetic oligonucleotide
caaaugccugaccucaag

SEQ ID NO: 59572 - RNA, 18 nt, Artificial Sequence
  Description of Artificial Sequence: Synthetic oligonucleotide
ggucucaaaugccugacc

SEQ ID NO: 59573 - RNA, 18 nt, Artificial Sequence
  Description of Artificial Sequence: Synthetic oligonucleotide
aggcuggucucaaaugcc

SEQ ID NO: 59574 - RNA, 18 nt, Artificial Sequence
  Description of Artificial Sequence: Synthetic oligonucleotide
ugcccaggcuggucucaa

SEQ ID NO: 59575 - RNA, 18 nt, Artificial Sequence
  Description of Artificial Sequence: Synthetic oligonucleotide
uauguugcccaggcuggu

SEQ ID NO: 59576 - RNA, 18 nt, Artificial Sequence
  Description of Artificial Sequence: Synthetic oligonucleotide
cucgcuauguugcccagg

SEQ ID NO: 59577 - RNA, 18 nt, Artificial Sequence
  Description of Artificial Sequence: Synthetic oligonucleotide
gggucucgcuauguugcc

SEQ ID NO: 59578 - RNA, 18 nt, Artificial Sequence
  Description of Artificial Sequence: Synthetic oligonucleotide
auuuugggcugagauggg

SEQ ID NO: 59579 - RNA, 18 nt, Artificial Sequence
  Description of Artificial Sequence: Synthetic oligonucleotide
uuuaaauuuugggcugag

SEQ ID NO: 59580 - RNA, 18 nt, Artificial Sequence
  Description of Artificial Sequence: Synthetic oligonucleotide
uaauuuuuaaauuuuggg

SEQ ID NO: 59581 - RNA, 18 nt, Artificial Sequence
  Description of Artificial Sequence: Synthetic oligonucleotide
uuggcuaauuuuuaaauu

SEQ ID NO: 59582 - RNA, 18 nt, Artificial Sequence
  Description of Artificial Sequence: Synthetic oligonucleotide
cacccuuggcuaauuuuu

SEQ ID NO: 59583 - RNA, 18 nt, Artificial Sequence
  Description of Artificial Sequence: Synthetic oligonucleotide
accaccacccuuggcuaa

SEQ ID NO: 59584 - RNA, 18 nt, Artificial Sequence
  Description of Artificial Sequence: Synthetic oligonucleotide
cacacaccaccacccuug

SEQ ID NO: 59585 - RNA, 18 nt, Artificial Sequence
  Description of Artificial Sequence: Synthetic oligonucleotide
agguacacacaccaccac

SEQ ID NO: 59586 - RNA, 18 nt, Artificial Sequence
  Description of Artificial Sequence: Synthetic oligonucleotide
acugcagguacacacacc

SEQ ID NO: 59587 - RNA, 18 nt, Artificial Sequence
  Description of Artificial Sequence: Synthetic oligonucleotide
uaaauuuugggcugagau

SEQ ID NO: 59588 - RNA, 18 nt, Artificial Sequence
  Description of Artificial Sequence: Synthetic oligonucleotide
auuuuuaaauuuugggcu

SEQ ID NO: 59589 - RNA, 18 nt, Artificial Sequence
  Description of Artificial Sequence: Synthetic oligonucleotide
ggcuaauuuuuaaauuuu

SEQ ID NO: 59590 - RNA, 18 nt, Artificial Sequence
  Description of Artificial Sequence: Synthetic oligonucleotide
cccuuggcuaauuuuuaa

SEQ ID NO: 59591 - RNA, 18 nt, Artificial Sequence
  Description of Artificial Sequence: Synthetic oligonucleotide
caccacccuuggcuaauu

SEQ ID NO: 59592 - RNA, 18 nt, Artificial Sequence
  Description of Artificial Sequence: Synthetic oligonucleotide
cacaccaccacccuuggc

SEQ ID NO: 59593 - RNA, 18 nt, Artificial Sequence
  Description of Artificial Sequence: Synthetic oligonucleotide
guacacacaccaccaccc

SEQ ID NO: 59594 - RNA, 18 nt, Artificial Sequence
  Description of Artificial Sequence: Synthetic oligonucleotide
ugcagguacacacaccac

SEQ ID NO: 59595 - RNA, 18 nt, Artificial Sequence
  Description of Artificial Sequence: Synthetic oligonucleotide
gggacugcagguacacac

SEQ ID NO: 59596 - RNA, 18 nt, Artificial Sequence
  Description of Artificial Sequence: Synthetic oligonucleotide
uagcugggacugcaggua

SEQ ID NO: 59597 - RNA, 18 nt, Artificial Sequence
  Description of Artificial Sequence: Synthetic oligonucleotide
cugaguagcugggacugc

SEQ ID NO: 59598 - RNA, 18 nt, Artificial Sequence
  Description of Artificial Sequence: Synthetic oligonucleotide
gccuccugaguagcuggg

SEQ ID NO: 59599 - RNA, 18 nt, Artificial Sequence
  Description of Artificial Sequence: Synthetic oligonucleotide
ccucagccuccugaguag

SEQ ID NO: 59600 - RNA, 18 nt, Artificial Sequence
  Description of Artificial Sequence: Synthetic oligonucleotide
cuccgccucagccuccug

SEQ ID NO: 59601 - RNA, 18 nt, Artificial Sequence
  Description of Artificial Sequence: Synthetic oligonucleotide
caauccuccgccucagcc

SEQ ID NO: 59602 - RNA, 18 nt, Artificial Sequence
  Description of Artificial Sequence: Synthetic oligonucleotide
ucaaacaauccuccgccu

SEQ ID NO: 59603 - RNA, 18 nt, Artificial Sequence
  Description of Artificial Sequence: Synthetic oligonucleotide
uggguucaaacaauccuc

SEQ ID NO: 59604 - RNA, 18 nt, Artificial Sequence
  Description of Artificial Sequence: Synthetic oligonucleotide
acuccuggguucaaacaa

SEQ ID NO: 59605 - RNA, 18 nt, Artificial Sequence
  Description of Artificial Sequence: Synthetic oligonucleotide
cuccaacuccuggguuca

SEQ ID NO: 59606 - RNA, 18 nt, Artificial Sequence
  Description of Artificial Sequence: Synthetic oligonucleotide
gcagccuccaacuccugg

SEQ ID NO: 59607 - RNA, 18 nt, Artificial Sequence
  Description of Artificial Sequence: Synthetic oligonucleotide
ugucugcagccuccaacu

SEQ ID NO: 59608 - RNA, 18 nt, Artificial Sequence
  Description of Artificial Sequence: Synthetic oligonucleotide
auagcugucugcagccuc

SEQ ID NO: 59609 - RNA, 18 nt, Artificial Sequence
  Description of Artificial Sequence: Synthetic oligonucleotide
ugaucauagcugucugca

SEQ ID NO: 59610 - RNA, 18 nt, Artificial Sequence
  Description of Artificial Sequence: Synthetic oligonucleotide
uggcaugaucauagcugu

SEQ ID NO: 59611 - RNA, 18 nt, Artificial Sequence
  Description of Artificial Sequence: Synthetic oligonucleotide
ugcaguggcaugaucaua

SEQ ID NO: 59612 - RNA, 18 nt, Artificial Sequence
  Description of Artificial Sequence: Synthetic oligonucleotide
uggagugcaguggcauga

SEQ ID NO: 59613 - RNA, 18 nt, Artificial Sequence
  Description of Artificial Sequence: Synthetic oligonucleotide
caggcuggagugcagugg

SEQ ID NO: 59614 - RNA, 18 nt, Artificial Sequence
  Description of Artificial Sequence: Synthetic oligonucleotide
uugcccaggcuggagugc

SEQ ID NO: 59615 - RNA, 18 nt, Artificial Sequence
  Description of Artificial Sequence: Synthetic oligonucleotide
cucuguugcccaggcugg

SEQ ID NO: 59616 - RNA, 18 nt, Artificial Sequence
  Description of Artificial Sequence: Synthetic oligonucleotide
ucucacucuguugcccag

SEQ ID NO: 59617 - RNA, 18 nt, Artificial Sequence
  Description of Artificial Sequence: Synthetic oligonucleotide
cagggucucacucuguug

SEQ ID NO: 59618 - RNA, 18 nt, Artificial Sequence
  Description of Artificial Sequence: Synthetic oligonucleotide
agauacagggucucacuc

SEQ ID NO: 59619 - RNA, 18 nt, Artificial Sequence
  Description of Artificial Sequence: Synthetic oligonucleotide
uuuuaagauacagggucu

SEQ ID NO: 59620 - RNA, 18 nt, Artificial Sequence
  Description of Artificial Sequence: Synthetic oligonucleotide
uuuuuuuuuaagauacag

SEQ ID NO: 59621 - RNA, 18 nt, Artificial Sequence
  Description of Artificial Sequence: Synthetic oligonucleotide
uuuuuuuuuuuuuuaaga

SEQ ID NO: 59622 - RNA, 18 nt, Artificial Sequence
  Description of Artificial Sequence: Synthetic oligonucleotide
uccauuuuuuuuuuuuuu

SEQ ID NO: 59623 - RNA, 18 nt, Artificial Sequence
  Description of Artificial Sequence: Synthetic oligonucleotide
uuuuguccauuuuuuuuu

SEQ ID NO: 59624 - RNA, 18 nt, Artificial Sequence
  Description of Artificial Sequence: Synthetic oligonucleotide
accuauuuuguccauuuu

SEQ ID NO: 59625 - RNA, 18 nt, Artificial Sequence
  Description of Artificial Sequence: Synthetic oligonucleotide
cccugaccuauuuugucc

SEQ ID NO: 59626 - RNA, 18 nt, Artificial Sequence
  Description of Artificial Sequence: Synthetic oligonucleotide
ccacucccugaccuauuu

SEQ ID NO: 59627 - RNA, 18 nt, Artificial Sequence
  Description of Artificial Sequence: Synthetic oligonucleotide
cccaaccacucccugacc

SEQ ID NO: 59628 - RNA, 18 nt, Artificial Sequence
  Description of Artificial Sequence: Synthetic oligonucleotide
gaugccccaaccacuccc

SEQ ID NO: 59629 - RNA, 18 nt, Artificial Sequence
  Description of Artificial Sequence: Synthetic oligonucleotide
agucugaugccccaacca

SEQ ID NO: 59630 - RNA, 18 nt, Artificial Sequence
  Description of Artificial Sequence: Synthetic oligonucleotide
guguaagucugaugcccc

SEQ ID NO: 59631 - RNA, 18 nt, Artificial Sequence
  Description of Artificial Sequence: Synthetic oligonucleotide
ggguaguguaagucugau

SEQ ID NO: 59632 - RNA, 18 nt, Artificial Sequence
  Description of Artificial Sequence: Synthetic oligonucleotide
uggcuccaccagggagau

SEQ ID NO: 59633 - RNA, 18 nt, Artificial Sequence
  Description of Artificial Sequence: Synthetic oligonucleotide
gggccuggcuccaccagg

SEQ ID NO: 59634 - RNA, 18 nt, Artificial Sequence
  Description of Artificial Sequence: Synthetic oligonucleotide
ccucaaacucggugacca

SEQ ID NO: 59635 - RNA, 18 nt, Artificial Sequence
  Description of Artificial Sequence: Synthetic oligonucleotide
cuuccccucaaacucggu

SEQ ID NO: 59636 - RNA, 18 nt, Artificial Sequence
  Description of Artificial Sequence: Synthetic oligonucleotide
agaagcuuccccucaaac

SEQ ID NO: 59637 - RNA, 18 nt, Artificial Sequence
  Description of Artificial Sequence: Synthetic oligonucleotide
gcgccagaagcuuccccu

SEQ ID NO: 59638 - RNA, 18 nt, Artificial Sequence
  Description of Artificial Sequence: Synthetic oligonucleotide
aaccugcgccagaagcuu

SEQ ID NO: 59639 - RNA, 18 nt, Artificial Sequence
  Description of Artificial Sequence: Synthetic oligonucleotide
auagaaaccugcgccaga

SEQ ID NO: 59640 - RNA, 18 nt, Artificial Sequence
  Description of Artificial Sequence: Synthetic oligonucleotide
cagccauagaaaccugcg

SEQ ID NO: 59641 - RNA, 18 nt, Artificial Sequence
  Description of Artificial Sequence: Synthetic oligonucleotide
gaacucagccauagaaac

SEQ ID NO: 59642 - RNA, 18 nt, Artificial Sequence
  Description of Artificial Sequence: Synthetic oligonucleotide
ccugggaacucagccaua

SEQ ID NO: 59643 - RNA, 18 nt, Artificial Sequence
  Description of Artificial Sequence: Synthetic oligonucleotide
cagugccugggaacucag

SEQ ID NO: 59644 - RNA, 18 nt, Artificial Sequence
  Description of Artificial Sequence: Synthetic oligonucleotide
agggucagugccugggaa

SEQ ID NO: 59645 - RNA, 18 nt, Artificial Sequence
  Description of Artificial Sequence: Synthetic oligonucleotide
gucucagggucagugccu

SEQ ID NO: 59646 - RNA, 18 nt, Artificial Sequence
  Description of Artificial Sequence: Synthetic oligonucleotide
gcagggucucagggucag

SEQ ID NO: 59647 - RNA, 18 nt, Artificial Sequence
  Description of Artificial Sequence: Synthetic oligonucleotide
guagugcagggucucagg

SEQ ID NO: 59648 - RNA, 18 nt, Artificial Sequence
  Description of Artificial Sequence: Synthetic oligonucleotide
cggaaguagugcaggguc

SEQ ID NO: 59649 - RNA, 18 nt, Artificial Sequence
  Description of Artificial Sequence: Synthetic oligonucleotide
ggucccggaaguagugca

SEQ ID NO: 59650 - RNA, 18 nt, Artificial Sequence
  Description of Artificial Sequence: Synthetic oligonucleotide
auagaggucccggaagua

SEQ ID NO: 59651 - RNA, 18 nt, Artificial Sequence
  Description of Artificial Sequence: Synthetic oligonucleotide
gggagauagaggucccgg

SEQ ID NO: 59652 - RNA, 18 nt, Artificial Sequence
  Description of Artificial Sequence: Synthetic oligonucleotide
aggcugggagauagaggu

SEQ ID NO: 59653 - RNA, 18 nt, Artificial Sequence
  Description of Artificial Sequence: Synthetic oligonucleotide
ccuggaggcugggagaua

SEQ ID NO: 59654 - RNA, 18 nt, Artificial Sequence
  Description of Artificial Sequence: Synthetic oligonucleotide
agcuuccuggaggcuggg

SEQ ID NO: 59655 - RNA, 18 nt, Artificial Sequence
  Description of Artificial Sequence: Synthetic oligonucleotide
aaaacagcuuccuggagg

SEQ ID NO: 59656 - RNA, 18 nt, Artificial Sequence
  Description of Artificial Sequence: Synthetic oligonucleotide
ggagcaaaacagcuuccu

SEQ ID NO: 59657 - RNA, 18 nt, Artificial Sequence
  Description of Artificial Sequence: Synthetic oligonucleotide
cccacggagcaaaacagc

SEQ ID NO: 59658 - RNA, 18 nt, Artificial Sequence
  Description of Artificial Sequence: Synthetic oligonucleotide
ucugucccacggagcaaa

SEQ ID NO: 59659 - RNA, 18 nt, Artificial Sequence
  Description of Artificial Sequence: Synthetic oligonucleotide
uggguucugucccacgga

SEQ ID NO: 59660 - RNA, 18 nt, Artificial Sequence
  Description of Artificial Sequence: Synthetic oligonucleotide
uccuguggguucuguccc

SEQ ID NO: 59661 - RNA, 18 nt, Artificial Sequence
  Description of Artificial Sequence: Synthetic oligonucleotide
ccacguccuguggguucu

SEQ ID NO: 59662 - RNA, 18 nt, Artificial Sequence
  Description of Artificial Sequence: Synthetic oligonucleotide
cugaaccacguccugugg

SEQ ID NO: 59663 - RNA, 18 nt, Artificial Sequence
  Description of Artificial Sequence: Synthetic oligonucleotide
agcgcggcgugugguccc

SEQ ID NO: 59664 - RNA, 18 nt, Artificial Sequence
  Description of Artificial Sequence: Synthetic oligonucleotide
gggacagcgcggcgugug

SEQ ID NO: 59665 - RNA, 18 nt, Artificial Sequence
  Description of Artificial Sequence: Synthetic oligonucleotide
ccuggguugggugcuggg

SEQ ID NO: 59666 - RNA, 18 nt, Artificial Sequence
  Description of Artificial Sequence: Synthetic oligonucleotide
uaaccuggguugggugcu

SEQ ID NO: 59667 - RNA, 18 nt, Artificial Sequence
  Description of Artificial Sequence: Synthetic oligonucleotide
caugguaaccuggguugg

SEQ ID NO: 59668 - RNA, 18 nt, Artificial Sequence
  Description of Artificial Sequence: Synthetic oligonucleotide
gaggccaugguaaccugg

SEQ ID NO: 59669 - RNA, 18 nt, Artificial Sequence
  Description of Artificial Sequence: Synthetic oligonucleotide
acagggaggccaugguaa

SEQ ID NO: 59670 - RNA, 18 nt, Artificial Sequence
  Description of Artificial Sequence: Synthetic oligonucleotide
agagaacagggaggccau

SEQ ID NO: 59671 - RNA, 18 nt, Artificial Sequence
  Description of Artificial Sequence: Synthetic oligonucleotide
cggccagagaacagggag

SEQ ID NO: 59672 - RNA, 18 nt, Artificial Sequence
  Description of Artificial Sequence: Synthetic oligonucleotide
ggaugcggccagagaaca

SEQ ID NO: 59673 - RNA, 18 nt, Artificial Sequence
  Description of Artificial Sequence: Synthetic oligonucleotide
gaucaggaugcggccaga

SEQ ID NO: 59674 - RNA, 18 nt, Artificial Sequence
  Description of Artificial Sequence: Synthetic oligonucleotide
uugcggaucaggaugcgg

SEQ ID NO: 59675 - RNA, 18 nt, Artificial Sequence
  Description of Artificial Sequence: Synthetic oligonucleotide
uauuguugcggaucagga

SEQ ID NO: 59676 - RNA, 18 nt, Artificial Sequence
  Description of Artificial Sequence: Synthetic oligonucleotide
gucgcuauuguugcggau

SEQ ID NO: 59677 - RNA, 18 nt, Artificial Sequence
  Description of Artificial Sequence: Synthetic oligonucleotide
uccuggucgcuauuguug

SEQ ID NO: 59678 - RNA, 18 nt, Artificial Sequence
  Description of Artificial Sequence: Synthetic oligonucleotide
gcucguccuggucgcuau

SEQ ID NO: 59679 - RNA, 18 nt, Artificial Sequence
  Description of Artificial Sequence: Synthetic oligonucleotide
auccagcucguccugguc

SEQ ID NO: 59680 - RNA, 18 nt, Artificial Sequence
  Description of Artificial Sequence: Synthetic oligonucleotide
uccguauccagcucgucc

SEQ ID NO: 59681 - RNA, 18 nt, Artificial Sequence
  Description of Artificial Sequence: Synthetic oligonucleotide
cagccuccguauccagcu

SEQ ID NO: 59682 - RNA, 18 nt, Artificial Sequence
  Description of Artificial Sequence: Synthetic oligonucleotide
gaccucagccuccguauc

SEQ ID NO: 59683 - RNA, 18 nt, Artificial Sequence
  Description of Artificial Sequence: Synthetic oligonucleotide
cgacugaccucagccucc

SEQ ID NO: 59684 - RNA, 18 nt, Artificial Sequence
  Description of Artificial Sequence: Synthetic oligonucleotide
gccugcgacugaccucag

SEQ ID NO: 59685 - RNA, 18 nt, Artificial Sequence
  Description of Artificial Sequence: Synthetic oligonucleotide
cuccagccugcgacugac

SEQ ID NO: 59686 - RNA, 18 nt, Artificial Sequence
  Description of Artificial Sequence: Synthetic oligonucleotide
cgguucuccagccugcga

SEQ ID NO: 59687 - RNA, 18 nt, Artificial Sequence
  Description of Artificial Sequence: Synthetic oligonucleotide
ccagccgguucuccagcc

SEQ ID NO: 59688 - RNA, 18 nt, Artificial Sequence
  Description of Artificial Sequence: Synthetic oligonucleotide
cagcaccagccgguucuc

SEQ ID NO: 59689 - RNA, 18 nt, Artificial Sequence
  Description of Artificial Sequence: Synthetic oligonucleotide
aacagcagcaccagccgg

SEQ ID NO: 59690 - RNA, 18 nt, Artificial Sequence
  Description of Artificial Sequence: Synthetic oligonucleotide
caaagaacagcagcacca

SEQ ID NO: 59691 - RNA, 18 nt, Artificial Sequence
  Description of Artificial Sequence: Synthetic oligonucleotide
agcaccaaagaacagcag

SEQ ID NO: 59692 - RNA, 18 nt, Artificial Sequence
  Description of Artificial Sequence: Synthetic oligonucleotide
gccccagcaccaaagaac

SEQ ID NO: 59693 - RNA, 18 nt, Artificial Sequence
  Description of Artificial Sequence: Synthetic oligonucleotide
gacaagccccagcaccaa

SEQ ID NO: 59694 - RNA, 18 nt, Artificial Sequence
  Description of Artificial Sequence: Synthetic oligonucleotide
cuguggacaagccccagc

SEQ ID NO: 59695 - RNA, 18 nt, Artificial Sequence
  Description of Artificial Sequence: Synthetic oligonucleotide
uggcacuguggacaagcc

SEQ ID NO: 59696 - RNA, 18 nt, Artificial Sequence
  Description of Artificial Sequence: Synthetic oligonucleotide
aggccuggcacuguggac

SEQ ID NO: 59697 - RNA, 18 nt, Artificial Sequence
  Description of Artificial Sequence: Synthetic oligonucleotide
cacgaaggccuggcacug

SEQ ID NO: 59698 - RNA, 18 nt, Artificial Sequence
  Description of Artificial Sequence: Synthetic oligonucleotide
augggcacgaaggccugg

SEQ ID NO: 59699 - RNA, 18 nt, Artificial Sequence
  Description of Artificial Sequence: Synthetic oligonucleotide
ugaggaugggcacgaagg

SEQ ID NO: 59700 - RNA, 18 nt, Artificial Sequence
  Description of Artificial Sequence: Synthetic oligonucleotide
guccuugaggaugggcac

SEQ ID NO: 59701 - RNA, 18 nt, Artificial Sequence
  Description of Artificial Sequence: Synthetic oligonucleotide
aagaaguccuugaggaug

SEQ ID NO: 59702 - RNA, 18 nt, Artificial Sequence
  Description of Artificial Sequence: Synthetic oligonucleotide
gcacgaagaaguccuuga

SEQ ID NO: 59703 - RNA, 18 nt, Artificial Sequence
  Description of Artificial Sequence: Synthetic oligonucleotide
gagccgcacgaagaaguc

SEQ ID NO: 59704 - RNA, 18 nt, Artificial Sequence
  Description of Artificial Sequence: Synthetic oligonucleotide
ucugugagccgcacgaag

SEQ ID NO: 59705 - RNA, 18 nt, Artificial Sequence
  Description of Artificial Sequence: Synthetic oligonucleotide
acucaucugugagccgca

SEQ ID NO: 59706 - RNA, 18 nt, Artificial Sequence
  Description of Artificial Sequence: Synthetic oligonucleotide
auagaacucaucugugag

SEQ ID NO: 59707 - RNA, 18 nt, Artificial Sequence
  Description of Artificial Sequence: Synthetic oligonucleotide
aguacauagaacucaucu

SEQ ID NO: 59708 - RNA, 18 nt, Artificial Sequence
  Description of Artificial Sequence: Synthetic oligonucleotide
cccgcaguacauagaacu

SEQ ID NO: 59709 - RNA, 18 nt, Artificial Sequence
  Description of Artificial Sequence: Synthetic oligonucleotide
agccgcccgcaguacaua

SEQ ID NO: 59710 - RNA, 18 nt, Artificial Sequence
  Description of Artificial Sequence: Synthetic oligonucleotide
agcugagccgcccgcagu

SEQ ID NO: 59711 - RNA, 18 nt, Artificial Sequence
  Description of Artificial Sequence: Synthetic oligonucleotide
gggccagcugagccgccc

SEQ ID NO: 59712 - RNA, 18 nt, Artificial Sequence
  Description of Artificial Sequence: Synthetic oligonucleotide
caccagggccagcugagc

SEQ ID NO: 59713 - RNA, 18 nt, Artificial Sequence
  Description of Artificial Sequence: Synthetic oligonucleotide
acguacaccagggccagc

SEQ ID NO: 59714 - RNA, 18 nt, Artificial Sequence
  Description of Artificial Sequence: Synthetic oligonucleotide
gggacacguacaccaggg

SEQ ID NO: 59715 - RNA, 18 nt, Artificial Sequence
  Description of Artificial Sequence: Synthetic oligonucleotide
guccugggacacguacac

SEQ ID NO: 59716 - RNA, 18 nt, Artificial Sequence
  Description of Artificial Sequence: Synthetic oligonucleotide
guggaguccugggacacg

SEQ ID NO: 59717 - RNA, 18 nt, Artificial Sequence
  Description of Artificial Sequence: Synthetic oligonucleotide
ccuccguggaguccuggg

SEQ ID NO: 59718 - RNA, 18 nt, Artificial Sequence
  Description of Artificial Sequence: Synthetic oligonucleotide
cugcuccuccguggaguc

SEQ ID NO: 59719 - RNA, 18 nt, Artificial Sequence
  Description of Artificial Sequence: Synthetic oligonucleotide
uccugcugcuccuccgug

SEQ ID NO: 59720 - RNA, 18 nt, Artificial Sequence
  Description of Artificial Sequence: Synthetic oligonucleotide
acagguccugcugcuccu

SEQ ID NO: 59721 - RNA, 18 nt, Artificial Sequence
  Description of Artificial Sequence: Synthetic oligonucleotide
gaggaacagguccugcug

SEQ ID NO: 59722 - RNA, 18 nt, Artificial Sequence
  Description of Artificial Sequence: Synthetic oligonucleotide
uccuugaggaacaggucc

SEQ ID NO: 59723 - RNA, 18 nt, Artificial Sequence
  Description of Artificial Sequence: Synthetic oligonucleotide
gcauguccuugaggaaca

SEQ ID NO: 59724 - RNA, 18 nt, Artificial Sequence
  Description of Artificial Sequence: Synthetic oligonucleotide
cuuuggcauguccuugag

SEQ ID NO: 59725 - RNA, 18 nt, Artificial Sequence
  Description of Artificial Sequence: Synthetic oligonucleotide
cauuucuuuggcaugucc

SEQ ID NO: 59726 - RNA, 18 nt, Artificial Sequence
  Description of Artificial Sequence: Synthetic oligonucleotide
aaagccauuucuuuggca

SEQ ID NO: 59727 - RNA, 18 nt, Artificial Sequence
  Description of Artificial Sequence: Synthetic oligonucleotide
caggaaaagccauuucuu

SEQ ID NO: 59728 - RNA, 18 nt, Artificial Sequence
  Description of Artificial Sequence: Synthetic oligonucleotide
aagggcaggaaaagccau

SEQ ID NO: 59729 - RNA, 18 nt, Artificial Sequence
  Description of Artificial Sequence: Synthetic oligonucleotide
ccucaaagggcaggaaaa

SEQ ID NO: 59730 - RNA, 18 nt, Artificial Sequence
  Description of Artificial Sequence: Synthetic oligonucleotide
aucauccucaaagggcag

SEQ ID NO: 59731 - RNA, 18 nt, Artificial Sequence
  Description of Artificial Sequence: Synthetic oligonucleotide
cucagaucauccucaaag

SEQ ID NO: 59732 - RNA, 18 nt, Artificial Sequence
  Description of Artificial Sequence: Synthetic oligonucleotide
aagcccucccugccccuc

SEQ ID NO: 59733 - RNA, 18 nt, Artificial Sequence
  Description of Artificial Sequence: Synthetic oligonucleotide
ccaggaagcccucccugc

SEQ ID NO: 59734 - RNA, 18 nt, Artificial Sequence
  Description of Artificial Sequence: Synthetic oligonucleotide
cuccuccaggaagcccuc

SEQ ID NO: 59735 - RNA, 18 nt, Artificial Sequence
  Description of Artificial Sequence: Synthetic oligonucleotide
gcccccuccuccaggaag

SEQ ID NO: 59736 - RNA, 18 nt, Artificial Sequence
  Description of Artificial Sequence: Synthetic oligonucleotide
aacaugcccccuccucca

SEQ ID NO: 59737 - RNA, 18 nt, Artificial Sequence
  Description of Artificial Sequence: Synthetic oligonucleotide
cagcgaacaugcccccuc

SEQ ID NO: 59738 - RNA, 18 nt, Artificial Sequence
  Description of Artificial Sequence: Synthetic oligonucleotide
acuuucagcgaacaugcc

SEQ ID NO: 59739 - RNA, 18 nt, Artificial Sequence
  Description of Artificial Sequence: Synthetic oligonucleotide
gcuucacuuucagcgaac

SEQ ID NO: 59740 - RNA, 18 nt, Artificial Sequence
  Description of Artificial Sequence: Synthetic oligonucleotide
uggaugcuucacuuucag

SEQ ID NO: 59741 - RNA, 18 nt, Artificial Sequence
  Description of Artificial Sequence: Synthetic oligonucleotide
uagaauggaugcuucacu

SEQ ID NO: 59742 - RNA, 18 nt, Artificial Sequence
  Description of Artificial Sequence: Synthetic oligonucleotide
cuaguuagaauggaugcu

SEQ ID NO: 59743 - RNA, 18 nt, Artificial Sequence
  Description of Artificial Sequence: Synthetic oligonucleotide
ucacucuaguuagaaugg

SEQ ID NO: 59744 - RNA, 18 nt, Artificial Sequence
  Description of Artificial Sequence: Synthetic oligonucleotide
cucauucacucuaguuag

SEQ ID NO: 59745 - RNA, 18 nt, Artificial Sequence
  Description of Artificial Sequence: Synthetic oligonucleotide
ggcugcucauucacucua

SEQ ID NO: 59746 - RNA, 18 nt, Artificial Sequence
  Description of Artificial Sequence: Synthetic oligonucleotide
gggcugcucauucacucu

SEQ ID NO: 59747 - RNA, 18 nt, Artificial Sequence
  Description of Artificial Sequence: Synthetic oligonucleotide
auggacuggcacacaggg

SEQ ID NO: 59748 - RNA, 18 nt, Artificial Sequence
  Description of Artificial Sequence: Synthetic oligonucleotide
aguauauggacuggcaca

SEQ ID NO: 59749 - RNA, 18 nt, Artificial Sequence
  Description of Artificial Sequence: Synthetic oligonucleotide
uucccaguauauggacug

SEQ ID NO: 59750 - RNA, 18 nt, Artificial Sequence
  Description of Artificial Sequence: Synthetic oligonucleotide
ccuaguucccaguauaug

SEQ ID NO: 59751 - RNA, 18 nt, Artificial Sequence
  Description of Artificial Sequence: Synthetic oligonucleotide
uacccccuaguucccagu

SEQ ID NO: 59752 - RNA, 18 nt, Artificial Sequence
  Description of Artificial Sequence: Synthetic oligonucleotide
gucuguacccccuaguuc

SEQ ID NO: 59753 - RNA, 18 nt, Artificial Sequence
  Description of Artificial Sequence: Synthetic oligonucleotide
ccccugucuguacccccu

SEQ ID NO: 59754 - RNA, 18 nt, Artificial Sequence
  Description of Artificial Sequence: Synthetic oligonucleotide
gggcaccccugucuguac

SEQ ID NO: 59755 - RNA, 18 nt, Artificial Sequence
  Description of Artificial Sequence: Synthetic oligonucleotide
gaagugggcaccccuguc

SEQ ID NO: 59756 - RNA, 18 nt, Artificial Sequence
  Description of Artificial Sequence: Synthetic oligonucleotide
auguggaagugggcaccc

SEQ ID NO: 59757 - RNA, 18 nt, Artificial Sequence
  Description of Artificial Sequence: Synthetic oligonucleotide
ccagcauguggaaguggg

SEQ ID NO: 59758 - RNA, 18 nt, Artificial Sequence
  Description of Artificial Sequence: Synthetic oligonucleotide
ggaagccagcauguggaa

SEQ ID NO: 59759 - RNA, 18 nt, Artificial Sequence
  Description of Artificial Sequence: Synthetic oligonucleotide
ggcauggaagccagcaug

SEQ ID NO: 59760 - RNA, 18 nt, Artificial Sequence
  Description of Artificial Sequence: Synthetic oligonucleotide
ggguggcauggaagccag

SEQ ID NO: 59761 - RNA, 18 nt, Artificial Sequence
  Description of Artificial Sequence: Synthetic oligonucleotide
ggcucuaagcucccuggg

SEQ ID NO: 59762 - RNA, 18 nt, Artificial Sequence
  Description of Artificial Sequence: Synthetic oligonucleotide
cacucggcucuaagcucc

SEQ ID NO: 59763 - RNA, 18 nt, Artificial Sequence
  Description of Artificial Sequence: Synthetic oligonucleotide
ccucucacucggcucuaa

SEQ ID NO: 59764 - RNA, 18 nt, Artificial Sequence
  Description of Artificial Sequence: Synthetic oligonucleotide
cuguuccucucacucggc

SEQ ID NO: 59765 - RNA, 18 nt, Artificial Sequence
  Description of Artificial Sequence: Synthetic oligonucleotide
ugcaucuguuccucucac

SEQ ID NO: 59766 - RNA, 18 nt, Artificial Sequence
  Description of Artificial Sequence: Synthetic oligonucleotide
ucuuuugcaucuguuccu

SEQ ID NO: 59767 - RNA, 18 nt, Artificial Sequence
  Description of Artificial Sequence: Synthetic oligonucleotide
uucugucuuuugcaucug

SEQ ID NO: 59768 - RNA, 18 nt, Artificial Sequence
  Description of Artificial Sequence: Synthetic oligonucleotide
guugauucugucuuuugc

SEQ ID NO: 59769 - RNA, 18 nt, Artificial Sequence
  Description of Artificial Sequence: Synthetic oligonucleotide
acauaguugauucugucu

SEQ ID NO: 59770 - RNA, 18 nt, Artificial Sequence
  Description of Artificial Sequence: Synthetic oligonucleotide
cuauuacauaguugauuc

SEQ ID NO: 59771 - RNA, 18 nt, Artificial Sequence
  Description of Artificial Sequence: Synthetic oligonucleotide
ccuugcuauuacauaguu

SEQ ID NO: 59772 - RNA, 18 nt, Artificial Sequence
  Description of Artificial Sequence: Synthetic oligonucleotide
cccggccuugcuauuaca

SEQ ID NO: 59773 - RNA, 18 nt, Artificial Sequence
  Description of Artificial Sequence: Synthetic oligonucleotide
ccaugcccggccuugcua

SEQ ID NO: 59774 - RNA, 18 nt, Artificial Sequence
  Description of Artificial Sequence: Synthetic oligonucleotide
agccaccaugcccggccu

SEQ ID NO: 59775 - RNA, 18 nt, Artificial Sequence
  Description of Artificial Sequence: Synthetic oligonucleotide
gguuaagccaccaugccc

SEQ ID NO: 59776 - RNA, 18 nt, Artificial Sequence
  Description of Artificial Sequence: Synthetic oligonucleotide
uacaggguuaagccacca

SEQ ID NO: 59777 - RNA, 18 nt, Artificial Sequence
  Description of Artificial Sequence: Synthetic oligonucleotide
gggauuacaggguuaagc

SEQ ID NO: 59778 - RNA, 18 nt, Artificial Sequence
  Description of Artificial Sequence: Synthetic oligonucleotide
guccugggauuacagggu

SEQ ID NO: 59779 - RNA, 18 nt, Artificial Sequence
  Description of Artificial Sequence: Synthetic oligonucleotide
ccaaaguccugggauuac

SEQ ID NO: 59780 - RNA, 18 nt, Artificial Sequence
  Description of Artificial Sequence: Synthetic oligonucleotide
gccugccaaaguccuggg

SEQ ID NO: 59781 - RNA, 18 nt, Artificial Sequence
  Description of Artificial Sequence: Synthetic oligonucleotide
ccucggccugccaaaguc

SEQ ID NO: 59782 - RNA, 18 nt, Artificial Sequence
  Description of Artificial Sequence: Synthetic oligonucleotide
gcccaccucggccugcca

SEQ ID NO: 59783 - RNA, 18 nt, Artificial Sequence
  Description of Artificial Sequence: Synthetic oligonucleotide
gaucugcccaccucggcc

SEQ ID NO: 59784 - RNA, 18 nt, Artificial Sequence
  Description of Artificial Sequence: Synthetic oligonucleotide
caggugaucugcccaccu

SEQ ID NO: 59785 - RNA, 18 nt, Artificial Sequence
  Description of Artificial Sequence: Synthetic oligonucleotide
gaccucaggugaucugcc

SEQ ID NO: 59786 - RNA, 18 nt, Artificial Sequence
  Description of Artificial Sequence: Synthetic oligonucleotide
cucccgaccucaggugau

SEQ ID NO: 59787 - RNA, 18 nt, Artificial Sequence
  Description of Artificial Sequence: Synthetic oligonucleotide
ucaaacucccgaccucag

SEQ ID NO: 59788 - RNA, 18 nt, Artificial Sequence
  Description of Artificial Sequence: Synthetic oligonucleotide
uugucucaaacucccgac

SEQ ID NO: 59789 - RNA, 18 nt, Artificial Sequence
  Description of Artificial Sequence: Synthetic oligonucleotide
caggcuugucucaaacuc

SEQ ID NO: 59790 - RNA, 18 nt, Artificial Sequence
  Description of Artificial Sequence: Synthetic oligonucleotide
uugaccaggcuugucuca

SEQ ID NO: 59791 - RNA, 18 nt, Artificial Sequence
  Description of Artificial Sequence: Synthetic oligonucleotide
cuauguugaccaggcuug

SEQ ID NO: 59792 - RNA, 18 nt, Artificial Sequence
  Description of Artificial Sequence: Synthetic oligonucleotide
uuucacuauguugaccag

SEQ ID NO: 59793 - RNA, 18 nt, Artificial Sequence
  Description of Artificial Sequence: Synthetic oligonucleotide
caggguuucacuauguug

SEQ ID NO: 59794 - RNA, 18 nt, Artificial Sequence
  Description of Artificial Sequence: Synthetic oligonucleotide
agagacaggguuucacua

SEQ ID NO: 59795 - RNA, 18 nt, Artificial Sequence
  Description of Artificial Sequence: Synthetic oligonucleotide
uuaguagagacaggguuu

SEQ ID NO: 59796 - RNA, 18 nt, Artificial Sequence
  Description of Artificial Sequence: Synthetic oligonucleotide
uauuuuuaguagagacag

SEQ ID NO: 59797 - RNA, 18 nt, Artificial Sequence
  Description of Artificial Sequence: Synthetic oligonucleotide
uuuuguauuuuuaguaga

SEQ ID NO: 59798 - RNA, 18 nt, Artificial Sequence
  Description of Artificial Sequence: Synthetic oligonucleotide
auaauuuuuguauuuuua

SEQ ID NO: 59799 - RNA, 18 nt, Artificial Sequence
  Description of Artificial Sequence: Synthetic oligonucleotide
ccuggauaauuuuuguau

SEQ ID NO: 59800 - RNA, 18 nt, Artificial Sequence
  Description of Artificial Sequence: Synthetic oligonucleotide
ccacgccuggauaauuuu

SEQ ID NO: 59801 - RNA, 18 nt, Artificial Sequence
  Description of Artificial Sequence: Synthetic oligonucleotide
caccaccacgccuggaua

SEQ ID NO: 59802 - RNA, 18 nt, Artificial Sequence
  Description of Artificial Sequence: Synthetic oligonucleotide
gcgcccaccaccacgccu

SEQ ID NO: 59803 - RNA, 18 nt, Artificial Sequence
  Description of Artificial Sequence: Synthetic oligonucleotide
uacaggcgcccaccacca

SEQ ID NO: 59804 - RNA, 18 nt, Artificial Sequence
  Description of Artificial Sequence: Synthetic oligonucleotide
gggauuacaggcgcccac

SEQ ID NO: 59805 - RNA, 18 nt, Artificial Sequence
  Description of Artificial Sequence: Synthetic oligonucleotide
cagcugggauuacaggcg

SEQ ID NO: 59806 - RNA, 18 nt, Artificial Sequence
  Description of Artificial Sequence: Synthetic oligonucleotide
ccaagcagcugggauuac

SEQ ID NO: 59807 - RNA, 18 nt, Artificial Sequence
  Description of Artificial Sequence: Synthetic oligonucleotide
gccucccaagcagcuggg

SEQ ID NO: 59808 - RNA, 18 nt, Artificial Sequence
  Description of Artificial Sequence: Synthetic oligonucleotide
ccucagccucccaagcag

SEQ ID NO: 59809 - RNA, 18 nt, Artificial Sequence
  Description of Artificial Sequence: Synthetic oligonucleotide
uccugccucagccuccca

SEQ ID NO: 59810 - RNA, 18 nt, Artificial Sequence
  Description of Artificial Sequence: Synthetic oligonucleotide
gauucuccugccucagcc

SEQ ID NO: 59811 - RNA, 18 nt, Artificial Sequence
  Description of Artificial Sequence: Synthetic oligonucleotide
caaacgauucuccugccu

SEQ ID NO: 59812 - RNA, 18 nt, Artificial Sequence
  Description of Artificial Sequence: Synthetic oligonucleotide
aguuucaaacgauucucc

SEQ ID NO: 59813 - RNA, 18 nt, Artificial Sequence
  Description of Artificial Sequence: Synthetic oligonucleotide
cucccaguuucaaacgau

SEQ ID NO: 59814 - RNA, 18 nt, Artificial Sequence
  Description of Artificial Sequence: Synthetic oligonucleotide
ucugccucccaguuucaa

SEQ ID NO: 59815 - RNA, 18 nt, Artificial Sequence
  Description of Artificial Sequence: Synthetic oligonucleotide
cagcaucugccucccagu

SEQ ID NO: 59816 - RNA, 18 nt, Artificial Sequence
  Description of Artificial Sequence: Synthetic oligonucleotide
cacugcagcaucugccuc

SEQ ID NO: 59817 - RNA, 18 nt, Artificial Sequence
  Description of Artificial Sequence: Synthetic oligonucleotide
uaccucacugcagcaucu

SEQ ID NO: 59818 - RNA, 18 nt, Artificial Sequence
  Description of Artificial Sequence: Synthetic oligonucleotide
gaucuuaccucacugcag

SEQ ID NO: 59819 - RNA, 18 nt, Artificial Sequence
  Description of Artificial Sequence: Synthetic oligonucleotide
ggcacgaucuuaccucac

SEQ ID NO: 59820 - RNA, 18 nt, Artificial Sequence
  Description of Artificial Sequence: Synthetic oligonucleotide
gcaguggcacgaucuuac

SEQ ID NO: 59821 - RNA, 18 nt, Artificial Sequence
  Description of Artificial Sequence: Synthetic oligonucleotide
ggagggcaguggcacgau

SEQ ID NO: 59822 - RNA, 18 nt, Artificial Sequence
  Description of Artificial Sequence: Synthetic oligonucleotide
aggcuggagggcaguggc

SEQ ID NO: 59823 - RNA, 18 nt, Artificial Sequence
  Description of Artificial Sequence: Synthetic oligonucleotide
cacccaggcuggagggca

SEQ ID NO: 59824 - RNA, 18 nt, Artificial Sequence
  Description of Artificial Sequence: Synthetic oligonucleotide
ucugucacccaggcugga

SEQ ID NO: 59825 - RNA, 18 nt, Artificial Sequence
  Description of Artificial Sequence: Synthetic oligonucleotide
cucccucugucacccagg

SEQ ID NO: 59826 - RNA, 18 nt, Artificial Sequence
  Description of Artificial Sequence: Synthetic oligonucleotide
agagucucccucugucac

SEQ ID NO: 59827 - RNA, 18 nt, Artificial Sequence
  Description of Artificial Sequence: Synthetic oligonucleotide
uagacagagucucccucu

SEQ ID NO: 59828 - RNA, 18 nt, Artificial Sequence
  Description of Artificial Sequence: Synthetic oligonucleotide
augauugcaccacuacac

SEQ ID NO: 59829 - RNA, 18 nt, Artificial Sequence
  Description of Artificial Sequence: Synthetic oligonucleotide
gagcuaugauugcaccac

SEQ ID NO: 59830 - RNA, 18 nt, Artificial Sequence
  Description of Artificial Sequence: Synthetic oligonucleotide
gcagugagcuaugauugc

SEQ ID NO: 59831 - RNA, 18 nt, Artificial Sequence
  Description of Artificial Sequence: Synthetic oligonucleotide
aggcugcagugagcuaug

SEQ ID NO: 59832 - RNA, 18 nt, Artificial Sequence
  Description of Artificial Sequence: Synthetic oligonucleotide
uuucgaggcugcagugag

SEQ ID NO: 59833 - RNA, 18 nt, Artificial Sequence
  Description of Artificial Sequence: Synthetic oligonucleotide
caggauuucgaggcugca

SEQ ID NO: 59834 - RNA, 18 nt, Artificial Sequence
  Description of Artificial Sequence: Synthetic oligonucleotide
gagcccaggauuucgagg

SEQ ID NO: 59835 - RNA, 18 nt, Artificial Sequence
  Description of Artificial Sequence: Synthetic oligonucleotide
cccuugagcccaggauuu

SEQ ID NO: 59836 - RNA, 18 nt, Artificial Sequence
  Description of Artificial Sequence: Synthetic oligonucleotide
aguaucccuugagcccag

SEQ ID NO: 59837 - RNA, 18 nt, Artificial Sequence
  Description of Artificial Sequence: Synthetic oligonucleotide
cgagaaguaucccuugag

SEQ ID NO: 59838 - RNA, 18 nt, Artificial Sequence
  Description of Artificial Sequence: Synthetic oligonucleotide
ucccucgagaaguauccc

SEQ ID NO: 59839 - RNA, 18 nt, Artificial Sequence
  Description of Artificial Sequence: Synthetic oligonucleotide
ggacuucccucgagaagu

SEQ ID NO: 59840 - RNA, 18 nt, Artificial Sequence
  Description of Artificial Sequence: Synthetic oligonucleotide
accugggacuucccucga

SEQ ID NO: 59841 - RNA, 18 nt, Artificial Sequence
  Description of Artificial Sequence: Synthetic oligonucleotide
gagguaccugggacuucc

SEQ ID NO: 59842 - RNA, 18 nt, Artificial Sequence
  Description of Artificial Sequence: Synthetic oligonucleotide
aggccgagguaccuggga

SEQ ID NO: 59843 - RNA, 18 nt, Artificial Sequence
  Description of Artificial Sequence: Synthetic oligonucleotide
ucaggaggccgagguacc

SEQ ID NO: 59844 - RNA, 18 nt, Artificial Sequence
  Description of Artificial Sequence: Synthetic oligonucleotide
gguacucaggaggccgag

SEQ ID NO: 59845 - RNA, 18 nt, Artificial Sequence
  Description of Artificial Sequence: Synthetic oligonucleotide
ucccagguacucaggagg

SEQ ID NO: 59846 - RNA, 18 nt, Artificial Sequence
  Description of Artificial Sequence: Synthetic oligonucleotide
uguagucccagguacuca

SEQ ID NO: 59847 - RNA, 18 nt, Artificial Sequence
  Description of Artificial Sequence: Synthetic oligonucleotide
gcuccuguagucccaggu

SEQ ID NO: 59848 - RNA, 18 nt, Artificial Sequence
  Description of Artificial Sequence: Synthetic oligonucleotide
ggugcgcuccuguagucc

SEQ ID NO: 59849 - RNA, 18 nt, Artificial Sequence
  Description of Artificial Sequence: Synthetic oligonucleotide
gugguggugcgcuccugu

SEQ ID NO: 59850 - RNA, 18 nt, Artificial Sequence
  Description of Artificial Sequence: Synthetic oligonucleotide
agggugugguggugcgcu

SEQ ID NO: 59851 - RNA, 18 nt, Artificial Sequence
  Description of Artificial Sequence: Synthetic oligonucleotide
aaagcagggugugguggu

SEQ ID NO: 59852 - RNA, 18 nt, Artificial Sequence
  Description of Artificial Sequence: Synthetic oligonucleotide
uaaauaaagcagggugug

SEQ ID NO: 59853 - RNA, 18 nt, Artificial Sequence
  Description of Artificial Sequence: Synthetic oligonucleotide
auaaauaaauaaagcagg

SEQ ID NO: 59854 - RNA, 18 nt, Artificial Sequence
  Description of Artificial Sequence: Synthetic oligonucleotide
aauaaauaaauaaauaaa

SEQ ID NO: 59855 - RNA, 18 nt, Artificial Sequence
  Description of Artificial Sequence: Synthetic oligonucleotide
aaauaaauaaauaaauaa

SEQ ID NO: 59856 - RNA, 18 nt, Artificial Sequence
  Description of Artificial Sequence: Synthetic oligonucleotide
uaaauaaauaaauaaaua

SEQ ID NO: 59857 - RNA, 18 nt, Artificial Sequence
  Description of Artificial Sequence: Synthetic oligonucleotide
auaaauaaauaaauaaau

SEQ ID NO: 59858 - RNA, 18 nt, Artificial Sequence
  Description of Artificial Sequence: Synthetic oligonucleotide
uacaaauaaauaaauaaa

SEQ ID NO: 59859 - RNA, 18 nt, Artificial Sequence
  Description of Artificial Sequence: Synthetic oligonucleotide
gucucuacaaauaaauaa

SEQ ID NO: 59860 - RNA, 18 nt, Artificial Sequence
  Description of Artificial Sequence: Synthetic oligonucleotide
acccugucucuacaaaua

SEQ ID NO: 59861 - RNA, 18 nt, Artificial Sequence
  Description of Artificial Sequence: Synthetic oligonucleotide
guaagacccugucucuac

SEQ ID NO: 59862 - RNA, 18 nt, Artificial Sequence
  Description of Artificial Sequence: Synthetic oligonucleotide
uuguaguaagacccuguc

SEQ ID NO: 59863 - RNA, 18 nt, Artificial Sequence
  Description of Artificial Sequence: Synthetic oligonucleotide
uuuauuuguaguaagacc

SEQ ID NO: 59864 - RNA, 18 nt, Artificial Sequence
  Description of Artificial Sequence: Synthetic oligonucleotide
cuacauuuauuuguagua

SEQ ID NO: 59865 - RNA, 18 nt, Artificial Sequence
  Description of Artificial Sequence: Synthetic oligonucleotide
ucuuacuacauuuauuug

SEQ ID NO: 59866 - RNA, 18 nt, Artificial Sequence
  Description of Artificial Sequence: Synthetic oligonucleotide
caaggucuuacuacauuu

SEQ ID NO: 59867 - RNA, 18 nt, Artificial Sequence
  Description of Artificial Sequence: Synthetic oligonucleotide
agacacaaggucuuacua

SEQ ID NO: 59868 - RNA, 18 nt, Artificial Sequence
  Description of Artificial Sequence: Synthetic oligonucleotide
ucgcaagacacaaggucu

SEQ ID NO: 59869 - RNA, 18 nt, Artificial Sequence
  Description of Artificial Sequence: Synthetic oligonucleotide
ucacaucgcaagacacaa

SEQ ID NO: 59870 - RNA, 18 nt, Artificial Sequence
  Description of Artificial Sequence: Synthetic oligonucleotide
agaccucacaucgcaaga

SEQ ID NO: 59871 - RNA, 18 nt, Artificial Sequence
  Description of Artificial Sequence: Synthetic oligonucleotide
uauggagaccucacaucg

SEQ ID NO: 59872 - RNA, 18 nt, Artificial Sequence
  Description of Artificial Sequence: Synthetic oligonucleotide
uguaguauggagaccuca

SEQ ID NO: 59873 - RNA, 18 nt, Artificial Sequence
  Description of Artificial Sequence: Synthetic oligonucleotide
gacccuguaguauggaga

SEQ ID NO: 59874 - RNA, 18 nt, Artificial Sequence
  Description of Artificial Sequence: Synthetic oligonucleotide
gcuaagacccuguaguau

SEQ ID NO: 59875 - RNA, 18 nt, Artificial Sequence
  Description of Artificial Sequence: Synthetic oligonucleotide
ugcaggcuaagacccugu

SEQ ID NO: 59876 - RNA, 18 nt, Artificial Sequence
  Description of Artificial Sequence: Synthetic oligonucleotide
acauuugcaggcuaagac

SEQ ID NO: 59877 - RNA, 18 nt, Artificial Sequence
  Description of Artificial Sequence: Synthetic oligonucleotide
cucagacauuugcaggcu

SEQ ID NO: 59878 - RNA, 18 nt, Artificial Sequence
  Description of Artificial Sequence: Synthetic oligonucleotide
cucuccucagacauuugc

SEQ ID NO: 59879 - RNA, 18 nt, Artificial Sequence
  Description of Artificial Sequence: Synthetic oligonucleotide
gagcgcucuccucagaca

SEQ ID NO: 59880 - RNA, 18 nt, Artificial Sequence
  Description of Artificial Sequence: Synthetic oligonucleotide
gucuggagcgcucuccuc

SEQ ID NO: 59881 - RNA, 18 nt, Artificial Sequence
  Description of Artificial Sequence: Synthetic oligonucleotide
cccacgucuggagcgcuc

SEQ ID NO: 59882 - RNA, 18 nt, Artificial Sequence
  Description of Artificial Sequence: Synthetic oligonucleotide
cugugcccacgucuggag

SEQ ID NO: 59883 - RNA, 18 nt, Artificial Sequence
  Description of Artificial Sequence: Synthetic oligonucleotide
gcuggcugugcccacguc

SEQ ID NO: 59884 - RNA, 18 nt, Artificial Sequence
  Description of Artificial Sequence: Synthetic oligonucleotide
uuugugcuggcugugccc

SEQ ID NO: 59885 - RNA, 18 nt, Artificial Sequence
  Description of Artificial Sequence: Synthetic oligonucleotide
gggcauuugugcuggcug

SEQ ID NO: 59886 - RNA, 18 nt, Artificial Sequence
  Description of Artificial Sequence: Synthetic oligonucleotide
gcaugcuccaaccucggg

SEQ ID NO: 59887 - RNA, 18 nt, Artificial Sequence
  Description of Artificial Sequence: Synthetic oligonucleotide
ccaggcaugcuccaaccu

SEQ ID NO: 59888 - RNA, 18 nt, Artificial Sequence
  Description of Artificial Sequence: Synthetic oligonucleotide
gcaccccaggcaugcucc

SEQ ID NO: 59889 - RNA, 18 nt, Artificial Sequence
  Description of Artificial Sequence: Synthetic oligonucleotide
cuccagcaccccaggcau

SEQ ID NO: 59890 - RNA, 18 nt, Artificial Sequence
  Description of Artificial Sequence: Synthetic oligonucleotide
uuugucuccagcacccca

SEQ ID NO: 59891 - RNA, 18 nt, Artificial Sequence
  Description of Artificial Sequence: Synthetic oligonucleotide
cgcgcuuugucuccagca

SEQ ID NO: 59892 - RNA, 18 nt, Artificial Sequence
  Description of Artificial Sequence: Synthetic oligonucleotide
guccccgcgcuuugucuc

SEQ ID NO: 59893 - RNA, 18 nt, Artificial Sequence
  Description of Artificial Sequence: Synthetic oligonucleotide
cuuugguccccgcgcuuu

SEQ ID NO: 59894 - RNA, 18 nt, Artificial Sequence
  Description of Artificial Sequence: Synthetic oligonucleotide
agacacuuugguccccgc

SEQ ID NO: 59895 - RNA, 18 nt, Artificial Sequence
  Description of Artificial Sequence: Synthetic oligonucleotide
gggccagacacuuugguc

SEQ ID NO: 59896 - RNA, 18 nt, Artificial Sequence
  Description of Artificial Sequence: Synthetic oligonucleotide
ggacagggccagacacuu

SEQ ID NO: 59897 - RNA, 18 nt, Artificial Sequence
  Description of Artificial Sequence: Synthetic oligonucleotide
gaccgggacagggccaga

SEQ ID NO: 59898 - RNA, 18 nt, Artificial Sequence
  Description of Artificial Sequence: Synthetic oligonucleotide
acgaggaccgggacaggg

SEQ ID NO: 59899 - RNA, 18 nt, Artificial Sequence
  Description of Artificial Sequence: Synthetic oligonucleotide
ugcacacgaggaccggga

SEQ ID NO: 59900 - RNA, 18 nt, Artificial Sequence
  Description of Artificial Sequence: Synthetic oligonucleotide
guaggugcacacgaggac

SEQ ID NO: 59901 - RNA, 18 nt, Artificial Sequence
  Description of Artificial Sequence: Synthetic oligonucleotide
acuggguaggugcacacg

SEQ ID NO: 59902 - RNA, 18 nt, Artificial Sequence
  Description of Artificial Sequence: Synthetic oligonucleotide
cgggcacuggguaggugc

SEQ ID NO: 59903 - RNA, 18 nt, Artificial Sequence
  Description of Artificial Sequence: Synthetic oligonucleotide
cuugccgggcacugggua

SEQ ID NO: 59904 - RNA, 18 nt, Artificial Sequence
  Description of Artificial Sequence: Synthetic oligonucleotide
ugccucuugccgggcacu

SEQ ID NO: 59905 - RNA, 18 nt, Artificial Sequence
  Description of Artificial Sequence: Synthetic oligonucleotide
ugcacugccucuugccgg

SEQ ID NO: 59906 - RNA, 18 nt, Artificial Sequence
  Description of Artificial Sequence: Synthetic oligonucleotide
cugugugcacugccucuu

SEQ ID NO: 59907 - RNA, 18 nt, Artificial Sequence
  Description of Artificial Sequence: Synthetic oligonucleotide
gccuucugugugcacugc

SEQ ID NO: 59908 - RNA, 18 nt, Artificial Sequence
  Description of Artificial Sequence: Synthetic oligonucleotide
gcagcgccuucugugugc

SEQ ID NO: 59909 - RNA, 18 nt, Artificial Sequence
  Description of Artificial Sequence: Synthetic oligonucleotide
cuuaggcagcgccuucug

SEQ ID NO: 59910 - RNA, 18 nt, Artificial Sequence
  Description of Artificial Sequence: Synthetic oligonucleotide
caguacuuaggcagcgcc

SEQ ID NO: 59911 - RNA, 18 nt, Artificial Sequence
  Description of Artificial Sequence: Synthetic oligonucleotide
ccucccaguacuuaggca

SEQ ID NO: 59912 - RNA, 18 nt, Artificial Sequence
  Description of Artificial Sequence: Synthetic oligonucleotide
ucccuccucccaguacuu

SEQ ID NO: 59913 - RNA, 18 nt, Artificial Sequence
  Description of Artificial Sequence: Synthetic oligonucleotide
ccacaucccuccucccag

SEQ ID NO: 59914 - RNA, 18 nt, Artificial Sequence
  Description of Artificial Sequence: Synthetic oligonucleotide
gagccccacaucccuccu

SEQ ID NO: 59915 - RNA, 18 nt, Artificial Sequence
  Description of Artificial Sequence: Synthetic oligonucleotide
ccagagagccccacaucc

SEQ ID NO: 59916 - RNA, 18 nt, Artificial Sequence
  Description of Artificial Sequence: Synthetic oligonucleotide
cugaaccagagagcccca

SEQ ID NO: 59917 - RNA, 18 nt, Artificial Sequence
  Description of Artificial Sequence: Synthetic oligonucleotide
ugaugcugaaccagagag

SEQ ID NO: 59918 - RNA, 18 nt, Artificial Sequence
  Description of Artificial Sequence: Synthetic oligonucleotide
aucccugaugcugaacca

SEQ ID NO: 59919 - RNA, 18 nt, Artificial Sequence
  Description of Artificial Sequence: Synthetic oligonucleotide
uccacaucccugaugcug

SEQ ID NO: 59920 - RNA, 18 nt, Artificial Sequence
  Description of Artificial Sequence: Synthetic oligonucleotide
acggauccacaucccuga

SEQ ID NO: 59921 - RNA, 18 nt, Artificial Sequence
  Description of Artificial Sequence: Synthetic oligonucleotide
ucuggacggauccacauc

SEQ ID NO: 59922 - RNA, 18 nt, Artificial Sequence
  Description of Artificial Sequence: Synthetic oligonucleotide
gucagucuggacggaucc

SEQ ID NO: 59923 - RNA, 18 nt, Artificial Sequence
  Description of Artificial Sequence: Synthetic oligonucleotide
gaacuggcgcccgagguc

SEQ ID NO: 59924 - RNA, 18 nt, Artificial Sequence
  Description of Artificial Sequence: Synthetic oligonucleotide
acugagaacuggcgcccg

SEQ ID NO: 59925 - RNA, 18 nt, Artificial Sequence
  Description of Artificial Sequence: Synthetic oligonucleotide
gcuccacugagaacuggc

SEQ ID NO: 59926 - RNA, 18 nt, Artificial Sequence
  Description of Artificial Sequence: Synthetic oligonucleotide
caggcgcuccacugagaa

SEQ ID NO: 59927 - RNA, 18 nt, Artificial Sequence
  Description of Artificial Sequence: Synthetic oligonucleotide
gccggcaggcgcuccacu

SEQ ID NO: 59928 - RNA, 18 nt, Artificial Sequence
  Description of Artificial Sequence: Synthetic oligonucleotide
cgaccgccggcaggcgcu

SEQ ID NO: 59929 - RNA, 18 nt, Artificial Sequence
  Description of Artificial Sequence: Synthetic oligonucleotide
caccacgaccgccggcag

SEQ ID NO: 59930 - RNA, 18 nt, Artificial Sequence
  Description of Artificial Sequence: Synthetic oligonucleotide
uugagcaccacgaccgcc

SEQ ID NO: 59931 - RNA, 18 nt, Artificial Sequence
  Description of Artificial Sequence: Synthetic oligonucleotide
ccggcuugagcaccacga

SEQ ID NO: 59932 - RNA, 18 nt, Artificial Sequence
  Description of Artificial Sequence: Synthetic oligonucleotide
cccguccggcuugagcac

SEQ ID NO: 59933 - RNA, 18 nt, Artificial Sequence
  Description of Artificial Sequence: Synthetic oligonucleotide
acguccccguccggcuug

SEQ ID NO: 59934 - RNA, 18 nt, Artificial Sequence
  Description of Artificial Sequence: Synthetic oligonucleotide
ugagcacguccccguccg

SEQ ID NO: 59935 - RNA, 18 nt, Artificial Sequence
  Description of Artificial Sequence: Synthetic oligonucleotide
gcgagugagcacgucccc

SEQ ID NO: 59936 - RNA, 18 nt, Artificial Sequence
  Description of Artificial Sequence: Synthetic oligonucleotide
ccgucgcgagugagcacg

SEQ ID NO: 59937 - RNA, 18 nt, Artificial Sequence
  Description of Artificial Sequence: Synthetic oligonucleotide
cggcgccgucgcgaguga

SEQ ID NO: 59938 - RNA, 18 nt, Artificial Sequence
  Description of Artificial Sequence: Synthetic oligonucleotide
cucgucggcgccgucgcg

SEQ ID NO: 59939 - RNA, 18 nt, Artificial Sequence
  Description of Artificial Sequence: Synthetic oligonucleotide
uggaucucgucggcgccg

SEQ ID NO: 59940 - RNA, 18 nt, Artificial Sequence
  Description of Artificial Sequence: Synthetic oligonucleotide
ggcgcuggaucucgucgg

SEQ ID NO: 59941 - RNA, 18 nt, Artificial Sequence
  Description of Artificial Sequence: Synthetic oligonucleotide
gcccaggcgcuggaucuc

SEQ ID NO: 59942 - RNA, 18 nt, Artificial Sequence
  Description of Artificial Sequence: Synthetic oligonucleotide
gcggugcccaggcgcugg

SEQ ID NO: 59943 - RNA, 18 nt, Artificial Sequence
  Description of Artificial Sequence: Synthetic oligonucleotide
agcaggcggugcccaggc

SEQ ID NO: 59944 - RNA, 18 nt, Artificial Sequence
  Description of Artificial Sequence: Synthetic oligonucleotide
ggcgaagcaggcggugcc

SEQ ID NO: 59945 - RNA, 18 nt, Artificial Sequence
  Description of Artificial Sequence: Synthetic oligonucleotide
caguuggcgaagcaggcg

SEQ ID NO: 59946 - RNA, 18 nt, Artificial Sequence
  Description of Artificial Sequence: Synthetic oligonucleotide
ccugccaguuggcgaagc

SEQ ID NO: 59947 - RNA, 18 nt, Artificial Sequence
  Description of Artificial Sequence: Synthetic oligonucleotide
cgccuccugccaguuggc

SEQ ID NO: 59948 - RNA, 18 nt, Artificial Sequence
  Description of Artificial Sequence: Synthetic oligonucleotide
ucggccgccuccugccag

SEQ ID NO: 59949 - RNA, 18 nt, Artificial Sequence
  Description of Artificial Sequence: Synthetic oligonucleotide
gcaccucggccgccuccu

SEQ ID NO: 59950 - RNA, 18 nt, Artificial Sequence
  Description of Artificial Sequence: Synthetic oligonucleotide
guccagcaccucggccgc

SEQ ID NO: 59951 - RNA, 18 nt, Artificial Sequence
  Description of Artificial Sequence: Synthetic oligonucleotide
uugcgguccagcaccucg

SEQ ID NO: 59952 - RNA, 18 nt, Artificial Sequence
  Description of Artificial Sequence: Synthetic oligonucleotide
ggaaguugcgguccagca

SEQ ID NO: 59953 - RNA, 18 nt, Artificial Sequence
  Description of Artificial Sequence: Synthetic oligonucleotide
cagcuggaaguugcgguc

SEQ ID NO: 59954 - RNA, 18 nt, Artificial Sequence
  Description of Artificial Sequence: Synthetic oligonucleotide
ucuggcagcuggaaguug

SEQ ID NO: 59955 - RNA, 18 nt, Artificial Sequence
  Description of Artificial Sequence: Synthetic oligonucleotide
gguccucuggcagcugga

SEQ ID NO: 59956 - RNA, 18 nt, Artificial Sequence
  Description of Artificial Sequence: Synthetic oligonucleotide
cuccagguccucuggcag

SEQ ID NO: 59957 - RNA, 18 nt, Artificial Sequence
  Description of Artificial Sequence: Synthetic oligonucleotide
ugguccuccagguccucu

SEQ ID NO: 59958 - RNA, 18 nt, Artificial Sequence
  Description of Artificial Sequence: Synthetic oligonucleotide
gcuccugguccuccaggu

SEQ ID NO: 59959 - RNA, 18 nt, Artificial Sequence
  Description of Artificial Sequence: Synthetic oligonucleotide
ccguggcuccugguccuc

SEQ ID NO: 59960 - RNA, 18 nt, Artificial Sequence
  Description of Artificial Sequence: Synthetic oligonucleotide
aggcuccguggcuccugg

SEQ ID NO: 59961 - RNA, 18 nt, Artificial Sequence
  Description of Artificial Sequence: Synthetic oligonucleotide
cggugaggcuccguggcu

SEQ ID NO: 59962 - RNA, 18 nt, Artificial Sequence
  Description of Artificial Sequence: Synthetic oligonucleotide
gcacucggugaggcuccg

SEQ ID NO: 59963 - RNA, 18 nt, Artificial Sequence
  Description of Artificial Sequence: Synthetic oligonucleotide
cgcaggcacucggugagg

SEQ ID NO: 59964 - RNA, 18 nt, Artificial Sequence
  Description of Artificial Sequence: Synthetic oligonucleotide
ggcggcgcaggcacucgg

SEQ ID NO: 59965 - RNA, 18 nt, Artificial Sequence
  Description of Artificial Sequence: Synthetic oligonucleotide
cuuguggcggcgcaggca

SEQ ID NO: 59966 - RNA, 18 nt, Artificial Sequence
  Description of Artificial Sequence: Synthetic oligonucleotide
cgguacuuguggcggcgc

SEQ ID NO: 59967 - RNA, 18 nt, Artificial Sequence
  Description of Artificial Sequence: Synthetic oligonucleotide
ccacgcgguacuuguggc

SEQ ID NO: 59968 - RNA, 18 nt, Artificial Sequence
  Description of Artificial Sequence: Synthetic oligonucleotide
cuuuuccacgcgguacuu

SEQ ID NO: 59969 - RNA, 18 nt, Artificial Sequence
  Description of Artificial Sequence: Synthetic oligonucleotide
gccgccuuuuccacgcgg

SEQ ID NO: 59970 - RNA, 18 nt, Artificial Sequence
  Description of Artificial Sequence: Synthetic oligonucleotide
cucgcgccgccuuuucca

SEQ ID NO: 59971 - RNA, 18 nt, Artificial Sequence
  Description of Artificial Sequence: Synthetic oligonucleotide
cccgccucgcgccgccuu

SEQ ID NO: 59972 - RNA, 18 nt, Artificial Sequence
  Description of Artificial Sequence: Synthetic oligonucleotide
ucgcgcccgccucgcgcc

SEQ ID NO: 59973 - RNA, 18 nt, Artificial Sequence
  Description of Artificial Sequence: Synthetic oligonucleotide
gggucgcgcccgccucgc

SEQ ID NO: 59974 - RNA, 18 nt, Artificial Sequence
  Description of Artificial Sequence: Synthetic oligonucleotide
cccacccccucccccggg

SEQ ID NO: 59975 - RNA, 18 nt, Artificial Sequence
  Description of Artificial Sequence: Synthetic oligonucleotide
uccuccccacccccuccc

SEQ ID NO: 59976 - RNA, 18 nt, Artificial Sequence
  Description of Artificial Sequence: Synthetic oligonucleotide
cgcccuccuccccacccc

SEQ ID NO: 59977 - RNA, 18 nt, Artificial Sequence
  Description of Artificial Sequence: Synthetic oligonucleotide
ggccccgcccuccucccc

SEQ ID NO: 59978 - RNA, 18 nt, Artificial Sequence
  Description of Artificial Sequence: Synthetic oligonucleotide
cccccggccccgcccucc

SEQ ID NO: 59979 - RNA, 18 nt, Artificial Sequence
  Description of Artificial Sequence: Synthetic oligonucleotide
acagccccccggccccgc

SEQ ID NO: 59980 - RNA, 18 nt, Artificial Sequence
  Description of Artificial Sequence: Synthetic oligonucleotide
ucagaacagccccccggc

SEQ ID NO: 59981 - RNA, 18 nt, Artificial Sequence
  Description of Artificial Sequence: Synthetic oligonucleotide
gcgggucagaacagcccc

SEQ ID NO: 59982 - RNA, 18 nt, Artificial Sequence
  Description of Artificial Sequence: Synthetic oligonucleotide
cccuagcgggucagaaca

SEQ ID NO: 59983 - RNA, 18 nt, Artificial Sequence
  Description of Artificial Sequence: Synthetic oligonucleotide
cuccacccuagcggguca

SEQ ID NO: 59984 - RNA, 18 nt, Artificial Sequence
  Description of Artificial Sequence: Synthetic oligonucleotide
cucuccuccacccuagcg

SEQ ID NO: 59985 - RNA, 18 nt, Artificial Sequence
  Description of Artificial Sequence: Synthetic oligonucleotide
cacuccucuccuccaccc

SEQ ID NO: 59986 - RNA, 18 nt, Artificial Sequence
  Description of Artificial Sequence: Synthetic oligonucleotide
aaccccacuccucuccuc

SEQ ID NO: 59987 - RNA, 18 nt, Artificial Sequence
  Description of Artificial Sequence: Synthetic oligonucleotide
caacaaaccccacuccuc

SEQ ID NO: 59988 - RNA, 18 nt, Artificial Sequence
  Description of Artificial Sequence: Synthetic oligonucleotide
uucaucaacaaaccccac

SEQ ID NO: 59989 - RNA, 18 nt, Artificial Sequence
  Description of Artificial Sequence: Synthetic oligonucleotide
ggagguucaucaacaaac

SEQ ID NO: 59990 - RNA, 18 nt, Artificial Sequence
  Description of Artificial Sequence: Synthetic oligonucleotide
ggguggagguucaucaac

SEQ ID NO: 59991 - RNA, 18 nt, Artificial Sequence
  Description of Artificial Sequence: Synthetic oligonucleotide
ggauuacaggcgugcggg

SEQ ID NO: 59992 - RNA, 18 nt, Artificial Sequence
  Description of Artificial Sequence: Synthetic oligonucleotide
ugcugggauuacaggcgu

SEQ ID NO: 59993 - RNA, 18 nt, Artificial Sequence
  Description of Artificial Sequence: Synthetic oligonucleotide
ccaagugcugggauuaca

SEQ ID NO: 59994 - RNA, 18 nt, Artificial Sequence
  Description of Artificial Sequence: Synthetic oligonucleotide
ccuccccaagugcuggga

SEQ ID NO: 59995 - RNA, 18 nt, Artificial Sequence
  Description of Artificial Sequence: Synthetic oligonucleotide
cuuggccuccccaagugc

SEQ ID NO: 59996 - RNA, 18 nt, Artificial Sequence
  Description of Artificial Sequence: Synthetic oligonucleotide
cccgccuuggccucccca

SEQ ID NO: 59997 - RNA, 18 nt, Artificial Sequence
  Description of Artificial Sequence: Synthetic oligonucleotide
auccucccgccuuggccu

SEQ ID NO: 59998 - RNA, 18 nt, Artificial Sequence
  Description of Artificial Sequence: Synthetic oligonucleotide
aagcgauccucccgccuu

SEQ ID NO: 59999 - RNA, 18 nt, Artificial Sequence
  Description of Artificial Sequence: Synthetic oligonucleotide
ggcucaagcgauccuccc

SEQ ID NO: 60000 - RNA, 18 nt, Artificial Sequence
  Description of Artificial Sequence: Synthetic oligonucleotide
cucugggcucaagcgauc

SEQ ID NO: 60001 - RNA, 18 nt, Artificial Sequence
  Description of Artificial Sequence: Synthetic oligonucleotide
cgaaccucugggcucaag

SEQ ID NO: 60002 - RNA, 18 nt, Artificial Sequence
  Description of Artificial Sequence: Synthetic oligonucleotide
gaucucgaaccucugggc

SEQ ID NO: 60003 - RNA, 18 nt, Artificial Sequence
  Description of Artificial Sequence: Synthetic oligonucleotide
agguugaucucgaaccuc

SEQ ID NO: 60004 - RNA, 18 nt, Artificial Sequence
  Description of Artificial Sequence: Synthetic oligonucleotide
ugcccagguugaucucga

SEQ ID NO: 60005 - RNA, 18 nt, Artificial Sequence
  Description of Artificial Sequence: Synthetic oligonucleotide
ucucuugcccagguugau

SEQ ID NO: 60006 - RNA, 18 nt, Artificial Sequence
  Description of Artificial Sequence: Synthetic oligonucleotide
cucacucucuugcccagg

SEQ ID NO: 60007 - RNA, 18 nt, Artificial Sequence
  Description of Artificial Sequence: Synthetic oligonucleotide
agggucucacucucuugc

SEQ ID NO: 60008 - RNA, 18 nt, Artificial Sequence
  Description of Artificial Sequence: Synthetic oligonucleotide
gagucagggucucacucu

SEQ ID NO: 60009 - RNA, 18 nt, Artificial Sequence
  Description of Artificial Sequence: Synthetic oligonucleotide
ucguagagucagggucuc

SEQ ID NO: 60010 - RNA, 18 nt, Artificial Sequence
  Description of Artificial Sequence: Synthetic oligonucleotide
aauuuucguagagucagg

SEQ ID NO: 60011 - RNA, 18 nt, Artificial Sequence
  Description of Artificial Sequence: Synthetic oligonucleotide
cuuuuaauuuucguagag

SEQ ID NO: 60012 - RNA, 18 nt, Artificial Sequence
  Description of Artificial Sequence: Synthetic oligonucleotide
gcuaacuuuuaauuuucg

SEQ ID NO: 60013 - RNA, 18 nt, Artificial Sequence
  Description of Artificial Sequence: Synthetic oligonucleotide
accgggcuaacuuuuaau

SEQ ID NO: 60014 - RNA, 18 nt, Artificial Sequence
  Description of Artificial Sequence: Synthetic oligonucleotide
accacaccgggcuaacuu

SEQ ID NO: 60015 - RNA, 18 nt, Artificial Sequence
  Description of Artificial Sequence: Synthetic oligonucleotide
gcgccaccacaccgggcu

SEQ ID NO: 60016 - RNA, 18 nt, Artificial Sequence
  Description of Artificial Sequence: Synthetic oligonucleotide
ggugcgcgccaccacacc

SEQ ID NO: 60017 - RNA, 18 nt, Artificial Sequence
  Description of Artificial Sequence: Synthetic oligonucleotide
ccacaggugcgcgccacc

SEQ ID NO: 60018 - RNA, 18 nt, Artificial Sequence
  Description of Artificial Sequence: Synthetic oligonucleotide
cuaagccacaggugcgcg

SEQ ID NO: 60019 - RNA, 18 nt, Artificial Sequence
  Description of Artificial Sequence: Synthetic oligonucleotide
gguagcuaagccacaggu

SEQ ID NO: 60020 - RNA, 18 nt, Artificial Sequence
  Description of Artificial Sequence: Synthetic oligonucleotide
uucaggguagcuaagcca

SEQ ID NO: 60021 - RNA, 18 nt, Artificial Sequence
  Description of Artificial Sequence: Synthetic oligonucleotide
uaaucccggccaaggugg

SEQ ID NO: 60022 - RNA, 18 nt, Artificial Sequence
  Description of Artificial Sequence: Synthetic oligonucleotide
gaggguaaucccggccaa

SEQ ID NO: 60023 - RNA, 18 nt, Artificial Sequence
  Description of Artificial Sequence: Synthetic oligonucleotide
acucggaggguaaucccg

SEQ ID NO: 60024 - RNA, 18 nt, Artificial Sequence
  Description of Artificial Sequence: Synthetic oligonucleotide
cuggaacucggaggguaa

SEQ ID NO: 60025 - RNA, 18 nt, Artificial Sequence
  Description of Artificial Sequence: Synthetic oligonucleotide
auggccuggaacucggag

SEQ ID NO: 60026 - RNA, 18 nt, Artificial Sequence
  Description of Artificial Sequence: Synthetic oligonucleotide
uugucauggccuggaacu

SEQ ID NO: 60027 - RNA, 18 nt, Artificial Sequence
  Description of Artificial Sequence: Synthetic oligonucleotide
gucauuugucauggccug

SEQ ID NO: 60028 - RNA, 18 nt, Artificial Sequence
  Description of Artificial Sequence: Synthetic oligonucleotide
gugaugucauuugucaug

SEQ ID NO: 60029 - RNA, 18 nt, Artificial Sequence
  Description of Artificial Sequence: Synthetic oligonucleotide
cgggagugaugucauuug

SEQ ID NO: 60030 - RNA, 18 nt, Artificial Sequence
  Description of Artificial Sequence: Synthetic oligonucleotide
ugggccgggagugauguc

SEQ ID NO: 60031 - RNA, 18 nt, Artificial Sequence
  Description of Artificial Sequence: Synthetic oligonucleotide
aagccugggccgggagug

SEQ ID NO: 60032 - RNA, 18 nt, Artificial Sequence
  Description of Artificial Sequence: Synthetic oligonucleotide
auuuuaagccugggccgg

SEQ ID NO: 60033 - RNA, 18 nt, Artificial Sequence
  Description of Artificial Sequence: Synthetic oligonucleotide
gggagauuuuaagccugg

SEQ ID NO: 60034 - RNA, 18 nt, Artificial Sequence
  Description of Artificial Sequence: Synthetic oligonucleotide
cacauccccucacauggg

SEQ ID NO: 60035 - RNA, 18 nt, Artificial Sequence
  Description of Artificial Sequence: Synthetic oligonucleotide
gaaacacauccccucaca

SEQ ID NO: 60036 - RNA, 18 nt, Artificial Sequence
  Description of Artificial Sequence: Synthetic oligonucleotide
ugaaggaaacacaucccc

SEQ ID NO: 60037 - RNA, 18 nt, Artificial Sequence
  Description of Artificial Sequence: Synthetic oligonucleotide
gaggcugaaggaaacaca

SEQ ID NO: 60038 - RNA, 18 nt, Artificial Sequence
  Description of Artificial Sequence: Synthetic oligonucleotide
cagcagaggcugaaggaa

SEQ ID NO: 60039 - RNA, 18 nt, Artificial Sequence
  Description of Artificial Sequence: Synthetic oligonucleotide
ccagacagcagaggcuga

SEQ ID NO: 60040 - RNA, 18 nt, Artificial Sequence
  Description of Artificial Sequence: Synthetic oligonucleotide
agcggccagacagcagag

SEQ ID NO: 60041 - RNA, 18 nt, Artificial Sequence
  Description of Artificial Sequence: Synthetic oligonucleotide
gacagagcggccagacag

SEQ ID NO: 60042 - RNA, 18 nt, Artificial Sequence
  Description of Artificial Sequence: Synthetic oligonucleotide
accuagacagagcggcca

SEQ ID NO: 60043 - RNA, 18 nt, Artificial Sequence
  Description of Artificial Sequence: Synthetic oligonucleotide
ccaggaccuagacagagc

SEQ ID NO: 60044 - RNA, 18 nt, Artificial Sequence
  Description of Artificial Sequence: Synthetic oligonucleotide
guggcccaggaccuagac

SEQ ID NO: 60045 - RNA, 18 nt, Artificial Sequence
  Description of Artificial Sequence: Synthetic oligonucleotide
cucccguggcccaggacc

SEQ ID NO: 60046 - RNA, 18 nt, Artificial Sequence
  Description of Artificial Sequence: Synthetic oligonucleotide
gggcucucccguggccca

SEQ ID NO: 60047 - RNA, 18 nt, Artificial Sequence
  Description of Artificial Sequence: Synthetic oligonucleotide
ucagaaaggagggacggg

SEQ ID NO: 60048 - RNA, 18 nt, Artificial Sequence
  Description of Artificial Sequence: Synthetic oligonucleotide
ccgccucuccugcagacg

SEQ ID NO: 60049 - RNA, 18 nt, Artificial Sequence
  Description of Artificial Sequence: Synthetic oligonucleotide
ccccuccgccucuccugc

SEQ ID NO: 60050 - RNA, 18 nt, Artificial Sequence
  Description of Artificial Sequence: Synthetic oligonucleotide
ucgguccccuccgccucu

SEQ ID NO: 60051 - RNA, 18 nt, Artificial Sequence
  Description of Artificial Sequence: Synthetic oligonucleotide
ccuccucgguccccuccg

SEQ ID NO: 60052 - RNA, 18 nt, Artificial Sequence
  Description of Artificial Sequence: Synthetic oligonucleotide
ucuccccuccucgguccc

SEQ ID NO: 60053 - RNA, 18 nt, Artificial Sequence
  Description of Artificial Sequence: Synthetic oligonucleotide
uuuuuucuccccuccucg

SEQ ID NO: 60054 - RNA, 18 nt, Artificial Sequence
  Description of Artificial Sequence: Synthetic oligonucleotide
cucucuuuuuucuccccu

SEQ ID NO: 60055 - RNA, 18 nt, Artificial Sequence
  Description of Artificial Sequence: Synthetic oligonucleotide
cuccccucucuuuuuucu

SEQ ID NO: 60056 - RNA, 18 nt, Artificial Sequence
  Description of Artificial Sequence: Synthetic oligonucleotide
aacuucuccccucucuuu

SEQ ID NO: 60057 - RNA, 18 nt, Artificial Sequence
  Description of Artificial Sequence: Synthetic oligonucleotide
aacccaacuucuccccuc

SEQ ID NO: 60058 - RNA, 18 nt, Artificial Sequence
  Description of Artificial Sequence: Synthetic oligonucleotide
agauaaacccaacuucuc

SEQ ID NO: 60059 - RNA, 18 nt, Artificial Sequence
  Description of Artificial Sequence: Synthetic oligonucleotide
gaauaagauaaacccaac

SEQ ID NO: 60060 - RNA, 18 nt, Artificial Sequence
  Description of Artificial Sequence: Synthetic oligonucleotide
gccacgaauaagauaaac

SEQ ID NO: 60061 - RNA, 18 nt, Artificial Sequence
  Description of Artificial Sequence: Synthetic oligonucleotide
acacagccacgaauaaga

SEQ ID NO: 60062 - RNA, 18 nt, Artificial Sequence
  Description of Artificial Sequence: Synthetic oligonucleotide
ggcaaacacagccacgaa

SEQ ID NO: 60063 - RNA, 18 nt, Artificial Sequence
  Description of Artificial Sequence: Synthetic oligonucleotide
agcacggcaaacacagcc

SEQ ID NO: 60064 - RNA, 18 nt, Artificial Sequence
  Description of Artificial Sequence: Synthetic oligonucleotide
ugcagagcacggcaaaca

SEQ ID NO: 60065 - RNA, 18 nt, Artificial Sequence
  Description of Artificial Sequence: Synthetic oligonucleotide
ucaccugcagagcacggc

SEQ ID NO: 60066 - RNA, 18 nt, Artificial Sequence
  Description of Artificial Sequence: Synthetic oligonucleotide
aaacaucaccugcagagc

SEQ ID NO: 60067 - RNA, 18 nt, Artificial Sequence
  Description of Artificial Sequence: Synthetic oligonucleotide
ucagcaaacaucaccugc

SEQ ID NO: 60068 - RNA, 18 nt, Artificial Sequence
  Description of Artificial Sequence: Synthetic oligonucleotide
acuauucagcaaacauca

SEQ ID NO: 60069 - RNA, 18 nt, Artificial Sequence
  Description of Artificial Sequence: Synthetic oligonucleotide
gugugacuauucagcaaa

SEQ ID NO: 60070 - RNA, 18 nt, Artificial Sequence
  Description of Artificial Sequence: Synthetic oligonucleotide
uuugugugugacuauuca

SEQ ID NO: 60071 - RNA, 18 nt, Artificial Sequence
  Description of Artificial Sequence: Synthetic oligonucleotide
ucuguuuugugugugacu

SEQ ID NO: 60072 - RNA, 18 nt, Artificial Sequence
  Description of Artificial Sequence: Synthetic oligonucleotide
gcaccucuguuuugugug

SEQ ID NO: 60073 - RNA, 18 nt, Artificial Sequence
  Description of Artificial Sequence: Synthetic oligonucleotide
ggacggcaccucuguuuu

SEQ ID NO: 60074 - RNA, 18 nt, Artificial Sequence
  Description of Artificial Sequence: Synthetic oligonucleotide
ugccaggacggcaccucu

SEQ ID NO: 60075 - RNA, 18 nt, Artificial Sequence
  Description of Artificial Sequence: Synthetic oligonucleotide
acaaaugccaggacggca

SEQ ID NO: 60076 - RNA, 18 nt, Artificial Sequence
  Description of Artificial Sequence: Synthetic oligonucleotide
uuuccacaaaugccagga

SEQ ID NO: 60077 - RNA, 18 nt, Artificial Sequence
  Description of Artificial Sequence: Synthetic oligonucleotide
ccccguuuccacaaaugc

SEQ ID NO: 60078 - RNA, 18 nt, Artificial Sequence
  Description of Artificial Sequence: Synthetic oligonucleotide
ccuagccccguuuccaca

SEQ ID NO: 60079 - RNA, 18 nt, Artificial Sequence
  Description of Artificial Sequence: Synthetic oligonucleotide
cacagccuagccccguuu

SEQ ID NO: 60080 - RNA, 18 nt, Artificial Sequence
  Description of Artificial Sequence: Synthetic oligonucleotide
gcaaucacagccuagccc

SEQ ID NO: 60081 - RNA, 18 nt, Artificial Sequence
  Description of Artificial Sequence: Synthetic oligonucleotide
cugcugcaaucacagccu

SEQ ID NO: 60082 - RNA, 18 nt, Artificial Sequence
  Description of Artificial Sequence: Synthetic oligonucleotide
cccuccugcugcaaucac

SEQ ID NO: 60083 - RNA, 18 nt, Artificial Sequence
  Description of Artificial Sequence: Synthetic oligonucleotide
uuacucccuccugcugca

SEQ ID NO: 60084 - RNA, 18 nt, Artificial Sequence
  Description of Artificial Sequence: Synthetic oligonucleotide
uaaccuuacucccuccug

SEQ ID NO: 60085 - RNA, 18 nt, Artificial Sequence
  Description of Artificial Sequence: Synthetic oligonucleotide
cugucuaaccuuacuccc

SEQ ID NO: 60086 - RNA, 18 nt, Artificial Sequence
  Description of Artificial Sequence: Synthetic oligonucleotide
cccugcugucuaaccuua

SEQ ID NO: 60087 - RNA, 18 nt, Artificial Sequence
  Description of Artificial Sequence: Synthetic oligonucleotide
ccagucccugcugucuaa

SEQ ID NO: 60088 - RNA, 18 nt, Artificial Sequence
  Description of Artificial Sequence: Synthetic oligonucleotide
aucagccagucccugcug

SEQ ID NO: 60089 - RNA, 18 nt, Artificial Sequence
  Description of Artificial Sequence: Synthetic oligonucleotide
gugccaucagccaguccc

SEQ ID NO: 60090 - RNA, 18 nt, Artificial Sequence
  Description of Artificial Sequence: Synthetic oligonucleotide
cccgagugccaucagcca

SEQ ID NO: 60091 - RNA, 18 nt, Artificial Sequence
  Description of Artificial Sequence: Synthetic oligonucleotide
aaugccccgagugccauc

SEQ ID NO: 60092 - RNA, 18 nt, Artificial Sequence
  Description of Artificial Sequence: Synthetic oligonucleotide
cucccaaugccccgagug

SEQ ID NO: 60093 - RNA, 18 nt, Artificial Sequence
  Description of Artificial Sequence: Synthetic oligonucleotide
gaauccucccaaugcccc

SEQ ID NO: 60094 - RNA, 18 nt, Artificial Sequence
  Description of Artificial Sequence: Synthetic oligonucleotide
acccugaauccucccaau

SEQ ID NO: 60095 - RNA, 18 nt, Artificial Sequence
  Description of Artificial Sequence: Synthetic oligonucleotide
aagccacccugaauccuc

SEQ ID NO: 60096 - RNA, 18 nt, Artificial Sequence
  Description of Artificial Sequence: Synthetic oligonucleotide
cccacaagccacccugaa

SEQ ID NO: 60097 - RNA, 18 nt, Artificial Sequence
  Description of Artificial Sequence: Synthetic oligonucleotide
ccuugcccacaagccacc

SEQ ID NO: 60098 - RNA, 18 nt, Artificial Sequence
  Description of Artificial Sequence: Synthetic oligonucleotide
gacccccuugcccacaag

SEQ ID NO: 60099 - RNA, 18 nt, Artificial Sequence
  Description of Artificial Sequence: Synthetic oligonucleotide
gggacccccuugcccaca

SEQ ID NO: 60100 - RNA, 18 nt, Artificial Sequence
  Description of Artificial Sequence: Synthetic oligonucleotide
gccgucagggcuugaggg

SEQ ID NO: 60101 - RNA, 18 nt, Artificial Sequence
  Description of Artificial Sequence: Synthetic oligonucleotide
cggaugccgucagggcuu

SEQ ID NO: 60102 - RNA, 18 nt, Artificial Sequence
  Description of Artificial Sequence: Synthetic oligonucleotide
aaccccggaugccgucag

SEQ ID NO: 60103 - RNA, 18 nt, Artificial Sequence
  Description of Artificial Sequence: Synthetic oligonucleotide
cccccaaccccggaugcc

SEQ ID NO: 60104 - RNA, 18 nt, Artificial Sequence
  Description of Artificial Sequence: Synthetic oligonucleotide
agaagcccccaaccccgg

SEQ ID NO: 60105 - RNA, 18 nt, Artificial Sequence
  Description of Artificial Sequence: Synthetic oligonucleotide
cggugagaagcccccaac

SEQ ID NO: 60106 - RNA, 18 nt, Artificial Sequence
  Description of Artificial Sequence: Synthetic oligonucleotide
aaccacggugagaagccc

SEQ ID NO: 60107 - RNA, 18 nt, Artificial Sequence
  Description of Artificial Sequence: Synthetic oligonucleotide
cuuagaaccacggugaga

SEQ ID NO: 60108 - RNA, 18 nt, Artificial Sequence
  Description of Artificial Sequence: Synthetic oligonucleotide
guugccuuagaaccacgg

SEQ ID NO: 60109 - RNA, 18 nt, Artificial Sequence
  Description of Artificial Sequence: Synthetic oligonucleotide
gaggaguugccuuagaac

SEQ ID NO: 60110 - RNA, 18 nt, Artificial Sequence
  Description of Artificial Sequence: Synthetic oligonucleotide
augcugaggaguugccuu

SEQ ID NO: 60111 - RNA, 18 nt, Artificial Sequence
  Description of Artificial Sequence: Synthetic oligonucleotide
gcgguaugcugaggaguu

SEQ ID NO: 60112 - RNA, 18 nt, Artificial Sequence
  Description of Artificial Sequence: Synthetic oligonucleotide
acagagcgguaugcugag

SEQ ID NO: 60113 - RNA, 18 nt, Artificial Sequence
  Description of Artificial Sequence: Synthetic oligonucleotide
auccaacagagcgguaug

SEQ ID NO: 60114 - RNA, 18 nt, Artificial Sequence
  Description of Artificial Sequence: Synthetic oligonucleotide
agaacauccaacagagcg

SEQ ID NO: 60115 - RNA, 18 nt, Artificial Sequence
  Description of Artificial Sequence: Synthetic oligonucleotide
uuuaaagaacauccaaca

SEQ ID NO: 60116 - RNA, 18 nt, Artificial Sequence
  Description of Artificial Sequence: Synthetic oligonucleotide
agaguuuuaaagaacauc

SEQ ID NO: 60117 - RNA, 18 nt, Artificial Sequence
  Description of Artificial Sequence: Synthetic oligonucleotide
ugcuaagaguuuuaaaga

SEQ ID NO: 60118 - RNA, 18 nt, Artificial Sequence
  Description of Artificial Sequence: Synthetic oligonucleotide
ggcagugcuaagaguuuu

SEQ ID NO: 60119 - RNA, 18 nt, Artificial Sequence
  Description of Artificial Sequence: Synthetic oligonucleotide
uuucaggcagugcuaaga

SEQ ID NO: 60120 - RNA, 18 nt, Artificial Sequence
  Description of Artificial Sequence: Synthetic oligonucleotide
gaaaauuucaggcagugc

SEQ ID NO: 60121 - RNA, 18 nt, Artificial Sequence
  Description of Artificial Sequence: Synthetic oligonucleotide
caaaugaaaauuucaggc

SEQ ID NO: 60122 - RNA, 18 nt, Artificial Sequence
  Description of Artificial Sequence: Synthetic oligonucleotide
ucgcgcaaaugaaaauuu

SEQ ID NO: 60123 - RNA, 18 nt, Artificial Sequence
  Description of Artificial Sequence: Synthetic oligonucleotide
gaucaucgcgcaaaugaa

SEQ ID NO: 60124 - RNA, 18 nt, Artificial Sequence
  Description of Artificial Sequence: Synthetic oligonucleotide
uuguggaucaucgcgcaa

SEQ ID NO: 60125 - RNA, 18 nt, Artificial Sequence
  Description of Artificial Sequence: Synthetic oligonucleotide
gccauuuguggaucaucg

SEQ ID NO: 60126 - RNA, 18 nt, Artificial Sequence
  Description of Artificial Sequence: Synthetic oligonucleotide
gacaggccauuuguggau

SEQ ID NO: 60127 - RNA, 18 nt, Artificial Sequence
  Description of Artificial Sequence: Synthetic oligonucleotide
agggagacaggccauuug

SEQ ID NO: 60128 - RNA, 18 nt, Artificial Sequence
  Description of Artificial Sequence: Synthetic oligonucleotide
aagggagggagacaggcc

SEQ ID NO: 60129 - RNA, 18 nt, Artificial Sequence
  Description of Artificial Sequence: Synthetic oligonucleotide
ucaacaagggagggagac

SEQ ID NO: 60130 - RNA, 18 nt, Artificial Sequence
  Description of Artificial Sequence: Synthetic oligonucleotide
agugcucaacaagggagg

SEQ ID NO: 60131 - RNA, 18 nt, Artificial Sequence
  Description of Artificial Sequence: Synthetic oligonucleotide
aaaucagugcucaacaag

SEQ ID NO: 60132 - RNA, 18 nt, Artificial Sequence
  Description of Artificial Sequence: Synthetic oligonucleotide
gggaaaaaucagugcuca

SEQ ID NO: 60133 - RNA, 18 nt, Artificial Sequence
  Description of Artificial Sequence: Synthetic oligonucleotide
caaccacacgcugggcac

SEQ ID NO: 60134 - RNA, 18 nt, Artificial Sequence
  Description of Artificial Sequence: Synthetic oligonucleotide
aaucccaaccacacgcug

SEQ ID NO: 60135 - RNA, 18 nt, Artificial Sequence
  Description of Artificial Sequence: Synthetic oligonucleotide
aggcaaaucccaaccaca

SEQ ID NO: 60136 - RNA, 18 nt, Artificial Sequence
  Description of Artificial Sequence: Synthetic oligonucleotide
uauuuaggcaaaucccaa

SEQ ID NO: 60137 - RNA, 18 nt, Artificial Sequence
  Description of Artificial Sequence: Synthetic oligonucleotide
acacauauuuaggcaaau

SEQ ID NO: 60138 - RNA, 18 nt, Artificial Sequence
  Description of Artificial Sequence: Synthetic oligonucleotide
augcaacacauauuuagg

SEQ ID NO: 60139 - RNA, 18 nt, Artificial Sequence
  Description of Artificial Sequence: Synthetic oligonucleotide
caucuaugcaacacauau

SEQ ID NO: 60140 - RNA, 18 nt, Artificial Sequence
  Description of Artificial Sequence: Synthetic oligonucleotide
ccauccaucuaugcaaca

SEQ ID NO: 60141 - RNA, 18 nt, Artificial Sequence
  Description of Artificial Sequence: Synthetic oligonucleotide
uucauccauccaucuaug

SEQ ID NO: 60142 - RNA, 18 nt, Artificial Sequence
  Description of Artificial Sequence: Synthetic oligonucleotide
ugucauucauccauccau

SEQ ID NO: 60143 - RNA, 18 nt, Artificial Sequence
  Description of Artificial Sequence: Synthetic oligonucleotide
ugagcccaggaguuuggg

SEQ ID NO: 60144 - RNA, 18 nt, Artificial Sequence
  Description of Artificial Sequence: Synthetic oligonucleotide
acuugagcccaggaguuu

SEQ ID NO: 60145 - RNA, 18 nt, Artificial Sequence
  Description of Artificial Sequence: Synthetic oligonucleotide
ggaucacuugagcccagg

SEQ ID NO: 60146 - RNA, 18 nt, Artificial Sequence
  Description of Artificial Sequence: Synthetic oligonucleotide
ugggaggaucacuugagc

SEQ ID NO: 60147 - RNA, 18 nt, Artificial Sequence
  Description of Artificial Sequence: Synthetic oligonucleotide
ugaggugggaggaucacu

SEQ ID NO: 60148 - RNA, 18 nt, Artificial Sequence
  Description of Artificial Sequence: Synthetic oligonucleotide
gaggcugaggugggagga

SEQ ID NO: 60149 - RNA, 18 nt, Artificial Sequence
  Description of Artificial Sequence: Synthetic oligonucleotide
cccaggaggcugaggugg

SEQ ID NO: 60150 - RNA, 18 nt, Artificial Sequence
  Description of Artificial Sequence: Synthetic oligonucleotide
agcuacccaggaggcuga

SEQ ID NO: 60151 - RNA, 18 nt, Artificial Sequence
  Description of Artificial Sequence: Synthetic oligonucleotide
aucccagcuacccaggag

SEQ ID NO: 60152 - RNA, 18 nt, Artificial Sequence
  Description of Artificial Sequence: Synthetic oligonucleotide
cuguaaucccagcuaccc

SEQ ID NO: 60153 - RNA, 18 nt, Artificial Sequence
  Description of Artificial Sequence: Synthetic oligonucleotide
caugccuguaaucccagc

SEQ ID NO: 60154 - RNA, 18 nt, Artificial Sequence
  Description of Artificial Sequence: Synthetic oligonucleotide
ugaugcaugccuguaauc

SEQ ID NO: 60155 - RNA, 18 nt, Artificial Sequence
  Description of Artificial Sequence: Synthetic oligonucleotide
uguggugaugcaugccug

SEQ ID NO: 60156 - RNA, 18 nt, Artificial Sequence
  Description of Artificial Sequence: Synthetic oligonucleotide
cuggguguggugaugcau

SEQ ID NO: 60157 - RNA, 18 nt, Artificial Sequence
  Description of Artificial Sequence: Synthetic oligonucleotide
guuaacugggugugguga

SEQ ID NO: 60158 - RNA, 18 nt, Artificial Sequence
  Description of Artificial Sequence: Synthetic oligonucleotide
aaaaaguuaacugggugu

SEQ ID NO: 60159 - RNA, 18 nt, Artificial Sequence
  Description of Artificial Sequence: Synthetic oligonucleotide
ucuuuaaaaaguuaacug

SEQ ID NO: 60160 - RNA, 18 nt, Artificial Sequence
  Description of Artificial Sequence: Synthetic oligonucleotide
aguguucuuuaaaaaguu

SEQ ID NO: 60161 - RNA, 18 nt, Artificial Sequence
  Description of Artificial Sequence: Synthetic oligonucleotide
aaaaaaguguucuuuaaa

SEQ ID NO: 60162 - RNA, 18 nt, Artificial Sequence
  Description of Artificial Sequence: Synthetic oligonucleotide
aaaaaaaaaaaguguucu

SEQ ID NO: 60163 - RNA, 18 nt, Artificial Sequence
  Description of Artificial Sequence: Synthetic oligonucleotide
uaaaaaaaaaaaaaaagu

SEQ ID NO: 60164 - RNA, 18 nt, Artificial Sequence
  Description of Artificial Sequence: Synthetic oligonucleotide
ucucuuaaaaaaaaaaaa

SEQ ID NO: 60165 - RNA, 18 nt, Artificial Sequence
  Description of Artificial Sequence: Synthetic oligonucleotide
cccugucucuuaaaaaaa

SEQ ID NO: 60166 - RNA, 18 nt, Artificial Sequence
  Description of Artificial Sequence: Synthetic oligonucleotide
caagacccugucucuuaa

SEQ ID NO: 60167 - RNA, 18 nt, Artificial Sequence
  Description of Artificial Sequence: Synthetic oligonucleotide
cauagcaagacccugucu

SEQ ID NO: 60168 - RNA, 18 nt, Artificial Sequence
  Description of Artificial Sequence: Synthetic oligonucleotide
agcaacauagcaagaccc

SEQ ID NO: 60169 - RNA, 18 nt, Artificial Sequence
  Description of Artificial Sequence: Synthetic oligonucleotide
gccugagcaacauagcaa

SEQ ID NO: 60170 - RNA, 18 nt, Artificial Sequence
  Description of Artificial Sequence: Synthetic oligonucleotide
gaccagccugagcaacau

SEQ ID NO: 60171 - RNA, 18 nt, Artificial Sequence
  Description of Artificial Sequence: Synthetic oligonucleotide
uuugagaccagccugagc

SEQ ID NO: 60172 - RNA, 18 nt, Artificial Sequence
  Description of Artificial Sequence: Synthetic oligonucleotide
aggaguuugagaccagcc

SEQ ID NO: 60173 - RNA, 18 nt, Artificial Sequence
  Description of Artificial Sequence: Synthetic oligonucleotide
agcccaggaguuugagac

SEQ ID NO: 60174 - RNA, 18 nt, Artificial Sequence
  Description of Artificial Sequence: Synthetic oligonucleotide
acuugagcccaggaguuu

SEQ ID NO: 60175 - RNA, 18 nt, Artificial Sequence
  Description of Artificial Sequence: Synthetic oligonucleotide
ggaucacuugagcccagg

SEQ ID NO: 60176 - RNA, 18 nt, Artificial Sequence
  Description of Artificial Sequence: Synthetic oligonucleotide
cgggaggaucacuugagc

SEQ ID NO: 60177 - RNA, 18 nt, Artificial Sequence
  Description of Artificial Sequence: Synthetic oligonucleotide
caaggcgggaggaucacu

SEQ ID NO: 60178 - RNA, 18 nt, Artificial Sequence
  Description of Artificial Sequence: Synthetic oligonucleotide
gaggccaaggcgggagga

SEQ ID NO: 60179 - RNA, 18 nt, Artificial Sequence
  Description of Artificial Sequence: Synthetic oligonucleotide
uuugggaggccaaggcgg

SEQ ID NO: 60180 - RNA, 18 nt, Artificial Sequence
  Description of Artificial Sequence: Synthetic oligonucleotide
agcacuuugggaggccaa

SEQ ID NO: 60181 - RNA, 18 nt, Artificial Sequence
  Description of Artificial Sequence: Synthetic oligonucleotide
aucccagcacuuugggag

SEQ ID NO: 60182 - RNA, 18 nt, Artificial Sequence
  Description of Artificial Sequence: Synthetic oligonucleotide
cugucaucccagcacuuu

SEQ ID NO: 60183 - RNA, 18 nt, Artificial Sequence
  Description of Artificial Sequence: Synthetic oligonucleotide
cacaucugucaucccagc

SEQ ID NO: 60184 - RNA, 18 nt, Artificial Sequence
  Description of Artificial Sequence: Synthetic oligonucleotide
uggcucacaucugucauc

SEQ ID NO: 60185 - RNA, 18 nt, Artificial Sequence
  Description of Artificial Sequence: Synthetic oligonucleotide
cacaauggcucacaucug

SEQ ID NO: 60186 - RNA, 18 nt, Artificial Sequence
  Description of Artificial Sequence: Synthetic oligonucleotide
cuaggcacaauggcucac

SEQ ID NO: 60187 - RNA, 18 nt, Artificial Sequence
  Description of Artificial Sequence: Synthetic oligonucleotide
ccuggcuaggcacaaugg

SEQ ID NO: 60188 - RNA, 18 nt, Artificial Sequence
  Description of Artificial Sequence: Synthetic oligonucleotide
cucguccuggcuaggcac

SEQ ID NO: 60189 - RNA, 18 nt, Artificial Sequence
  Description of Artificial Sequence: Synthetic oligonucleotide
aaaaucucguccuggcua

SEQ ID NO: 60190 - RNA, 18 nt, Artificial Sequence
  Description of Artificial Sequence: Synthetic oligonucleotide
cucuaaaaaucucguccu

SEQ ID NO: 60191 - RNA, 18 nt, Artificial Sequence
  Description of Artificial Sequence: Synthetic oligonucleotide
cuacccucuaaaaaucuc

SEQ ID NO: 60192 - RNA, 18 nt, Artificial Sequence
  Description of Artificial Sequence: Synthetic oligonucleotide
cuacucuacccucuaaaa

SEQ ID NO: 60193 - RNA, 18 nt, Artificial Sequence
  Description of Artificial Sequence: Synthetic oligonucleotide
uauuccuacucuacccuc

SEQ ID NO: 60194 - RNA, 18 nt, Artificial Sequence
  Description of Artificial Sequence: Synthetic oligonucleotide
gcucuuauuccuacucua

SEQ ID NO: 60195 - RNA, 18 nt, Artificial Sequence
  Description of Artificial Sequence: Synthetic oligonucleotide
ugcaagcucuuauuccua

SEQ ID NO: 60196 - RNA, 18 nt, Artificial Sequence
  Description of Artificial Sequence: Synthetic oligonucleotide
auaagugcaagcucuuau

SEQ ID NO: 60197 - RNA, 18 nt, Artificial Sequence
  Description of Artificial Sequence: Synthetic oligonucleotide
gccucauaagugcaagcu

SEQ ID NO: 60198 - RNA, 18 nt, Artificial Sequence
  Description of Artificial Sequence: Synthetic oligonucleotide
caugugccucauaagugc

SEQ ID NO: 60199 - RNA, 18 nt, Artificial Sequence
  Description of Artificial Sequence: Synthetic oligonucleotide
gccaucaugugccucaua

SEQ ID NO: 60200 - RNA, 18 nt, Artificial Sequence
  Description of Artificial Sequence: Synthetic oligonucleotide
cugaagccaucaugugcc

SEQ ID NO: 60201 - RNA, 18 nt, Artificial Sequence
  Description of Artificial Sequence: Synthetic oligonucleotide
gacagcugaagccaucau

SEQ ID NO: 60202 - RNA, 18 nt, Artificial Sequence
  Description of Artificial Sequence: Synthetic oligonucleotide
aagcagacagcugaagcc

SEQ ID NO: 60203 - RNA, 18 nt, Artificial Sequence
  Description of Artificial Sequence: Synthetic oligonucleotide
cugcaaagcagacagcug

SEQ ID NO: 60204 - RNA, 18 nt, Artificial Sequence
  Description of Artificial Sequence: Synthetic oligonucleotide
agacucugcaaagcagac

SEQ ID NO: 60205 - RNA, 18 nt, Artificial Sequence
  Description of Artificial Sequence: Synthetic oligonucleotide
ucuugagacucugcaaag

SEQ ID NO: 60206 - RNA, 18 nt, Artificial Sequence
  Description of Artificial Sequence: Synthetic oligonucleotide
agcuuucuugagacucug

SEQ ID NO: 60207 - RNA, 18 nt, Artificial Sequence
  Description of Artificial Sequence: Synthetic oligonucleotide
cucagagcuuucuugaga

SEQ ID NO: 60208 - RNA, 18 nt, Artificial Sequence
  Description of Artificial Sequence: Synthetic oligonucleotide
agguucucagagcuuucu

SEQ ID NO: 60209 - RNA, 18 nt, Artificial Sequence
  Description of Artificial Sequence: Synthetic oligonucleotide
gcuuaagguucucagagc

SEQ ID NO: 60210 - RNA, 18 nt, Artificial Sequence
  Description of Artificial Sequence: Synthetic oligonucleotide
ccucugcuuaagguucuc

SEQ ID NO: 60211 - RNA, 18 nt, Artificial Sequence
  Description of Artificial Sequence: Synthetic oligonucleotide
aauggccucugcuuaagg

SEQ ID NO: 60212 - RNA, 18 nt, Artificial Sequence
  Description of Artificial Sequence: Synthetic oligonucleotide
uguaaaauggccucugcu

SEQ ID NO: 60213 - RNA, 18 nt, Artificial Sequence
  Description of Artificial Sequence: Synthetic oligonucleotide
ucacauguaaaauggccu

SEQ ID NO: 60214 - RNA, 18 nt, Artificial Sequence
  Description of Artificial Sequence: Synthetic oligonucleotide
uguccucacauguaaaau

SEQ ID NO: 60215 - RNA, 18 nt, Artificial Sequence
  Description of Artificial Sequence: Synthetic oligonucleotide
cucuguguccucacaugu

SEQ ID NO: 60216 - RNA, 18 nt, Artificial Sequence
  Description of Artificial Sequence: Synthetic oligonucleotide
uguaccucuguguccuca

SEQ ID NO: 60217 - RNA, 18 nt, Artificial Sequence
  Description of Artificial Sequence: Synthetic oligonucleotide
cucucuguaccucugugu

SEQ ID NO: 60218 - RNA, 18 nt, Artificial Sequence
  Description of Artificial Sequence: Synthetic oligonucleotide
cucaccucucuguaccuc

SEQ ID NO: 60219 - RNA, 18 nt, Artificial Sequence
  Description of Artificial Sequence: Synthetic oligonucleotide
uuuaucucaccucucugu

SEQ ID NO: 60220 - RNA, 18 nt, Artificial Sequence
  Description of Artificial Sequence: Synthetic oligonucleotide
ggccauuuaucucaccuc

SEQ ID NO: 60221 - RNA, 18 nt, Artificial Sequence
  Description of Artificial Sequence: Synthetic oligonucleotide
accuuggccauuuaucuc

SEQ ID NO: 60222 - RNA, 18 nt, Artificial Sequence
  Description of Artificial Sequence: Synthetic oligonucleotide
augugaccuuggccauuu

SEQ ID NO: 60223 - RNA, 18 nt, Artificial Sequence
  Description of Artificial Sequence: Synthetic oligonucleotide
uagguaugugaccuuggc

SEQ ID NO: 60224 - RNA, 18 nt, Artificial Sequence
  Description of Artificial Sequence: Synthetic oligonucleotide
ccucuuagguaugugacc

SEQ ID NO: 60225 - RNA, 18 nt, Artificial Sequence
  Description of Artificial Sequence: Synthetic oligonucleotide
cuucuccucuuagguaug

SEQ ID NO: 60226 - RNA, 18 nt, Artificial Sequence
  Description of Artificial Sequence: Synthetic oligonucleotide
gccuccuucuccucuuag

SEQ ID NO: 60227 - RNA, 18 nt, Artificial Sequence
  Description of Artificial Sequence: Synthetic oligonucleotide
auccugccuccuucuccu

SEQ ID NO: 60228 - RNA, 18 nt, Artificial Sequence
  Description of Artificial Sequence: Synthetic oligonucleotide
uucaaauccugccuccuu

SEQ ID NO: 60229 - RNA, 18 nt, Artificial Sequence
  Description of Artificial Sequence: Synthetic oligonucleotide
ugcgauucaaauccugcc

SEQ ID NO: 60230 - RNA, 18 nt, Artificial Sequence
  Description of Artificial Sequence: Synthetic oligonucleotide
caggcugcgauucaaauc

SEQ ID NO: 60231 - RNA, 18 nt, Artificial Sequence
  Description of Artificial Sequence: Synthetic oligonucleotide
acgugcaggcugcgauuc

SEQ ID NO: 60232 - RNA, 18 nt, Artificial Sequence
  Description of Artificial Sequence: Synthetic oligonucleotide
gggugacgugcaggcugc

SEQ ID NO: 60233 - RNA, 18 nt, Artificial Sequence
  Description of Artificial Sequence: Synthetic oligonucleotide
ccaguuacucaccauggg

SEQ ID NO: 60234 - RNA, 18 nt, Artificial Sequence
  Description of Artificial Sequence: Synthetic oligonucleotide
cuuaccaguuacucacca

SEQ ID NO: 60235 - RNA, 18 nt, Artificial Sequence
  Description of Artificial Sequence: Synthetic oligonucleotide
acucacuuaccaguuacu

SEQ ID NO: 60236 - RNA, 18 nt, Artificial Sequence
  Description of Artificial Sequence: Synthetic oligonucleotide
ugcucacucacuuaccag

SEQ ID NO: 60237 - RNA, 18 nt, Artificial Sequence
  Description of Artificial Sequence: Synthetic oligonucleotide
agggaugcucacucacuu

SEQ ID NO: 60238 - RNA, 18 nt, Artificial Sequence
  Description of Artificial Sequence: Synthetic oligonucleotide
acacugaggcccaaguca

SEQ ID NO: 60239 - RNA, 18 nt, Artificial Sequence
  Description of Artificial Sequence: Synthetic oligonucleotide
gggacacugaggcccaag

SEQ ID NO: 60240 - RNA, 18 nt, Artificial Sequence
  Description of Artificial Sequence: Synthetic oligonucleotide
gccaucaugaucuucggg

SEQ ID NO: 60241 - RNA, 18 nt, Artificial Sequence
  Description of Artificial Sequence: Synthetic oligonucleotide
uauacgccaucaugaucu

SEQ ID NO: 60242 - RNA, 18 nt, Artificial Sequence
  Description of Artificial Sequence: Synthetic oligonucleotide
guucauauacgccaucau

SEQ ID NO: 60243 - RNA, 18 nt, Artificial Sequence
  Description of Artificial Sequence: Synthetic oligonucleotide
cccggguucauauacgcc

SEQ ID NO: 60244 - RNA, 18 nt, Artificial Sequence
  Description of Artificial Sequence: Synthetic oligonucleotide
gggccccggguucauaua

SEQ ID NO: 60245 - RNA, 18 nt, Artificial Sequence
  Description of Artificial Sequence: Synthetic oligonucleotide
cguugacagaauaguggg

SEQ ID NO: 60246 - RNA, 18 nt, Artificial Sequence
  Description of Artificial Sequence: Synthetic oligonucleotide
caaggcguugacagaaua

SEQ ID NO: 60247 - RNA, 18 nt, Artificial Sequence
  Description of Artificial Sequence: Synthetic oligonucleotide
agggccaaggcguugaca

SEQ ID NO: 60248 - RNA, 18 nt, Artificial Sequence
  Description of Artificial Sequence: Synthetic oligonucleotide
cacuuagggccaaggcgu

SEQ ID NO: 60249 - RNA, 18 nt, Artificial Sequence
  Description of Artificial Sequence: Synthetic oligonucleotide
gggccacuuagggccaag

SEQ ID NO: 60250 - RNA, 18 nt, Artificial Sequence
  Description of Artificial Sequence: Synthetic oligonucleotide
caucagauccacacuggg

SEQ ID NO: 60251 - RNA, 18 nt, Artificial Sequence
  Description of Artificial Sequence: Synthetic oligonucleotide
uggugcaucagauccaca

SEQ ID NO: 60252 - RNA, 18 nt, Artificial Sequence
  Description of Artificial Sequence: Synthetic oligonucleotide
cagccuggugcaucagau

SEQ ID NO: 60253 - RNA, 18 nt, Artificial Sequence
  Description of Artificial Sequence: Synthetic oligonucleotide
gggcacagccuggugcau

SEQ ID NO: 60254 - RNA, 18 nt, Artificial Sequence
  Description of Artificial Sequence: Synthetic oligonucleotide
ggguagggcacagccugg

SEQ ID NO: 60255 - RNA, 18 nt, Artificial Sequence
  Description of Artificial Sequence: Synthetic oligonucleotide
acugaggcccaagucagg

SEQ ID NO: 60256 - RNA, 18 nt, Artificial Sequence
  Description of Artificial Sequence: Synthetic oligonucleotide
gggacacugaggcccaag

SEQ ID NO: 60257 - RNA, 18 nt, Artificial Sequence
  Description of Artificial Sequence: Synthetic oligonucleotide
gccaucaugaucuucggg

SEQ ID NO: 60258 - RNA, 18 nt, Artificial Sequence
  Description of Artificial Sequence: Synthetic oligonucleotide
auacgccaucaugaucuu

SEQ ID NO: 60259 - RNA, 18 nt, Artificial Sequence
  Description of Artificial Sequence: Synthetic oligonucleotide
uucauauacgccaucaug

SEQ ID NO: 60260 - RNA, 18 nt, Artificial Sequence
  Description of Artificial Sequence: Synthetic oligonucleotide
ccggguucauauacgcca

SEQ ID NO: 60261 - RNA, 18 nt, Artificial Sequence
  Description of Artificial Sequence: Synthetic oligonucleotide
gggccccggguucauaua

SEQ ID NO: 60262 - RNA, 18 nt, Artificial Sequence
  Description of Artificial Sequence: Synthetic oligonucleotide
cguugacagaauaguggg

SEQ ID NO: 60263 - RNA, 18 nt, Artificial Sequence
  Description of Artificial Sequence: Synthetic oligonucleotide
aaggcguugacagaauag

SEQ ID NO: 60264 - RNA, 18 nt, Artificial Sequence
  Description of Artificial Sequence: Synthetic oligonucleotide
gggccaaggcguugacag

SEQ ID NO: 60265 - RNA, 18 nt, Artificial Sequence
  Description of Artificial Sequence: Synthetic oligonucleotide
acuuagggccaaggcguu

SEQ ID NO: 60266 - RNA, 18 nt, Artificial Sequence
  Description of Artificial Sequence: Synthetic oligonucleotide
gggccacuuagggccaag

SEQ ID NO: 60267 - RNA, 18 nt, Artificial Sequence
  Description of Artificial Sequence: Synthetic oligonucleotide
caucagauccacacuggg

SEQ ID NO: 60268 - RNA, 18 nt, Artificial Sequence
  Description of Artificial Sequence: Synthetic oligonucleotide
ggugcaucagauccacac

SEQ ID NO: 60269 - RNA, 18 nt, Artificial Sequence
  Description of Artificial Sequence: Synthetic oligonucleotide
agccuggugcaucagauc

SEQ ID NO: 60270 - RNA, 18 nt, Artificial Sequence
  Description of Artificial Sequence: Synthetic oligonucleotide
ggcacagccuggugcauc

SEQ ID NO: 60271 - RNA, 18 nt, Artificial Sequence
  Description of Artificial Sequence: Synthetic oligonucleotide
gguagggcacagccuggu

SEQ ID NO: 60272 - RNA, 18 nt, Artificial Sequence
  Description of Artificial Sequence: Synthetic oligonucleotide
ccaagagaaacgacugua

SEQ ID NO: 60273 - RNA, 18 nt, Artificial Sequence
  Description of Artificial Sequence: Synthetic oligonucleotide
gggugccaagagaaacga

SEQ ID NO: 60274 - RNA, 18 nt, Artificial Sequence
  Description of Artificial Sequence: Synthetic oligonucleotide
caagagaugaggccagcc

SEQ ID NO: 60275 - RNA, 18 nt, Artificial Sequence
  Description of Artificial Sequence: Synthetic oligonucleotide
uccuccaagagaugaggc

SEQ ID NO: 60276 - RNA, 18 nt, Artificial Sequence
  Description of Artificial Sequence: Synthetic oligonucleotide
agagguccuccaagagau

SEQ ID NO: 60277 - RNA, 18 nt, Artificial Sequence
  Description of Artificial Sequence: Synthetic oligonucleotide
accccagagguccuccaa

SEQ ID NO: 60278 - RNA, 18 nt, Artificial Sequence
  Description of Artificial Sequence: Synthetic oligonucleotide
aagggaccccagaggucc

SEQ ID NO: 60279 - RNA, 18 nt, Artificial Sequence
  Description of Artificial Sequence: Synthetic oligonucleotide
gggcaaagggaccccaga

SEQ ID NO: 60280 - RNA, 18 nt, Artificial Sequence
  Description of Artificial Sequence: Synthetic oligonucleotide
ugugauugccuucuuccu

SEQ ID NO: 60281 - RNA, 18 nt, Artificial Sequence
  Description of Artificial Sequence: Synthetic oligonucleotide
gccccugugauugccuuc

SEQ ID NO: 60282 - RNA, 18 nt, Artificial Sequence
  Description of Artificial Sequence: Synthetic oligonucleotide
aagucgccccugugauug

SEQ ID NO: 60283 - RNA, 18 nt, Artificial Sequence
  Description of Artificial Sequence: Synthetic oligonucleotide
cccugaagucgccccugu

SEQ ID NO: 60284 - RNA, 18 nt, Artificial Sequence
  Description of Artificial Sequence: Synthetic oligonucleotide
uauggcccugaagucgcc

SEQ ID NO: 60285 - RNA, 18 nt, Artificial Sequence
  Description of Artificial Sequence: Synthetic oligonucleotide
ugguguauggcccugaag

SEQ ID NO: 60286 - RNA, 18 nt, Artificial Sequence
  Description of Artificial Sequence: Synthetic oligonucleotide
agggcugguguauggccc

SEQ ID NO: 60287 - RNA, 18 nt, Artificial Sequence
  Description of Artificial Sequence: Synthetic oligonucleotide
cccagagggcugguguau

SEQ ID NO: 60288 - RNA, 18 nt, Artificial Sequence
  Description of Artificial Sequence: Synthetic oligonucleotide
augaacccagagggcugg

SEQ ID NO: 60289 - RNA, 18 nt, Artificial Sequence
  Description of Artificial Sequence: Synthetic oligonucleotide
uucagaugaacccagagg

SEQ ID NO: 60290 - RNA, 18 nt, Artificial Sequence
  Description of Artificial Sequence: Synthetic oligonucleotide
uacauuucagaugaaccc

SEQ ID NO: 60291 - RNA, 18 nt, Artificial Sequence
  Description of Artificial Sequence: Synthetic oligonucleotide
ugacauacauuucagaug

SEQ ID NO: 60292 - RNA, 18 nt, Artificial Sequence
  Description of Artificial Sequence: Synthetic oligonucleotide
cuaagugacauacauuuc

SEQ ID NO: 60293 - RNA, 18 nt, Artificial Sequence
  Description of Artificial Sequence: Synthetic oligonucleotide
uuuuucuaagugacauac

SEQ ID NO: 60294 - RNA, 18 nt, Artificial Sequence
  Description of Artificial Sequence: Synthetic oligonucleotide
uaauguuuuucuaaguga

SEQ ID NO: 60295 - RNA, 18 nt, Artificial Sequence
  Description of Artificial Sequence: Synthetic oligonucleotide
acugcuaauguuuuucua

SEQ ID NO: 60296 - RNA, 18 nt, Artificial Sequence
  Description of Artificial Sequence: Synthetic oligonucleotide
cuaggacugcuaauguuu

SEQ ID NO: 60297 - RNA, 18 nt, Artificial Sequence
  Description of Artificial Sequence: Synthetic oligonucleotide
aauuucuaggacugcuaa

SEQ ID NO: 60298 - RNA, 18 nt, Artificial Sequence
  Description of Artificial Sequence: Synthetic oligonucleotide
uccugaauuucuaggacu

SEQ ID NO: 60299 - RNA, 18 nt, Artificial Sequence
  Description of Artificial Sequence: Synthetic oligonucleotide
cucuguccugaauuucua

SEQ ID NO: 60300 - RNA, 18 nt, Artificial Sequence
  Description of Artificial Sequence: Synthetic oligonucleotide
ggaaccucuguccugaau

SEQ ID NO: 60301 - RNA, 18 nt, Artificial Sequence
  Description of Artificial Sequence: Synthetic oligonucleotide
caaaaggaaccucugucc

SEQ ID NO: 60302 - RNA, 18 nt, Artificial Sequence
  Description of Artificial Sequence: Synthetic oligonucleotide
caccccaaaaggaaccuc

SEQ ID NO: 60303 - RNA, 18 nt, Artificial Sequence
  Description of Artificial Sequence: Synthetic oligonucleotide
uuccucaccccaaaagga

SEQ ID NO: 60304 - RNA, 18 nt, Artificial Sequence
  Description of Artificial Sequence: Synthetic oligonucleotide
cccucuuccucaccccaa

SEQ ID NO: 60305 - RNA, 18 nt, Artificial Sequence
  Description of Artificial Sequence: Synthetic oligonucleotide
acauccccucuuccucac

SEQ ID NO: 60306 - RNA, 18 nt, Artificial Sequence
  Description of Artificial Sequence: Synthetic oligonucleotide
agauuacauccccucuuc

SEQ ID NO: 60307 - RNA, 18 nt, Artificial Sequence
  Description of Artificial Sequence: Synthetic oligonucleotide
cuuccagauuacaucccc

SEQ ID NO: 60308 - RNA, 18 nt, Artificial Sequence
  Description of Artificial Sequence: Synthetic oligonucleotide
uuccccuuccagauuaca

SEQ ID NO: 60309 - RNA, 18 nt, Artificial Sequence
  Description of Artificial Sequence: Synthetic oligonucleotide
cuugauuccccuuccaga

SEQ ID NO: 60310 - RNA, 18 nt, Artificial Sequence
  Description of Artificial Sequence: Synthetic oligonucleotide
uuccucuugauuccccuu

SEQ ID NO: 60311 - RNA, 18 nt, Artificial Sequence
  Description of Artificial Sequence: Synthetic oligonucleotide
gaaaauuccucuugauuc

SEQ ID NO: 60312 - RNA, 18 nt, Artificial Sequence
  Description of Artificial Sequence: Synthetic oligonucleotide
cagaugaaaauuccucuu

SEQ ID NO: 60313 - RNA, 18 nt, Artificial Sequence
  Description of Artificial Sequence: Synthetic oligonucleotide
gguaacagaugaaaauuc

SEQ ID NO: 60314 - RNA, 18 nt, Artificial Sequence
  Description of Artificial Sequence: Synthetic oligonucleotide
guuuugguaacagaugaa

SEQ ID NO: 60315 - RNA, 18 nt, Artificial Sequence
  Description of Artificial Sequence: Synthetic oligonucleotide
auaaaguuuugguaacag

SEQ ID NO: 60316 - RNA, 18 nt, Artificial Sequence
  Description of Artificial Sequence: Synthetic oligonucleotide
aaauaauaaaguuuuggu

SEQ ID NO: 60317 - RNA, 18 nt, Artificial Sequence
  Description of Artificial Sequence: Synthetic oligonucleotide
uaaauaaauaauaaaguu

SEQ ID NO: 60318 - RNA, 18 nt, Artificial Sequence
  Description of Artificial Sequence: Synthetic oligonucleotide
aaaaauaaauaaauaaua

SEQ ID NO: 60319 - RNA, 18 nt, Artificial Sequence
  Description of Artificial Sequence: Synthetic oligonucleotide
cucugaaaaauaaauaaa

SEQ ID NO: 60320 - RNA, 18 nt, Artificial Sequence
  Description of Artificial Sequence: Synthetic oligonucleotide
cuugucucugaaaaauaa

SEQ ID NO: 60321 - RNA, 18 nt, Artificial Sequence
  Description of Artificial Sequence: Synthetic oligonucleotide
gagaccuugucucugaaa

SEQ ID NO: 60322 - RNA, 18 nt, Artificial Sequence
  Description of Artificial Sequence: Synthetic oligonucleotide
agugugagaccuugucuc

SEQ ID NO: 60323 - RNA, 18 nt, Artificial Sequence
  Description of Artificial Sequence: Synthetic oligonucleotide
gacagagugugagaccuu

SEQ ID NO: 60324 - RNA, 18 nt, Artificial Sequence
  Description of Artificial Sequence: Synthetic oligonucleotide
ugggugacagagugugag

SEQ ID NO: 60325 - RNA, 18 nt, Artificial Sequence
  Description of Artificial Sequence: Synthetic oligonucleotide
cagccugggugacagagu

SEQ ID NO: 60326 - RNA, 18 nt, Artificial Sequence
  Description of Artificial Sequence: Synthetic oligonucleotide
cacuccagccugggugac

SEQ ID NO: 60327 - RNA, 18 nt, Artificial Sequence
  Description of Artificial Sequence: Synthetic oligonucleotide
cacugcacuccagccugg

SEQ ID NO: 60328 - RNA, 18 nt, Artificial Sequence
  Description of Artificial Sequence: Synthetic oligonucleotide
accaccacugcacuccag

SEQ ID NO: 60329 - RNA, 18 nt, Artificial Sequence
  Description of Artificial Sequence: Synthetic oligonucleotide
ugaccaccaccacugcac

SEQ ID NO: 60330 - RNA, 18 nt, Artificial Sequence
  Description of Artificial Sequence: Synthetic oligonucleotide
agccgugaccaccaccac

SEQ ID NO: 60331 - RNA, 18 nt, Artificial Sequence
  Description of Artificial Sequence: Synthetic oligonucleotide
cagugagccgugaccacc

SEQ ID NO: 60332 - RNA, 18 nt, Artificial Sequence
  Description of Artificial Sequence: Synthetic oligonucleotide
ggcugcagugagccguga

SEQ ID NO: 60333 - RNA, 18 nt, Artificial Sequence
  Description of Artificial Sequence: Synthetic oligonucleotide
uucgaggcugcagugagc

SEQ ID NO: 60334 - RNA, 18 nt, Artificial Sequence
  Description of Artificial Sequence: Synthetic oligonucleotide
aggaguucgaggcugcag

SEQ ID NO: 60335 - RNA, 18 nt, Artificial Sequence
  Description of Artificial Sequence: Synthetic oligonucleotide
agcccaggaguucgaggc

SEQ ID NO: 60336 - RNA, 18 nt, Artificial Sequence
  Description of Artificial Sequence: Synthetic oligonucleotide
gcuugagcccaggaguuc

SEQ ID NO: 60337 - RNA, 18 nt, Artificial Sequence
  Description of Artificial Sequence: Synthetic oligonucleotide
ggauugcuugagcccagg

SEQ ID NO: 60338 - RNA, 18 nt, Artificial Sequence
  Description of Artificial Sequence: Synthetic oligonucleotide
ugggaggauugcuugagc

SEQ ID NO: 60339 - RNA, 18 nt, Artificial Sequence
  Description of Artificial Sequence: Synthetic oligonucleotide
ugaggugggaggauugcu

SEQ ID NO: 60340 - RNA, 18 nt, Artificial Sequence
  Description of Artificial Sequence: Synthetic oligonucleotide
gaggcugaggugggagga

SEQ ID NO: 60341 - RNA, 18 nt, Artificial Sequence
  Description of Artificial Sequence: Synthetic oligonucleotide
cucaggaggcugaggugg

SEQ ID NO: 60342 - RNA, 18 nt, Artificial Sequence
  Description of Artificial Sequence: Synthetic oligonucleotide
agcuacucaggaggcuga

SEQ ID NO: 60343 - RNA, 18 nt, Artificial Sequence
  Description of Artificial Sequence: Synthetic oligonucleotide
gucccagcuacucaggag

SEQ ID NO: 60344 - RNA, 18 nt, Artificial Sequence
  Description of Artificial Sequence: Synthetic oligonucleotide
cugcagucccagcuacuc

SEQ ID NO: 60345 - RNA, 18 nt, Artificial Sequence
  Description of Artificial Sequence: Synthetic oligonucleotide
cacaccugcagucccagc

SEQ ID NO: 60346 - RNA, 18 nt, Artificial Sequence
  Description of Artificial Sequence: Synthetic oligonucleotide
uggcucacaccugcaguc

SEQ ID NO: 60347 - RNA, 18 nt, Artificial Sequence
  Description of Artificial Sequence: Synthetic oligonucleotide
cacaauggcucacaccug

SEQ ID NO: 60348 - RNA, 18 nt, Artificial Sequence
  Description of Artificial Sequence: Synthetic oligonucleotide
cuaggcacaauggcucac

SEQ ID NO: 60349 - RNA, 18 nt, Artificial Sequence
  Description of Artificial Sequence: Synthetic oligonucleotide
cgggccuaggcacaaugg

SEQ ID NO: 60350 - RNA, 18 nt, Artificial Sequence
  Description of Artificial Sequence: Synthetic oligonucleotide
ccccccgggccuaggcac

SEQ ID NO: 60351 - RNA, 18 nt, Artificial Sequence
  Description of Artificial Sequence: Synthetic oligonucleotide
aagugccccccgggccua

SEQ ID NO: 60352 - RNA, 18 nt, Artificial Sequence
  Description of Artificial Sequence: Synthetic oligonucleotide
aaaaaaagugccccccgg

SEQ ID NO: 60353 - RNA, 18 nt, Artificial Sequence
  Description of Artificial Sequence: Synthetic oligonucleotide
uaaaaaaaaaaagugccc

SEQ ID NO: 60354 - RNA, 18 nt, Artificial Sequence
  Description of Artificial Sequence: Synthetic oligonucleotide
aaaauuaaaaaaaaaaag

SEQ ID NO: 60355 - RNA, 18 nt, Artificial Sequence
  Description of Artificial Sequence: Synthetic oligonucleotide
aaaauaaaauuaaaaaaa

SEQ ID NO: 60356 - RNA, 18 nt, Artificial Sequence
  Description of Artificial Sequence: Synthetic oligonucleotide
ucucaaaaauaaaauuaa

SEQ ID NO: 60357 - RNA, 18 nt, Artificial Sequence
  Description of Artificial Sequence: Synthetic oligonucleotide
cccugucucaaaaauaaa

SEQ ID NO: 60358 - RNA, 18 nt, Artificial Sequence
  Description of Artificial Sequence: Synthetic oligonucleotide
ugagacccugucucaaaa

SEQ ID NO: 60359 - RNA, 18 nt, Artificial Sequence
  Description of Artificial Sequence: Synthetic oligonucleotide
cagagugagacccugucu

SEQ ID NO: 60360 - RNA, 18 nt, Artificial Sequence
  Description of Artificial Sequence: Synthetic oligonucleotide
ggcaacagagugagaccc

SEQ ID NO: 60361 - RNA, 18 nt, Artificial Sequence
  Description of Artificial Sequence: Synthetic oligonucleotide
gagugggcaacagaguga

SEQ ID NO: 60362 - RNA, 18 nt, Artificial Sequence
  Description of Artificial Sequence: Synthetic oligonucleotide
cuucagagugggcaacag

SEQ ID NO: 60363 - RNA, 18 nt, Artificial Sequence
  Description of Artificial Sequence: Synthetic oligonucleotide
uugcacuucagagugggc

SEQ ID NO: 60364 - RNA, 18 nt, Artificial Sequence
  Description of Artificial Sequence: Synthetic oligonucleotide
caccauugcacuucagag

SEQ ID NO: 60365 - RNA, 18 nt, Artificial Sequence
  Description of Artificial Sequence: Synthetic oligonucleotide
cgggaggcugagggagga

SEQ ID NO: 60366 - RNA, 18 nt, Artificial Sequence
  Description of Artificial Sequence: Synthetic oligonucleotide
cuacucgggaggcugagg

SEQ ID NO: 60367 - RNA, 18 nt, Artificial Sequence
  Description of Artificial Sequence: Synthetic oligonucleotide
cccagcuacucgggaggc

SEQ ID NO: 60368 - RNA, 18 nt, Artificial Sequence
  Description of Artificial Sequence: Synthetic oligonucleotide
guagucccagcuacucgg

SEQ ID NO: 60369 - RNA, 18 nt, Artificial Sequence
  Description of Artificial Sequence: Synthetic oligonucleotide
ugccuguagucccagcua

SEQ ID NO: 60370 - RNA, 18 nt, Artificial Sequence
  Description of Artificial Sequence: Synthetic oligonucleotide
gugcaugccuguaguccc

SEQ ID NO: 60371 - RNA, 18 nt, Artificial Sequence
  Description of Artificial Sequence: Synthetic oligonucleotide
ugguggugcaugccugua

SEQ ID NO: 60372 - RNA, 18 nt, Artificial Sequence
  Description of Artificial Sequence: Synthetic oligonucleotide
aggugugguggugcaugc

SEQ ID NO: 60373 - RNA, 18 nt, Artificial Sequence
  Description of Artificial Sequence: Synthetic oligonucleotide
uagccaggugugguggug

SEQ ID NO: 60374 - RNA, 18 nt, Artificial Sequence
  Description of Artificial Sequence: Synthetic oligonucleotide
aaaauuagccaggugugg

SEQ ID NO: 60375 - RNA, 18 nt, Artificial Sequence
  Description of Artificial Sequence: Synthetic oligonucleotide
uacaaaaaauuagccagg

SEQ ID NO: 60376 - RNA, 18 nt, Artificial Sequence
  Description of Artificial Sequence: Synthetic oligonucleotide
aaaaauacaaaaaauuag

SEQ ID NO: 60377 - RNA, 18 nt, Artificial Sequence
  Description of Artificial Sequence: Synthetic oligonucleotide
cuacuaaaaauacaaaaa

SEQ ID NO: 60378 - RNA, 18 nt, Artificial Sequence
  Description of Artificial Sequence: Synthetic oligonucleotide
ugucucuacuaaaaauac

SEQ ID NO: 60379 - RNA, 18 nt, Artificial Sequence
  Description of Artificial Sequence: Synthetic oligonucleotide
accccugucucuacuaaa

SEQ ID NO: 60380 - RNA, 18 nt, Artificial Sequence
  Description of Artificial Sequence: Synthetic oligonucleotide
uauccuggccaacauggg

SEQ ID NO: 60381 - RNA, 18 nt, Artificial Sequence
  Description of Artificial Sequence: Synthetic oligonucleotide
gagacuauccuggccaac

SEQ ID NO: 60382 - RNA, 18 nt, Artificial Sequence
  Description of Artificial Sequence: Synthetic oligonucleotide
aaauugagacuauccugg

SEQ ID NO: 60383 - RNA, 18 nt, Artificial Sequence
  Description of Artificial Sequence: Synthetic oligonucleotide
ucaagaaauugagacuau

SEQ ID NO: 60384 - RNA, 18 nt, Artificial Sequence
  Description of Artificial Sequence: Synthetic oligonucleotide
caaggucaagaaauugag

SEQ ID NO: 60385 - RNA, 18 nt, Artificial Sequence
  Description of Artificial Sequence: Synthetic oligonucleotide
gaucacaaggucaagaaa

SEQ ID NO: 60386 - RNA, 18 nt, Artificial Sequence
  Description of Artificial Sequence: Synthetic oligonucleotide
aggcagaucacaagguca

SEQ ID NO: 60387 - RNA, 18 nt, Artificial Sequence
  Description of Artificial Sequence: Synthetic oligonucleotide
gaggcaggcagaucacaa

SEQ ID NO: 60388 - RNA, 18 nt, Artificial Sequence
  Description of Artificial Sequence: Synthetic oligonucleotide
aggcugaggcaggcagau

SEQ ID NO: 60389 - RNA, 18 nt, Artificial Sequence
  Description of Artificial Sequence: Synthetic oligonucleotide
uugggaggcugaggcagg

SEQ ID NO: 60390 - RNA, 18 nt, Artificial Sequence
  Description of Artificial Sequence: Synthetic oligonucleotide
gcacuuugggaggcugag

SEQ ID NO: 60391 - RNA, 18 nt, Artificial Sequence
  Description of Artificial Sequence: Synthetic oligonucleotide
ucccagcacuuugggagg

SEQ ID NO: 60392 - RNA, 18 nt, Artificial Sequence
  Description of Artificial Sequence: Synthetic oligonucleotide
uauaaucccagcacuuug

SEQ ID NO: 60393 - RNA, 18 nt, Artificial Sequence
  Description of Artificial Sequence: Synthetic oligonucleotide
acgccuauaaucccagca

SEQ ID NO: 60394 - RNA, 18 nt, Artificial Sequence
  Description of Artificial Sequence: Synthetic oligonucleotide
ggcucacgccuauaaucc

SEQ ID NO: 60395 - RNA, 18 nt, Artificial Sequence
  Description of Artificial Sequence: Synthetic oligonucleotide
gcgguggcucacgccuau

SEQ ID NO: 60396 - RNA, 18 nt, Artificial Sequence
  Description of Artificial Sequence: Synthetic oligonucleotide
ugggugcgguggcucacg

SEQ ID NO: 60397 - RNA, 18 nt, Artificial Sequence
  Description of Artificial Sequence: Synthetic oligonucleotide
ugggcugggugcgguggc

SEQ ID NO: 60398 - RNA, 18 nt, Artificial Sequence
  Description of Artificial Sequence: Synthetic oligonucleotide
aagucugggcugggugcg

SEQ ID NO: 60399 - RNA, 18 nt, Artificial Sequence
  Description of Artificial Sequence: Synthetic oligonucleotide
guagcaagucugggcugg

SEQ ID NO: 60400 - RNA, 18 nt, Artificial Sequence
  Description of Artificial Sequence: Synthetic oligonucleotide
uaaaaguagcaagucugg

SEQ ID NO: 60401 - RNA, 18 nt, Artificial Sequence
  Description of Artificial Sequence: Synthetic oligonucleotide
gccuauaaaaguagcaag

SEQ ID NO: 60402 - RNA, 18 nt, Artificial Sequence
  Description of Artificial Sequence: Synthetic oligonucleotide
uucuagccuauaaaagua

SEQ ID NO: 60403 - RNA, 18 nt, Artificial Sequence
  Description of Artificial Sequence: Synthetic oligonucleotide
accguuucuagccuauaa

SEQ ID NO: 60404 - RNA, 18 nt, Artificial Sequence
  Description of Artificial Sequence: Synthetic oligonucleotide
auucaaccguuucuagcc

SEQ ID NO: 60405 - RNA, 18 nt, Artificial Sequence
  Description of Artificial Sequence: Synthetic oligonucleotide
cugacauucaaccguuuc

SEQ ID NO: 60406 - RNA, 18 nt, Artificial Sequence
  Description of Artificial Sequence: Synthetic oligonucleotide
cauugcugacauucaacc

SEQ ID NO: 60407 - RNA, 18 nt, Artificial Sequence
  Description of Artificial Sequence: Synthetic oligonucleotide
caugacauugcugacauu

SEQ ID NO: 60408 - RNA, 18 nt, Artificial Sequence
  Description of Artificial Sequence: Synthetic oligonucleotide
ugaagcaugacauugcug

SEQ ID NO: 60409 - RNA, 18 nt, Artificial Sequence
  Description of Artificial Sequence: Synthetic oligonucleotide
ucaguugaagcaugacau

SEQ ID NO: 60410 - RNA, 18 nt, Artificial Sequence
  Description of Artificial Sequence: Synthetic oligonucleotide
cauaaucaguugaagcau

SEQ ID NO: 60411 - RNA, 18 nt, Artificial Sequence
  Description of Artificial Sequence: Synthetic oligonucleotide
uaagacauaaucaguuga

SEQ ID NO: 60412 - RNA, 18 nt, Artificial Sequence
  Description of Artificial Sequence: Synthetic oligonucleotide
ugcacuaagacauaauca

SEQ ID NO: 60413 - RNA, 18 nt, Artificial Sequence
  Description of Artificial Sequence: Synthetic oligonucleotide
ucuuaugcacuaagacau

SEQ ID NO: 60414 - RNA, 18 nt, Artificial Sequence
  Description of Artificial Sequence: Synthetic oligonucleotide
aacuuucuuaugcacuaa

SEQ ID NO: 60415 - RNA, 18 nt, Artificial Sequence
  Description of Artificial Sequence: Synthetic oligonucleotide
uucuaaacuuucuuaugc

SEQ ID NO: 60416 - RNA, 18 nt, Artificial Sequence
  Description of Artificial Sequence: Synthetic oligonucleotide
cccucuucuaaacuuucu

SEQ ID NO: 60417 - RNA, 18 nt, Artificial Sequence
  Description of Artificial Sequence: Synthetic oligonucleotide
uuuuucccucuucuaaac

SEQ ID NO: 60418 - RNA, 18 nt, Artificial Sequence
  Description of Artificial Sequence: Synthetic oligonucleotide
agucguuuuucccucuuc

SEQ ID NO: 60419 - RNA, 18 nt, Artificial Sequence
  Description of Artificial Sequence: Synthetic oligonucleotide
gugcgagucguuuuuccc

SEQ ID NO: 60420 - RNA, 18 nt, Artificial Sequence
  Description of Artificial Sequence: Synthetic oligonucleotide
gaggugugcgagucguuu

SEQ ID NO: 60421 - RNA, 18 nt, Artificial Sequence
  Description of Artificial Sequence: Synthetic oligonucleotide
acaaggaggugugcgagu

SEQ ID NO: 60422 - RNA, 18 nt, Artificial Sequence
  Description of Artificial Sequence: Synthetic oligonucleotide
gcucaacaaggaggugug

SEQ ID NO: 60423 - RNA, 18 nt, Artificial Sequence
  Description of Artificial Sequence: Synthetic oligonucleotide
cuuuagcucaacaaggag

SEQ ID NO: 60424 - RNA, 18 nt, Artificial Sequence
  Description of Artificial Sequence: Synthetic oligonucleotide
caaggcuuuagcucaaca

SEQ ID NO: 60425 - RNA, 18 nt, Artificial Sequence
  Description of Artificial Sequence: Synthetic oligonucleotide
gaccccaaggcuuuagcu

SEQ ID NO: 60426 - RNA, 18 nt, Artificial Sequence
  Description of Artificial Sequence: Synthetic oligonucleotide
ugccugaccccaaggcuu

SEQ ID NO: 60427 - RNA, 18 nt, Artificial Sequence
  Description of Artificial Sequence: Synthetic oligonucleotide
gcucaugccugaccccaa

SEQ ID NO: 60428 - RNA, 18 nt, Artificial Sequence
  Description of Artificial Sequence: Synthetic oligonucleotide
cuguggcucaugccugac

SEQ ID NO: 60429 - RNA, 18 nt, Artificial Sequence
  Description of Artificial Sequence: Synthetic oligonucleotide
gcacucuguggcucaugc

SEQ ID NO: 60430 - RNA, 18 nt, Artificial Sequence
  Description of Artificial Sequence: Synthetic oligonucleotide
gccuggcacucuguggcu

SEQ ID NO: 60431 - RNA, 18 nt, Artificial Sequence
  Description of Artificial Sequence: Synthetic oligonucleotide
ugugugccuggcacucug

SEQ ID NO: 60432 - RNA, 18 nt, Artificial Sequence
  Description of Artificial Sequence: Synthetic oligonucleotide
cucacugugugccuggca

SEQ ID NO: 60433 - RNA, 18 nt, Artificial Sequence
  Description of Artificial Sequence: Synthetic oligonucleotide
uacaccucacugugugcc

SEQ ID NO: 60434 - RNA, 18 nt, Artificial Sequence
  Description of Artificial Sequence: Synthetic oligonucleotide
ccuucuacaccucacugu

SEQ ID NO: 60435 - RNA, 18 nt, Artificial Sequence
  Description of Artificial Sequence: Synthetic oligonucleotide
ccugcccuucuacaccuc

SEQ ID NO: 60436 - RNA, 18 nt, Artificial Sequence
  Description of Artificial Sequence: Synthetic oligonucleotide
cauucccugcccuucuac

SEQ ID NO: 60437 - RNA, 18 nt, Artificial Sequence
  Description of Artificial Sequence: Synthetic oligonucleotide
auacacauucccugcccu

SEQ ID NO: 60438 - RNA, 18 nt, Artificial Sequence
  Description of Artificial Sequence: Synthetic oligonucleotide
auggaauacacauucccu

SEQ ID NO: 60439 - RNA, 18 nt, Artificial Sequence
  Description of Artificial Sequence: Synthetic oligonucleotide
uaaggauggaauacacau

SEQ ID NO: 60440 - RNA, 18 nt, Artificial Sequence
  Description of Artificial Sequence: Synthetic oligonucleotide
uaaacuaaggauggaaua

SEQ ID NO: 60441 - RNA, 18 nt, Artificial Sequence
  Description of Artificial Sequence: Synthetic oligonucleotide
cugccuaaacuaaggaug

SEQ ID NO: 60442 - RNA, 18 nt, Artificial Sequence
  Description of Artificial Sequence: Synthetic oligonucleotide
gccaucugccuaaacuaa

SEQ ID NO: 60443 - RNA, 18 nt, Artificial Sequence
  Description of Artificial Sequence: Synthetic oligonucleotide
ugguugccaucugccuaa

SEQ ID NO: 60444 - RNA, 18 nt, Artificial Sequence
  Description of Artificial Sequence: Synthetic oligonucleotide
cauccugguugccaucug

SEQ ID NO: 60445 - RNA, 18 nt, Artificial Sequence
  Description of Artificial Sequence: Synthetic oligonucleotide
aauuccauccugguugcc

SEQ ID NO: 60446 - RNA, 18 nt, Artificial Sequence
  Description of Artificial Sequence: Synthetic oligonucleotide
ccaagaauuccauccugg

SEQ ID NO: 60447 - RNA, 18 nt, Artificial Sequence
  Description of Artificial Sequence: Synthetic oligonucleotide
ggaugccaagaauuccau

SEQ ID NO: 60448 - RNA, 18 nt, Artificial Sequence
  Description of Artificial Sequence: Synthetic oligonucleotide
gggugggaugccaagaau

SEQ ID NO: 60449 - RNA, 18 nt, Artificial Sequence
  Description of Artificial Sequence: Synthetic oligonucleotide
aggcugggugggaugcca

SEQ ID NO: 60450 - RNA, 18 nt, Artificial Sequence
  Description of Artificial Sequence: Synthetic oligonucleotide
cccugaggcuggguggga

SEQ ID NO: 60451 - RNA, 18 nt, Artificial Sequence
  Description of Artificial Sequence: Synthetic oligonucleotide
ugaggcccugaggcuggg

SEQ ID NO: 60452 - RNA, 18 nt, Artificial Sequence
  Description of Artificial Sequence: Synthetic oligonucleotide
uggugugaggcccugagg

SEQ ID NO: 60453 - RNA, 18 nt, Artificial Sequence
  Description of Artificial Sequence: Synthetic oligonucleotide
ugggcuggugugaggccc

SEQ ID NO: 60454 - RNA, 18 nt, Artificial Sequence
  Description of Artificial Sequence: Synthetic oligonucleotide
ccacaugggcugguguga

SEQ ID NO: 60455 - RNA, 18 nt, Artificial Sequence
  Description of Artificial Sequence: Synthetic oligonucleotide
gucauccacaugggcugg

SEQ ID NO: 60456 - RNA, 18 nt, Artificial Sequence
  Description of Artificial Sequence: Synthetic oligonucleotide
cucaggucauccacaugg

SEQ ID NO: 60457 - RNA, 18 nt, Artificial Sequence
  Description of Artificial Sequence: Synthetic oligonucleotide
ggacccucaggucaucca

SEQ ID NO: 60458 - RNA, 18 nt, Artificial Sequence
  Description of Artificial Sequence: Synthetic oligonucleotide
aaacaggacccucagguc

SEQ ID NO: 60459 - RNA, 18 nt, Artificial Sequence
  Description of Artificial Sequence: Synthetic oligonucleotide
cccgccgcugcuuccugg

SEQ ID NO: 60460 - RNA, 18 nt, Artificial Sequence
  Description of Artificial Sequence: Synthetic oligonucleotide
gcgcucccgccgcugcuu

SEQ ID NO: 60461 - RNA, 18 nt, Artificial Sequence
  Description of Artificial Sequence: Synthetic oligonucleotide
guggugcgcucccgccgc

SEQ ID NO: 60462 - RNA, 18 nt, Artificial Sequence
  Description of Artificial Sequence: Synthetic oligonucleotide
ugaagguggugcgcuccc

SEQ ID NO: 60463 - RNA, 18 nt, Artificial Sequence
  Description of Artificial Sequence: Synthetic oligonucleotide
ccgggugaagguggugcg

SEQ ID NO: 60464 - RNA, 18 nt, Artificial Sequence
  Description of Artificial Sequence: Synthetic oligonucleotide
uggcuccgggugaaggug

SEQ ID NO: 60465 - RNA, 18 nt, Artificial Sequence
  Description of Artificial Sequence: Synthetic oligonucleotide
ccaguuggcuccggguga

SEQ ID NO: 60466 - RNA, 18 nt, Artificial Sequence
  Description of Artificial Sequence: Synthetic oligonucleotide
cuccuccaguuggcuccg

SEQ ID NO: 60467 - RNA, 18 nt, Artificial Sequence
  Description of Artificial Sequence: Synthetic oligonucleotide
uccagcuccuccaguugg

SEQ ID NO: 60468 - RNA, 18 nt, Artificial Sequence
  Description of Artificial Sequence: Synthetic oligonucleotide
gugccuccagcuccucca

SEQ ID NO: 60469 - RNA, 18 nt, Artificial Sequence
  Description of Artificial Sequence: Synthetic oligonucleotide
aaacagugccuccagcuc

SEQ ID NO: 60470 - RNA, 18 nt, Artificial Sequence
  Description of Artificial Sequence: Synthetic oligonucleotide
uuggcaaacagugccucc

SEQ ID NO: 60471 - RNA, 18 nt, Artificial Sequence
  Description of Artificial Sequence: Synthetic oligonucleotide
gggucuuggcaaacagug

SEQ ID NO: 60472 - RNA, 18 nt, Artificial Sequence
  Description of Artificial Sequence: Synthetic oligonucleotide
guacugggucuuggcaaa

SEQ ID NO: 60473 - RNA, 18 nt, Artificial Sequence
  Description of Artificial Sequence: Synthetic oligonucleotide
ucuggguacugggucuug

SEQ ID NO: 60474 - RNA, 18 nt, Artificial Sequence
  Description of Artificial Sequence: Synthetic oligonucleotide
agacgucuggguacuggg

SEQ ID NO: 60475 - RNA, 18 nt, Artificial Sequence
  Description of Artificial Sequence: Synthetic oligonucleotide
ggcauagacgucugggua

SEQ ID NO: 60476 - RNA, 18 nt, Artificial Sequence
  Description of Artificial Sequence: Synthetic oligonucleotide
ucacgggcauagacgucu

SEQ ID NO: 60477 - RNA, 18 nt, Artificial Sequence
  Description of Artificial Sequence: Synthetic oligonucleotide
ccuccucacgggcauaga

SEQ ID NO: 60478 - RNA, 18 nt, Artificial Sequence
  Description of Artificial Sequence: Synthetic oligonucleotide
agccaccuccucacgggc

SEQ ID NO: 60479 - RNA, 18 nt, Artificial Sequence
  Description of Artificial Sequence: Synthetic oligonucleotide
uucagagccaccuccuca

SEQ ID NO: 60480 - RNA, 18 nt, Artificial Sequence
  Description of Artificial Sequence: Synthetic oligonucleotide
ugaucuucagagccaccu

SEQ ID NO: 60481 - RNA, 18 nt, Artificial Sequence
  Description of Artificial Sequence: Synthetic oligonucleotide
cagauugaucuucagagc

SEQ ID NO: 60482 - RNA, 18 nt, Artificial Sequence
  Description of Artificial Sequence: Synthetic oligonucleotide
ucaggcagauugaucuuc

SEQ ID NO: 60483 - RNA, 18 nt, Artificial Sequence
  Description of Artificial Sequence: Synthetic oligonucleotide
uggacucaggcagauuga

SEQ ID NO: 60484 - RNA, 18 nt, Artificial Sequence
  Description of Artificial Sequence: Synthetic oligonucleotide
aacccuggacucaggcag

SEQ ID NO: 60485 - RNA, 18 nt, Artificial Sequence
  Description of Artificial Sequence: Synthetic oligonucleotide
ccgccgcugcuuccuggg

SEQ ID NO: 60486 - RNA, 18 nt, Artificial Sequence
  Description of Artificial Sequence: Synthetic oligonucleotide
cccgccgcugcuuccugg

SEQ ID NO: 60487 - RNA, 18 nt, Artificial Sequence
  Description of Artificial Sequence: Synthetic oligonucleotide
gcgcucccgccgcugcuu

SEQ ID NO: 60488 - RNA, 18 nt, Artificial Sequence
  Description of Artificial Sequence: Synthetic oligonucleotide
guggugcgcucccgccgc

SEQ ID NO: 60489 - RNA, 18 nt, Artificial Sequence
  Description of Artificial Sequence: Synthetic oligonucleotide
ugaagguggugcgcuccc

SEQ ID NO: 60490 - RNA, 18 nt, Artificial Sequence
  Description of Artificial Sequence: Synthetic oligonucleotide
ccgggugaagguggugcg

SEQ ID NO: 60491 - RNA, 18 nt, Artificial Sequence
  Description of Artificial Sequence: Synthetic oligonucleotide
uggcuccgggugaaggug

SEQ ID NO: 60492 - RNA, 18 nt, Artificial Sequence
  Description of Artificial Sequence: Synthetic oligonucleotide
ccaguuggcuccggguga

SEQ ID NO: 60493 - RNA, 18 nt, Artificial Sequence
  Description of Artificial Sequence: Synthetic oligonucleotide
cuccuccaguuggcuccg

SEQ ID NO: 60494 - RNA, 18 nt, Artificial Sequence
  Description of Artificial Sequence: Synthetic oligonucleotide
uccagcuccuccaguugg

SEQ ID NO: 60495 - RNA, 18 nt, Artificial Sequence
  Description of Artificial Sequence: Synthetic oligonucleotide
gugccuccagcuccucca

SEQ ID NO: 60496 - RNA, 18 nt, Artificial Sequence
  Description of Artificial Sequence: Synthetic oligonucleotide
aaacagugccuccagcuc

SEQ ID NO: 60497 - RNA, 18 nt, Artificial Sequence
  Description of Artificial Sequence: Synthetic oligonucleotide
uuggcaaacagugccucc

SEQ ID NO: 60498 - RNA, 18 nt, Artificial Sequence
  Description of Artificial Sequence: Synthetic oligonucleotide
gggucuuggcaaacagug

SEQ ID NO: 60499 - RNA, 18 nt, Artificial Sequence
  Description of Artificial Sequence: Synthetic oligonucleotide
guacugggucuuggcaaa

SEQ ID NO: 60500 - RNA, 18 nt, Artificial Sequence
  Description of Artificial Sequence: Synthetic oligonucleotide
ucuggguacugggucuug

SEQ ID NO: 60501 - RNA, 18 nt, Artificial Sequence
  Description of Artificial Sequence: Synthetic oligonucleotide
agacgucuggguacuggg

SEQ ID NO: 60502 - RNA, 18 nt, Artificial Sequence
  Description of Artificial Sequence: Synthetic oligonucleotide
ggcauagacgucugggua

SEQ ID NO: 60503 - RNA, 18 nt, Artificial Sequence
  Description of Artificial Sequence: Synthetic oligonucleotide
ucacgggcauagacgucu

SEQ ID NO: 60504 - RNA, 18 nt, Artificial Sequence
  Description of Artificial Sequence: Synthetic oligonucleotide
ccuccucacgggcauaga

SEQ ID NO: 60505 - RNA, 18 nt, Artificial Sequence
  Description of Artificial Sequence: Synthetic oligonucleotide
agccaccuccucacgggc

SEQ ID NO: 60506 - RNA, 18 nt, Artificial Sequence
  Description of Artificial Sequence: Synthetic oligonucleotide
uucagagccaccuccuca

SEQ ID NO: 60507 - RNA, 18 nt, Artificial Sequence
  Description of Artificial Sequence: Synthetic oligonucleotide
ugaucuucagagccaccu

SEQ ID NO: 60508 - RNA, 18 nt, Artificial Sequence
  Description of Artificial Sequence: Synthetic oligonucleotide
cagauugaucuucagagc

SEQ ID NO: 60509 - RNA, 18 nt, Artificial Sequence
  Description of Artificial Sequence: Synthetic oligonucleotide
ucaggcagauugaucuuc

SEQ ID NO: 60510 - RNA, 18 nt, Artificial Sequence
  Description of Artificial Sequence: Synthetic oligonucleotide
uggacucaggcagauuga

SEQ ID NO: 60511 - RNA, 18 nt, Artificial Sequence
  Description of Artificial Sequence: Synthetic oligonucleotide
aacccuggacucaggcag

SEQ ID NO: 60512 - RNA, 18 nt, Artificial Sequence
  Description of Artificial Sequence: Synthetic oligonucleotide
gguccagggacccaccac

SEQ ID NO: 60513 - RNA, 18 nt, Artificial Sequence
  Description of Artificial Sequence: Synthetic oligonucleotide
ggguccagggacccacca

SEQ ID NO: 60514 - RNA, 18 nt, Artificial Sequence
  Description of Artificial Sequence: Synthetic oligonucleotide
caggaagugucgggaggg

SEQ ID NO: 60515 - RNA, 18 nt, Artificial Sequence
  Description of Artificial Sequence: Synthetic oligonucleotide
gaucacaggaagugucgg

SEQ ID NO: 60516 - RNA, 18 nt, Artificial Sequence
  Description of Artificial Sequence: Synthetic oligonucleotide
ccugagaucacaggaagu

SEQ ID NO: 60517 - RNA, 18 nt, Artificial Sequence
  Description of Artificial Sequence: Synthetic oligonucleotide
ggccuccugagaucacag

SEQ ID NO: 60518 - RNA, 18 nt, Artificial Sequence
  Description of Artificial Sequence: Synthetic oligonucleotide
gggcaggccuccugagau

SEQ ID NO: 60519 - RNA, 18 nt, Artificial Sequence
  Description of Artificial Sequence: Synthetic oligonucleotide
guuccgggcaggccuccu

SEQ ID NO: 60520 - RNA, 18 nt, Artificial Sequence
  Description of Artificial Sequence: Synthetic oligonucleotide
ucuuuguuccgggcaggc

SEQ ID NO: 60521 - RNA, 18 nt, Artificial Sequence
  Description of Artificial Sequence: Synthetic oligonucleotide
aucacucuuuguuccggg

SEQ ID NO: 60522 - RNA, 18 nt, Artificial Sequence
  Description of Artificial Sequence: Synthetic oligonucleotide
cucccaucacucuuuguu

SEQ ID NO: 60523 - RNA, 18 nt, Artificial Sequence
  Description of Artificial Sequence: Synthetic oligonucleotide
cccuccucccaucacucu

SEQ ID NO: 60524 - RNA, 18 nt, Artificial Sequence
  Description of Artificial Sequence: Synthetic oligonucleotide
ucucucccuccucccauc

SEQ ID NO: 60525 - RNA, 18 nt, Artificial Sequence
  Description of Artificial Sequence: Synthetic oligonucleotide
ugugaucucucccuccuc

SEQ ID NO: 60526 - RNA, 18 nt, Artificial Sequence
  Description of Artificial Sequence: Synthetic oligonucleotide
cacucugugaucucuccc

SEQ ID NO: 60527 - RNA, 18 nt, Artificial Sequence
  Description of Artificial Sequence: Synthetic oligonucleotide
gcugucacucugugaucu

SEQ ID NO: 60528 - RNA, 18 nt, Artificial Sequence
  Description of Artificial Sequence: Synthetic oligonucleotide
cuuuggcugucacucugu

SEQ ID NO: 60529 - RNA, 18 nt, Artificial Sequence
  Description of Artificial Sequence: Synthetic oligonucleotide
uauaacuuuggcugucac

SEQ ID NO: 60530 - RNA, 18 nt, Artificial Sequence
  Description of Artificial Sequence: Synthetic oligonucleotide
cccuuuauaacuuuggcu

SEQ ID NO: 60531 - RNA, 18 nt, Artificial Sequence
  Description of Artificial Sequence: Synthetic oligonucleotide
uuguccccuuuauaacuu

SEQ ID NO: 60532 - RNA, 18 nt, Artificial Sequence
  Description of Artificial Sequence: Synthetic oligonucleotide
gauuauuguccccuuuau

SEQ ID NO: 60533 - RNA, 18 nt, Artificial Sequence
  Description of Artificial Sequence: Synthetic oligonucleotide
agagggauuauugucccc

SEQ ID NO: 60534 - RNA, 18 nt, Artificial Sequence
  Description of Artificial Sequence: Synthetic oligonucleotide
gggagagggauuauuguc

SEQ ID NO: 60535 - RNA, 18 nt, Artificial Sequence
  Description of Artificial Sequence: Synthetic oligonucleotide
ggucagugggaugguggg

SEQ ID NO: 60536 - RNA, 18 nt, Artificial Sequence
  Description of Artificial Sequence: Synthetic oligonucleotide
gaggcggucagugggaug

SEQ ID NO: 60537 - RNA, 18 nt, Artificial Sequence
  Description of Artificial Sequence: Synthetic oligonucleotide
gccaugaggcggucagug

SEQ ID NO: 60538 - RNA, 18 nt, Artificial Sequence
  Description of Artificial Sequence: Synthetic oligonucleotide
ugagagccaugaggcggu

SEQ ID NO: 60539 - RNA, 18 nt, Artificial Sequence
  Description of Artificial Sequence: Synthetic oligonucleotide
ggcaaugagagccaugag

SEQ ID NO: 60540 - RNA, 18 nt, Artificial Sequence
  Description of Artificial Sequence: Synthetic oligonucleotide
gggcaaugagagccauga

SEQ ID NO: 60541 - RNA, 18 nt, Artificial Sequence
  Description of Artificial Sequence: Synthetic oligonucleotide
gcuggagaggagcgaggg

SEQ ID NO: 60542 - RNA, 18 nt, Artificial Sequence
  Description of Artificial Sequence: Synthetic oligonucleotide
gcgcagcuggagaggagc

SEQ ID NO: 60543 - RNA, 18 nt, Artificial Sequence
  Description of Artificial Sequence: Synthetic oligonucleotide
ggccagcgcagcuggaga

SEQ ID NO: 60544 - RNA, 18 nt, Artificial Sequence
  Description of Artificial Sequence: Synthetic oligonucleotide
gucagggccagcgcagcu

SEQ ID NO: 60545 - RNA, 18 nt, Artificial Sequence
  Description of Artificial Sequence: Synthetic oligonucleotide
ggcaggucagggccagcg

SEQ ID NO: 60546 - RNA, 18 nt, Artificial Sequence
  Description of Artificial Sequence: Synthetic oligonucleotide
uggcaggcaggucagggc

SEQ ID NO: 60547 - RNA, 18 nt, Artificial Sequence
  Description of Artificial Sequence: Synthetic oligonucleotide
gugcuuggcaggcagguc

SEQ ID NO: 60548 - RNA, 18 nt, Artificial Sequence
  Description of Artificial Sequence: Synthetic oligonucleotide
ggagggugcuuggcaggc

SEQ ID NO: 60549 - RNA, 18 nt, Artificial Sequence
  Description of Artificial Sequence: Synthetic oligonucleotide
aggcaggagggugcuugg

SEQ ID NO: 60550 - RNA, 18 nt, Artificial Sequence
  Description of Artificial Sequence: Synthetic oligonucleotide
gcccaaggcaggagggug

SEQ ID NO: 60551 - RNA, 18 nt, Artificial Sequence
  Description of Artificial Sequence: Synthetic oligonucleotide
caaaggcccaaggcagga

SEQ ID NO: 60552 - RNA, 18 nt, Artificial Sequence
  Description of Artificial Sequence: Synthetic oligonucleotide
gagugcaaaggcccaagg

SEQ ID NO: 60553 - RNA, 18 nt, Artificial Sequence
  Description of Artificial Sequence: Synthetic oligonucleotide
aaacugagugcaaaggcc

SEQ ID NO: 60554 - RNA, 18 nt, Artificial Sequence
  Description of Artificial Sequence: Synthetic oligonucleotide
agaggaaacugagugcaa

SEQ ID NO: 60555 - RNA, 18 nt, Artificial Sequence
  Description of Artificial Sequence: Synthetic oligonucleotide
cagauagaggaaacugag

SEQ ID NO: 60556 - RNA, 18 nt, Artificial Sequence
  Description of Artificial Sequence: Synthetic oligonucleotide
cauuccagauagaggaaa

SEQ ID NO: 60557 - RNA, 18 nt, Artificial Sequence
  Description of Artificial Sequence: Synthetic oligonucleotide
auaagcauuccagauaga

SEQ ID NO: 60558 - RNA, 18 nt, Artificial Sequence
  Description of Artificial Sequence: Synthetic oligonucleotide
uggaaauaagcauuccag

SEQ ID NO: 60559 - RNA, 18 nt, Artificial Sequence
  Description of Artificial Sequence: Synthetic oligonucleotide
uuaucuggaaauaagcau

SEQ ID NO: 60560 - RNA, 18 nt, Artificial Sequence
  Description of Artificial Sequence: Synthetic oligonucleotide
ugugguuaucuggaaaua

SEQ ID NO: 60561 - RNA, 18 nt, Artificial Sequence
  Description of Artificial Sequence: Synthetic oligonucleotide
ugcugugugguuaucugg

SEQ ID NO: 60562 - RNA, 18 nt, Artificial Sequence
  Description of Artificial Sequence: Synthetic oligonucleotide
gggccugcugugugguua

SEQ ID NO: 60563 - RNA, 18 nt, Artificial Sequence
  Description of Artificial Sequence: Synthetic oligonucleotide
aagacucgaacaaggcga

SEQ ID NO: 60564 - RNA, 18 nt, Artificial Sequence
  Description of Artificial Sequence: Synthetic oligonucleotide
aagcaaagacucgaacaa

SEQ ID NO: 60565 - RNA, 18 nt, Artificial Sequence
  Description of Artificial Sequence: Synthetic oligonucleotide
uggauaagcaaagacucg

SEQ ID NO: 60566 - RNA, 18 nt, Artificial Sequence
  Description of Artificial Sequence: Synthetic oligonucleotide
acugauggauaagcaaag

SEQ ID NO: 60567 - RNA, 18 nt, Artificial Sequence
  Description of Artificial Sequence: Synthetic oligonucleotide
gucucacugauggauaag

SEQ ID NO: 60568 - RNA, 18 nt, Artificial Sequence
  Description of Artificial Sequence: Synthetic oligonucleotide
ugugggucucacugaugg

SEQ ID NO: 60569 - RNA, 18 nt, Artificial Sequence
  Description of Artificial Sequence: Synthetic oligonucleotide
uucagugugggucucacu

SEQ ID NO: 60570 - RNA, 18 nt, Artificial Sequence
  Description of Artificial Sequence: Synthetic oligonucleotide
cuguguucaguguggguc

SEQ ID NO: 60571 - RNA, 18 nt, Artificial Sequence
  Description of Artificial Sequence: Synthetic oligonucleotide
aaaugcuguguucagugu

SEQ ID NO: 60572 - RNA, 18 nt, Artificial Sequence
  Description of Artificial Sequence: Synthetic oligonucleotide
auuuuaaaugcuguguuc

SEQ ID NO: 60573 - RNA, 18 nt, Artificial Sequence
  Description of Artificial Sequence: Synthetic oligonucleotide
augcaauuuuaaaugcug

SEQ ID NO: 60574 - RNA, 18 nt, Artificial Sequence
  Description of Artificial Sequence: Synthetic oligonucleotide
aucauaugcaauuuuaaa

SEQ ID NO: 60575 - RNA, 18 nt, Artificial Sequence
  Description of Artificial Sequence: Synthetic oligonucleotide
uguaaaucauaugcaauu

SEQ ID NO: 60576 - RNA, 18 nt, Artificial Sequence
  Description of Artificial Sequence: Synthetic oligonucleotide
ccauauguaaaucauaug

SEQ ID NO: 60577 - RNA, 18 nt, Artificial Sequence
  Description of Artificial Sequence: Synthetic oligonucleotide
agauaccauauguaaauc

SEQ ID NO: 60578 - RNA, 18 nt, Artificial Sequence
  Description of Artificial Sequence: Synthetic oligonucleotide
cucugagauaccauaugu

SEQ ID NO: 60579 - RNA, 18 nt, Artificial Sequence
  Description of Artificial Sequence: Synthetic oligonucleotide
acagacucugagauacca

SEQ ID NO: 60580 - RNA, 18 nt, Artificial Sequence
  Description of Artificial Sequence: Synthetic oligonucleotide
aauaaacagacucugaga

SEQ ID NO: 60581 - RNA, 18 nt, Artificial Sequence
  Description of Artificial Sequence: Synthetic oligonucleotide
gucuaaauaaacagacuc

SEQ ID NO: 60582 - RNA, 18 nt, Artificial Sequence
  Description of Artificial Sequence: Synthetic oligonucleotide
acagagucuaaauaaaca

SEQ ID NO: 60583 - RNA, 18 nt, Artificial Sequence
  Description of Artificial Sequence: Synthetic oligonucleotide
gagagacagagucuaaau

SEQ ID NO: 60584 - RNA, 18 nt, Artificial Sequence
  Description of Artificial Sequence: Synthetic oligonucleotide
guugggagagacagaguc

SEQ ID NO: 60585 - RNA, 18 nt, Artificial Sequence
  Description of Artificial Sequence: Synthetic oligonucleotide
uucuaguugggagagaca

SEQ ID NO: 60586 - RNA, 18 nt, Artificial Sequence
  Description of Artificial Sequence: Synthetic oligonucleotide
ugacauucuaguugggag

SEQ ID NO: 60587 - RNA, 18 nt, Artificial Sequence
  Description of Artificial Sequence: Synthetic oligonucleotide
ggaauugacauucuaguu

SEQ ID NO: 60588 - RNA, 18 nt, Artificial Sequence
  Description of Artificial Sequence: Synthetic oligonucleotide
ucaguggaauugacauuc

SEQ ID NO: 60589 - RNA, 18 nt, Artificial Sequence
  Description of Artificial Sequence: Synthetic oligonucleotide
guccgucaguggaauuga

SEQ ID NO: 60590 - RNA, 18 nt, Artificial Sequence
  Description of Artificial Sequence: Synthetic oligonucleotide
ugaguguccgucagugga

SEQ ID NO: 60591 - RNA, 18 nt, Artificial Sequence
  Description of Artificial Sequence: Synthetic oligonucleotide
uacucugaguguccguca

SEQ ID NO: 60592 - RNA, 18 nt, Artificial Sequence
  Description of Artificial Sequence: Synthetic oligonucleotide
ucuacuacucugaguguc

SEQ ID NO: 60593 - RNA, 18 nt, Artificial Sequence
  Description of Artificial Sequence: Synthetic oligonucleotide
cauuuucuacuacucuga

SEQ ID NO: 60594 - RNA, 18 nt, Artificial Sequence
  Description of Artificial Sequence: Synthetic oligonucleotide
uuaaccauuuucuacuac

SEQ ID NO: 60595 - RNA, 18 nt, Artificial Sequence
  Description of Artificial Sequence: Synthetic oligonucleotide
auguauuaaccauuuucu

SEQ ID NO: 60596 - RNA, 18 nt, Artificial Sequence
  Description of Artificial Sequence: Synthetic oligonucleotide
uaaacauguauuaaccau

SEQ ID NO: 60597 - RNA, 18 nt, Artificial Sequence
  Description of Artificial Sequence: Synthetic oligonucleotide
guuaauaaacauguauua

SEQ ID NO: 60598 - RNA, 18 nt, Artificial Sequence
  Description of Artificial Sequence: Synthetic oligonucleotide
agucaguuaauaaacaug

SEQ ID NO: 60599 - RNA, 18 nt, Artificial Sequence
  Description of Artificial Sequence: Synthetic oligonucleotide
uauucagucaguuaauaa

SEQ ID NO: 60600 - RNA, 18 nt, Artificial Sequence
  Description of Artificial Sequence: Synthetic oligonucleotide
ccgucuauucagucaguu

SEQ ID NO: 60601 - RNA, 18 nt, Artificial Sequence
  Description of Artificial Sequence: Synthetic oligonucleotide
uccauccgucuauucagu

SEQ ID NO: 60602 - RNA, 18 nt, Artificial Sequence
  Description of Artificial Sequence: Synthetic oligonucleotide
auccauccauccgucuau

SEQ ID NO: 60603 - RNA, 18 nt, Artificial Sequence
  Description of Artificial Sequence: Synthetic oligonucleotide
cacccauccauccauccg

SEQ ID NO: 60604 - RNA, 18 nt, Artificial Sequence
  Description of Artificial Sequence: Synthetic oligonucleotide
auacauacauacaccaua

SEQ ID NO: 60605 - RNA, 18 nt, Artificial Sequence
  Description of Artificial Sequence: Synthetic oligonucleotide
caauuauacauacauaca

SEQ ID NO: 60606 - RNA, 18 nt, Artificial Sequence
  Description of Artificial Sequence: Synthetic oligonucleotide
acauacaauuauacauac

SEQ ID NO: 60607 - RNA, 18 nt, Artificial Sequence
  Description of Artificial Sequence: Synthetic oligonucleotide
ugcacacauacaauuaua

SEQ ID NO: 60608 - RNA, 18 nt, Artificial Sequence
  Description of Artificial Sequence: Synthetic oligonucleotide
aaacaugcacacauacaa

SEQ ID NO: 60609 - RNA, 18 nt, Artificial Sequence
  Description of Artificial Sequence: Synthetic oligonucleotide
aauacaaacaugcacaca

SEQ ID NO: 60610 - RNA, 18 nt, Artificial Sequence
  Description of Artificial Sequence: Synthetic oligonucleotide
caucuaauacaaacaugc

SEQ ID NO: 60611 - RNA, 18 nt, Artificial Sequence
  Description of Artificial Sequence: Synthetic oligonucleotide
ccauccaucuaauacaaa

SEQ ID NO: 60612 - RNA, 18 nt, Artificial Sequence
  Description of Artificial Sequence: Synthetic oligonucleotide
uucauccauccaucuaau

SEQ ID NO: 60613 - RNA, 18 nt, Artificial Sequence
  Description of Artificial Sequence: Synthetic oligonucleotide
acauuuucauccauccau

SEQ ID NO: 60614 - RNA, 18 nt, Artificial Sequence
  Description of Artificial Sequence: Synthetic oligonucleotide
cauacacauuuucaucca

SEQ ID NO: 60615 - RNA, 18 nt, Artificial Sequence
  Description of Artificial Sequence: Synthetic oligonucleotide
uacaucauacacauuuuc

SEQ ID NO: 60616 - RNA, 18 nt, Artificial Sequence
  Description of Artificial Sequence: Synthetic oligonucleotide
auacguacaucauacaca

SEQ ID NO: 60617 - RNA, 18 nt, Artificial Sequence
  Description of Artificial Sequence: Synthetic oligonucleotide
ugaucauacguacaucau

SEQ ID NO: 60618 - RNA, 18 nt, Artificial Sequence
  Description of Artificial Sequence: Synthetic oligonucleotide
cuauaugaucauacguac

SEQ ID NO: 60619 - RNA, 18 nt, Artificial Sequence
  Description of Artificial Sequence: Synthetic oligonucleotide
cccaucuauaugaucaua

SEQ ID NO: 60620 - RNA, 18 nt, Artificial Sequence
  Description of Artificial Sequence: Synthetic oligonucleotide
auuuacccaucuauauga

SEQ ID NO: 60621 - RNA, 18 nt, Artificial Sequence
  Description of Artificial Sequence: Synthetic oligonucleotide
cauacauuuacccaucua

SEQ ID NO: 60622 - RNA, 18 nt, Artificial Sequence
  Description of Artificial Sequence: Synthetic oligonucleotide
ucaugcauacauuuaccc

SEQ ID NO: 60623 - RNA, 18 nt, Artificial Sequence
  Description of Artificial Sequence: Synthetic oligonucleotide
auauaucaugcauacauu

SEQ ID NO: 60624 - RNA, 18 nt, Artificial Sequence
  Description of Artificial Sequence: Synthetic oligonucleotide
cgcacauauaucaugcau

SEQ ID NO: 60625 - RNA, 18 nt, Artificial Sequence
  Description of Artificial Sequence: Synthetic oligonucleotide
ccauacgcacauauauca

SEQ ID NO: 60626 - RNA, 18 nt, Artificial Sequence
  Description of Artificial Sequence: Synthetic oligonucleotide
auacaccauacgcacaua

SEQ ID NO: 60627 - RNA, 18 nt, Artificial Sequence
  Description of Artificial Sequence: Synthetic oligonucleotide
cauauauacaccauacgc

SEQ ID NO: 60628 - RNA, 18 nt, Artificial Sequence
  Description of Artificial Sequence: Synthetic oligonucleotide
uuauacauauauacacca

SEQ ID NO: 60629 - RNA, 18 nt, Artificial Sequence
  Description of Artificial Sequence: Synthetic oligonucleotide
uacaguuauacauauaua

SEQ ID NO: 60630 - RNA, 18 nt, Artificial Sequence
  Description of Artificial Sequence: Synthetic oligonucleotide
acacguacaguuauacau

SEQ ID NO: 60631 - RNA, 18 nt, Artificial Sequence
  Description of Artificial Sequence: Synthetic oligonucleotide
caugcacacguacaguua

SEQ ID NO: 60632 - RNA, 18 nt, Artificial Sequence
  Description of Artificial Sequence: Synthetic oligonucleotide
acaaacaugcacacguac

SEQ ID NO: 60633 - RNA, 18 nt, Artificial Sequence
  Description of Artificial Sequence: Synthetic oligonucleotide
cuaauacaaacaugcaca

SEQ ID NO: 60634 - RNA, 18 nt, Artificial Sequence
  Description of Artificial Sequence: Synthetic oligonucleotide
cccaucuaauacaaacau

SEQ ID NO: 60635 - RNA, 18 nt, Artificial Sequence
  Description of Artificial Sequence: Synthetic oligonucleotide
auccacccaucuaauaca

SEQ ID NO: 60636 - RNA, 18 nt, Artificial Sequence
  Description of Artificial Sequence: Synthetic oligonucleotide
uauucauccacccaucua

SEQ ID NO: 60637 - RNA, 18 nt, Artificial Sequence
  Description of Artificial Sequence: Synthetic oligonucleotide
acacauauucauccaccc

SEQ ID NO: 60638 - RNA, 18 nt, Artificial Sequence
  Description of Artificial Sequence: Synthetic oligonucleotide
aucauacacauauucauc

SEQ ID NO: 60639 - RNA, 18 nt, Artificial Sequence
  Description of Artificial Sequence: Synthetic oligonucleotide
cauacaucauacacauau

SEQ ID NO: 60640 - RNA, 18 nt, Artificial Sequence
  Description of Artificial Sequence: Synthetic oligonucleotide
ucauacauacaucauaca

SEQ ID NO: 60641 - RNA, 18 nt, Artificial Sequence
  Description of Artificial Sequence: Synthetic oligonucleotide
uaugaucauacauacauc

SEQ ID NO: 60642 - RNA, 18 nt, Artificial Sequence
  Description of Artificial Sequence: Synthetic oligonucleotide
aucgauaugaucauacau

SEQ ID NO: 60643 - RNA, 18 nt, Artificial Sequence
  Description of Artificial Sequence: Synthetic oligonucleotide
uacccaucgauaugauca

SEQ ID NO: 60644 - RNA, 18 nt, Artificial Sequence
  Description of Artificial Sequence: Synthetic oligonucleotide
gcauuuacccaucgauau

SEQ ID NO: 60645 - RNA, 18 nt, Artificial Sequence
  Description of Artificial Sequence: Synthetic oligonucleotide
ugccugcauuuacccauc

SEQ ID NO: 60646 - RNA, 18 nt, Artificial Sequence
  Description of Artificial Sequence: Synthetic oligonucleotide
caucaugccugcauuuac

SEQ ID NO: 60647 - RNA, 18 nt, Artificial Sequence
  Description of Artificial Sequence: Synthetic oligonucleotide
acauacaucaugccugca

SEQ ID NO: 60648 - RNA, 18 nt, Artificial Sequence
  Description of Artificial Sequence: Synthetic oligonucleotide
uacgcacauacaucaugc

SEQ ID NO: 60649 - RNA, 18 nt, Artificial Sequence
  Description of Artificial Sequence: Synthetic oligonucleotide
caccauacgcacauacau

SEQ ID NO: 60650 - RNA, 18 nt, Artificial Sequence
  Description of Artificial Sequence: Synthetic oligonucleotide
gcauacaccauacgcaca

SEQ ID NO: 60651 - RNA, 18 nt, Artificial Sequence
  Description of Artificial Sequence: Synthetic oligonucleotide
uacaugcauacaccauac

SEQ ID NO: 60652 - RNA, 18 nt, Artificial Sequence
  Description of Artificial Sequence: Synthetic oligonucleotide
aauuauacaugcauacac

SEQ ID NO: 60653 - RNA, 18 nt, Artificial Sequence
  Description of Artificial Sequence: Synthetic oligonucleotide
cguacaauuauacaugca

SEQ ID NO: 60654 - RNA, 18 nt, Artificial Sequence
  Description of Artificial Sequence: Synthetic oligonucleotide
gcacacguacaauuauac

SEQ ID NO: 60655 - RNA, 18 nt, Artificial Sequence
  Description of Artificial Sequence: Synthetic oligonucleotide
aacaugcacacguacaau

SEQ ID NO: 60656 - RNA, 18 nt, Artificial Sequence
  Description of Artificial Sequence: Synthetic oligonucleotide
augcaaacaugcacacgu

SEQ ID NO: 60657 - RNA, 18 nt, Artificial Sequence
  Description of Artificial Sequence: Synthetic oligonucleotide
gucuaaugcaaacaugca

SEQ ID NO: 60658 - RNA, 18 nt, Artificial Sequence
  Description of Artificial Sequence: Synthetic oligonucleotide
cauccgucuaaugcaaac

SEQ ID NO: 60659 - RNA, 18 nt, Artificial Sequence
  Description of Artificial Sequence: Synthetic oligonucleotide
caucccauccgucuaaug

SEQ ID NO: 60660 - RNA, 18 nt, Artificial Sequence
  Description of Artificial Sequence: Synthetic oligonucleotide
gcauucaucccauccguc

SEQ ID NO: 60661 - RNA, 18 nt, Artificial Sequence
  Description of Artificial Sequence: Synthetic oligonucleotide
caugugcauucaucccau

SEQ ID NO: 60662 - RNA, 18 nt, Artificial Sequence
  Description of Artificial Sequence: Synthetic oligonucleotide
auacccaugugcauucau

SEQ ID NO: 60663 - RNA, 18 nt, Artificial Sequence
  Description of Artificial Sequence: Synthetic oligonucleotide
acaucauacccaugugca

SEQ ID NO: 60664 - RNA, 18 nt, Artificial Sequence
  Description of Artificial Sequence: Synthetic oligonucleotide
ugcauacaucauacccau

SEQ ID NO: 60665 - RNA, 18 nt, Artificial Sequence
  Description of Artificial Sequence: Synthetic oligonucleotide
acacaugcauacaucaua

SEQ ID NO: 60666 - RNA, 18 nt, Artificial Sequence
  Description of Artificial Sequence: Synthetic oligonucleotide
caugaacacaugcauaca

SEQ ID NO: 60667 - RNA, 18 nt, Artificial Sequence
  Description of Artificial Sequence: Synthetic oligonucleotide
gugugcaugaacacaugc

SEQ ID NO: 60668 - RNA, 18 nt, Artificial Sequence
  Description of Artificial Sequence: Synthetic oligonucleotide
ugcaugugugcaugaaca

SEQ ID NO: 60669 - RNA, 18 nt, Artificial Sequence
  Description of Artificial Sequence: Synthetic oligonucleotide
auaccugcaugugugcau

SEQ ID NO: 60670 - RNA, 18 nt, Artificial Sequence
  Description of Artificial Sequence: Synthetic oligonucleotide
caaucauaccugcaugug

SEQ ID NO: 60671 - RNA, 18 nt, Artificial Sequence
  Description of Artificial Sequence: Synthetic oligonucleotide
ccauccaaucauaccugc

SEQ ID NO: 60672 - RNA, 18 nt, Artificial Sequence
  Description of Artificial Sequence: Synthetic oligonucleotide
ucuauccauccaaucaua

SEQ ID NO: 60673 - RNA, 18 nt, Artificial Sequence
  Description of Artificial Sequence: Synthetic oligonucleotide
auccaucuauccauccaa

SEQ ID NO: 60674 - RNA, 18 nt, Artificial Sequence
  Description of Artificial Sequence: Synthetic oligonucleotide
cauccauccaucuaucca

SEQ ID NO: 60675 - RNA, 18 nt, Artificial Sequence
  Description of Artificial Sequence: Synthetic oligonucleotide
ucacccauccauccaucu

SEQ ID NO: 60676 - RNA, 18 nt, Artificial Sequence
  Description of Artificial Sequence: Synthetic oligonucleotide
ucuauucacccauccauc

SEQ ID NO: 60677 - RNA, 18 nt, Artificial Sequence
  Description of Artificial Sequence: Synthetic oligonucleotide
gggcgucuauucacccau

SEQ ID NO: 60678 - RNA, 18 nt, Artificial Sequence
  Description of Artificial Sequence: Synthetic oligonucleotide
uuugcauccagcuguggg

SEQ ID NO: 60679 - RNA, 18 nt, Artificial Sequence
  Description of Artificial Sequence: Synthetic oligonucleotide
cuacuuugcauccagcug

SEQ ID NO: 60680 - RNA, 18 nt, Artificial Sequence
  Description of Artificial Sequence: Synthetic oligonucleotide
ucugucuacuuugcaucc

SEQ ID NO: 60681 - RNA, 18 nt, Artificial Sequence
  Description of Artificial Sequence: Synthetic oligonucleotide
ucacaucugucuacuuug

SEQ ID NO: 60682 - RNA, 18 nt, Artificial Sequence
  Description of Artificial Sequence: Synthetic oligonucleotide
uggguucacaucugucua

SEQ ID NO: 60683 - RNA, 18 nt, Artificial Sequence
  Description of Artificial Sequence: Synthetic oligonucleotide
ggugcuggguucacaucu

SEQ ID NO: 60684 - RNA, 18 nt, Artificial Sequence
  Description of Artificial Sequence: Synthetic oligonucleotide
ugagaggugcuggguuca

SEQ ID NO: 60685 - RNA, 18 nt, Artificial Sequence
  Description of Artificial Sequence: Synthetic oligonucleotide
auuggugagaggugcugg

SEQ ID NO: 60686 - RNA, 18 nt, Artificial Sequence
  Description of Artificial Sequence: Synthetic oligonucleotide
cacuuauuggugagaggu

SEQ ID NO: 60687 - RNA, 18 nt, Artificial Sequence
  Description of Artificial Sequence: Synthetic oligonucleotide
gaggacacuuauugguga

SEQ ID NO: 60688 - RNA, 18 nt, Artificial Sequence
  Description of Artificial Sequence: Synthetic oligonucleotide
gggaugaggacacuuauu

SEQ ID NO: 60689 - RNA, 18 nt, Artificial Sequence
  Description of Artificial Sequence: Synthetic oligonucleotide
agccgcagggugcccggg

SEQ ID NO: 60690 - RNA, 18 nt, Artificial Sequence
  Description of Artificial Sequence: Synthetic oligonucleotide
gagagccgcagggugccc

SEQ ID NO: 60691 - RNA, 18 nt, Artificial Sequence
  Description of Artificial Sequence: Synthetic oligonucleotide
cccaggagagccgcaggg

SEQ ID NO: 60692 - RNA, 18 nt, Artificial Sequence
  Description of Artificial Sequence: Synthetic oligonucleotide
agaggcccaggagagccg

SEQ ID NO: 60693 - RNA, 18 nt, Artificial Sequence
  Description of Artificial Sequence: Synthetic oligonucleotide
uccgguucuugaaccaaa

SEQ ID NO: 60694 - RNA, 18 nt, Artificial Sequence
  Description of Artificial Sequence: Synthetic oligonucleotide
agcccuccgguucuugaa

SEQ ID NO: 60695 - RNA, 18 nt, Artificial Sequence
  Description of Artificial Sequence: Synthetic oligonucleotide
cauuuagcccuccgguuc

SEQ ID NO: 60696 - RNA, 18 nt, Artificial Sequence
  Description of Artificial Sequence: Synthetic oligonucleotide
gccugcauuuagcccucc

SEQ ID NO: 60697 - RNA, 18 nt, Artificial Sequence
  Description of Artificial Sequence: Synthetic oligonucleotide
cugcugccugcauuuagc

SEQ ID NO: 60698 - RNA, 18 nt, Artificial Sequence
  Description of Artificial Sequence: Synthetic oligonucleotide
ugucgcugcugccugcau

SEQ ID NO: 60699 - RNA, 18 nt, Artificial Sequence
  Description of Artificial Sequence: Synthetic oligonucleotide
gcugcugucgcugcugcc

SEQ ID NO: 60700 - RNA, 18 nt, Artificial Sequence
  Description of Artificial Sequence: Synthetic oligonucleotide
uuucugcugcugucgcug

SEQ ID NO: 60701 - RNA, 18 nt, Artificial Sequence
  Description of Artificial Sequence: Synthetic oligonucleotide
ugcuguuucugcugcugu

SEQ ID NO: 60702 - RNA, 18 nt, Artificial Sequence
  Description of Artificial Sequence: Synthetic oligonucleotide
gcugcugcuguuucugcu

SEQ ID NO: 60703 - RNA, 18 nt, Artificial Sequence
  Description of Artificial Sequence: Synthetic oligonucleotide
gggcugcugcugcuguuu

SEQ ID NO: 60704 - RNA, 18 nt, Artificial Sequence
  Description of Artificial Sequence: Synthetic oligonucleotide
gccuuggccuggcccccu

SEQ ID NO: 60705 - RNA, 18 nt, Artificial Sequence
  Description of Artificial Sequence: Synthetic oligonucleotide
gccgggccuuggccuggc

SEQ ID NO: 60706 - RNA, 18 nt, Artificial Sequence
  Description of Artificial Sequence: Synthetic oligonucleotide
ggcaggccgggccuuggc

SEQ ID NO: 60707 - RNA, 18 nt, Artificial Sequence
  Description of Artificial Sequence: Synthetic oligonucleotide
cucuuggcaggccgggcc

SEQ ID NO: 60708 - RNA, 18 nt, Artificial Sequence
  Description of Artificial Sequence: Synthetic oligonucleotide
ccuuccucuuggcaggcc

SEQ ID NO: 60709 - RNA, 18 nt, Artificial Sequence
  Description of Artificial Sequence: Synthetic oligonucleotide
gcccgccuuccucuuggc

SEQ ID NO: 60710 - RNA, 18 nt, Artificial Sequence
  Description of Artificial Sequence: Synthetic oligonucleotide
gacgugcccgccuuccuc

SEQ ID NO: 60711 - RNA, 18 nt, Artificial Sequence
  Description of Artificial Sequence: Synthetic oligonucleotide
gggacgugcccgccuucc

SEQ ID NO: 60712 - RNA, 18 nt, Artificial Sequence
  Description of Artificial Sequence: Synthetic oligonucleotide
ucuguggagggucuuggg

SEQ ID NO: 60713 - RNA, 18 nt, Artificial Sequence
  Description of Artificial Sequence: Synthetic oligonucleotide
acacaucuguggaggguc

SEQ ID NO: 60714 - RNA, 18 nt, Artificial Sequence
  Description of Artificial Sequence: Synthetic oligonucleotide
uggacacacaucugugga

SEQ ID NO: 60715 - RNA, 18 nt, Artificial Sequence
  Description of Artificial Sequence: Synthetic oligonucleotide
gggucuggacacacaucu

SEQ ID NO: 60716 - RNA, 18 nt, Artificial Sequence
  Description of Artificial Sequence: Synthetic oligonucleotide
ccagagggucuggacaca

SEQ ID NO: 60717 - RNA, 18 nt, Artificial Sequence
  Description of Artificial Sequence: Synthetic oligonucleotide
gaugcccagagggucugg

SEQ ID NO: 60718 - RNA, 18 nt, Artificial Sequence
  Description of Artificial Sequence: Synthetic oligonucleotide
ucugagaugcccagaggg

SEQ ID NO: 60719 - RNA, 18 nt, Artificial Sequence
  Description of Artificial Sequence: Synthetic oligonucleotide
aggaaucugagaugccca

SEQ ID NO: 60720 - RNA, 18 nt, Artificial Sequence
  Description of Artificial Sequence: Synthetic oligonucleotide
acuguaggaaucugagau

SEQ ID NO: 60721 - RNA, 18 nt, Artificial Sequence
  Description of Artificial Sequence: Synthetic oligonucleotide
gggacuguaggaaucuga

SEQ ID NO: 60722 - RNA, 18 nt, Artificial Sequence
  Description of Artificial Sequence: Synthetic oligonucleotide
gccacugccgugguuggg

SEQ ID NO: 60723 - RNA, 18 nt, Artificial Sequence
  Description of Artificial Sequence: Synthetic oligonucleotide
caguggccacugccgugg

SEQ ID NO: 60724 - RNA, 18 nt, Artificial Sequence
  Description of Artificial Sequence: Synthetic oligonucleotide
ggacacaguggccacugc

SEQ ID NO: 60725 - RNA, 18 nt, Artificial Sequence
  Description of Artificial Sequence: Synthetic oligonucleotide
cagauggacacaguggcc

SEQ ID NO: 60726 - RNA, 18 nt, Artificial Sequence
  Description of Artificial Sequence: Synthetic oligonucleotide
ggcuccagauggacacag

SEQ ID NO: 60727 - RNA, 18 nt, Artificial Sequence
  Description of Artificial Sequence: Synthetic oligonucleotide
ggcugggcuccagaugga

SEQ ID NO: 60728 - RNA, 18 nt, Artificial Sequence
  Description of Artificial Sequence: Synthetic oligonucleotide
ucugaggcugggcuccag

SEQ ID NO: 60729 - RNA, 18 nt, Artificial Sequence
  Description of Artificial Sequence: Synthetic oligonucleotide
gggacucugaggcugggc

SEQ ID NO: 60730 - RNA, 18 nt, Artificial Sequence
  Description of Artificial Sequence: Synthetic oligonucleotide
ccgcugcgccucaggcaa

SEQ ID NO: 60731 - RNA, 18 nt, Artificial Sequence
  Description of Artificial Sequence: Synthetic oligonucleotide
ccagcccgcugcgccuca

SEQ ID NO: 60732 - RNA, 18 nt, Artificial Sequence
  Description of Artificial Sequence: Synthetic oligonucleotide
ccagcccagcccgcugcg

SEQ ID NO: 60733 - RNA, 18 nt, Artificial Sequence
  Description of Artificial Sequence: Synthetic oligonucleotide
ggccaccagcccagcccg

SEQ ID NO: 60734 - RNA, 18 nt, Artificial Sequence
  Description of Artificial Sequence: Synthetic oligonucleotide
ccugaggccaccagccca

SEQ ID NO: 60735 - RNA, 18 nt, Artificial Sequence
  Description of Artificial Sequence: Synthetic oligonucleotide
acggcccugaggccacca

SEQ ID NO: 60736 - RNA, 18 nt, Artificial Sequence
  Description of Artificial Sequence: Synthetic oligonucleotide
cagagacggcccugaggc

SEQ ID NO: 60737 - RNA, 18 nt, Artificial Sequence
  Description of Artificial Sequence: Synthetic oligonucleotide
gaggucagagacggcccu

SEQ ID NO: 60738 - RNA, 18 nt, Artificial Sequence
  Description of Artificial Sequence: Synthetic oligonucleotide
gggcggaggucagagacg

SEQ ID NO: 60739 - RNA, 18 nt, Artificial Sequence
  Description of Artificial Sequence: Synthetic oligonucleotide
ggcguaggucauggcaua

SEQ ID NO: 60740 - RNA, 18 nt, Artificial Sequence
  Description of Artificial Sequence: Synthetic oligonucleotide
gggcguaggucauggcau

SEQ ID NO: 60741 - RNA, 18 nt, Artificial Sequence
  Description of Artificial Sequence: Synthetic oligonucleotide
cagaaagcggaggccggg

SEQ ID NO: 60742 - RNA, 18 nt, Artificial Sequence
  Description of Artificial Sequence: Synthetic oligonucleotide
aagagcagaaagcggagg

SEQ ID NO: 60743 - RNA, 18 nt, Artificial Sequence
  Description of Artificial Sequence: Synthetic oligonucleotide
gggaagagcagaaagcgg

SEQ ID NO: 60744 - RNA, 18 nt, Artificial Sequence
  Description of Artificial Sequence: Synthetic oligonucleotide
agacccauaggcggaggg

SEQ ID NO: 60745 - RNA, 18 nt, Artificial Sequence
  Description of Artificial Sequence: Synthetic oligonucleotide
cucggagacccauaggcg

SEQ ID NO: 60746 - RNA, 18 nt, Artificial Sequence
  Description of Artificial Sequence: Synthetic oligonucleotide
aggagcucggagacccau

SEQ ID NO: 60747 - RNA, 18 nt, Artificial Sequence
  Description of Artificial Sequence: Synthetic oligonucleotide
gaaauaggagcucggaga

SEQ ID NO: 60748 - RNA, 18 nt, Artificial Sequence
  Description of Artificial Sequence: Synthetic oligonucleotide
ccgcugaaauaggagcuc

SEQ ID NO: 60749 - RNA, 18 nt, Artificial Sequence
  Description of Artificial Sequence: Synthetic oligonucleotide
cuaggccgcugaaauagg

SEQ ID NO: 60750 - RNA, 18 nt, Artificial Sequence
  Description of Artificial Sequence: Synthetic oligonucleotide
gggucuaggccgcugaaa

SEQ ID NO: 60751 - RNA, 18 nt, Artificial Sequence
  Description of Artificial Sequence: Synthetic oligonucleotide
caugggagaaagguaggg

SEQ ID NO: 60752 - RNA, 18 nt, Artificial Sequence
  Description of Artificial Sequence: Synthetic oligonucleotide
ggcaccaugggagaaagg

SEQ ID NO: 60753 - RNA, 18 nt, Artificial Sequence
  Description of Artificial Sequence: Synthetic oligonucleotide
gggcaccaugggagaaag

SEQ ID NO: 60754 - RNA, 18 nt, Artificial Sequence
  Description of Artificial Sequence: Synthetic oligonucleotide
ccgggcccccuagcuggg

SEQ ID NO: 60755 - RNA, 18 nt, Artificial Sequence
  Description of Artificial Sequence: Synthetic oligonucleotide
aagagccgggcccccuag

SEQ ID NO: 60756 - RNA, 18 nt, Artificial Sequence
  Description of Artificial Sequence: Synthetic oligonucleotide
gggcuaagagccgggccc

SEQ ID NO: 60757 - RNA, 18 nt, Artificial Sequence
  Description of Artificial Sequence: Synthetic oligonucleotide
agggaaggucccacggag

SEQ ID NO: 60758 - RNA, 18 nt, Artificial Sequence
  Description of Artificial Sequence: Synthetic oligonucleotide
gggccagggaagguccca

SEQ ID NO: 60759 - RNA, 18 nt, Artificial Sequence
  Description of Artificial Sequence: Synthetic oligonucleotide
ggacugggccagggaagg

SEQ ID NO: 60760 - RNA, 18 nt, Artificial Sequence
  Description of Artificial Sequence: Synthetic oligonucleotide
gggacugggccagggaag

SEQ ID NO: 60761 - RNA, 18 nt, Artificial Sequence
  Description of Artificial Sequence: Synthetic oligonucleotide
gccugauagggagguggg

SEQ ID NO: 60762 - RNA, 18 nt, Artificial Sequence
  Description of Artificial Sequence: Synthetic oligonucleotide
cucuggccugauagggag

SEQ ID NO: 60763 - RNA, 18 nt, Artificial Sequence
  Description of Artificial Sequence: Synthetic oligonucleotide
cauagcucuggccugaua

SEQ ID NO: 60764 - RNA, 18 nt, Artificial Sequence
  Description of Artificial Sequence: Synthetic oligonucleotide
ggcgccauagcucuggcc

SEQ ID NO: 60765 - RNA, 18 nt, Artificial Sequence
  Description of Artificial Sequence: Synthetic oligonucleotide
cuguaggcgccauagcuc

SEQ ID NO: 60766 - RNA, 18 nt, Artificial Sequence
  Description of Artificial Sequence: Synthetic oligonucleotide
gggcuguaggcgccauag

SEQ ID NO: 60767 - RNA, 18 nt, Artificial Sequence
  Description of Artificial Sequence: Synthetic oligonucleotide
uuccaagcuauccacggg

SEQ ID NO: 60768 - RNA, 18 nt, Artificial Sequence
  Description of Artificial Sequence: Synthetic oligonucleotide
uugaauuccaagcuaucc

SEQ ID NO: 60769 - RNA, 18 nt, Artificial Sequence
  Description of Artificial Sequence: Synthetic oligonucleotide
gguccuugaauuccaagc

SEQ ID NO: 60770 - RNA, 18 nt, Artificial Sequence
  Description of Artificial Sequence: Synthetic oligonucleotide
ggguccuugaauuccaag

SEQ ID NO: 60771 - RNA, 18 nt, Artificial Sequence
  Description of Artificial Sequence: Synthetic oligonucleotide
uuuccaggugcccguggg

SEQ ID NO: 60772 - RNA, 18 nt, Artificial Sequence
  Description of Artificial Sequence: Synthetic oligonucleotide
gugaauuuccaggugccc

SEQ ID NO: 60773 - RNA, 18 nt, Artificial Sequence
  Description of Artificial Sequence: Synthetic oligonucleotide
uguaggugaauuuccagg

SEQ ID NO: 60774 - RNA, 18 nt, Artificial Sequence
  Description of Artificial Sequence: Synthetic oligonucleotide
gggauuguaggugaauuu

SEQ ID NO: 60775 - RNA, 18 nt, Artificial Sequence
  Description of Artificial Sequence: Synthetic oligonucleotide
uccaugggauuguaggug

SEQ ID NO: 60776 - RNA, 18 nt, Artificial Sequence
  Description of Artificial Sequence: Synthetic oligonucleotide
gaggguccaugggauugu

SEQ ID NO: 60777 - RNA, 18 nt, Artificial Sequence
  Description of Artificial Sequence: Synthetic oligonucleotide
guccagaggguccauggg

SEQ ID NO: 60778 - RNA, 18 nt, Artificial Sequence
  Description of Artificial Sequence: Synthetic oligonucleotide
uuguaguccagagggucc

SEQ ID NO: 60779 - RNA, 18 nt, Artificial Sequence
  Description of Artificial Sequence: Synthetic oligonucleotide
gauccuuguaguccagag

SEQ ID NO: 60780 - RNA, 18 nt, Artificial Sequence
  Description of Artificial Sequence: Synthetic oligonucleotide
acucugauccuuguaguc

SEQ ID NO: 60781 - RNA, 18 nt, Artificial Sequence
  Description of Artificial Sequence: Synthetic oligonucleotide
caggcacucugauccuug

SEQ ID NO: 60782 - RNA, 18 nt, Artificial Sequence
  Description of Artificial Sequence: Synthetic oligonucleotide
acuuccaggcacucugau

SEQ ID NO: 60783 - RNA, 18 nt, Artificial Sequence
  Description of Artificial Sequence: Synthetic oligonucleotide
cugaaacuuccaggcacu

SEQ ID NO: 60784 - RNA, 18 nt, Artificial Sequence
  Description of Artificial Sequence: Synthetic oligonucleotide
aagaucugaaacuuccag

SEQ ID NO: 60785 - RNA, 18 nt, Artificial Sequence
  Description of Artificial Sequence: Synthetic oligonucleotide
ucuacaagaucugaaacu

SEQ ID NO: 60786 - RNA, 18 nt, Artificial Sequence
  Description of Artificial Sequence: Synthetic oligonucleotide
cguccucuacaagaucug

SEQ ID NO: 60787 - RNA, 18 nt, Artificial Sequence
  Description of Artificial Sequence: Synthetic oligonucleotide
gacugcguccucuacaag

SEQ ID NO: 60788 - RNA, 18 nt, Artificial Sequence
  Description of Artificial Sequence: Synthetic oligonucleotide
auggagacugcguccucu

SEQ ID NO: 60789 - RNA, 18 nt, Artificial Sequence
  Description of Artificial Sequence: Synthetic oligonucleotide
gagagauggagacugcgu

SEQ ID NO: 60790 - RNA, 18 nt, Artificial Sequence
  Description of Artificial Sequence: Synthetic oligonucleotide
auggagagagauggagac

SEQ ID NO: 60791 - RNA, 18 nt, Artificial Sequence
  Description of Artificial Sequence: Synthetic oligonucleotide
gcccgauggagagagaug

SEQ ID NO: 60792 - RNA, 18 nt, Artificial Sequence
  Description of Artificial Sequence: Synthetic oligonucleotide
ccgaggcccgauggagag

SEQ ID NO: 60793 - RNA, 18 nt, Artificial Sequence
  Description of Artificial Sequence: Synthetic oligonucleotide
gggucccgaggcccgaug

SEQ ID NO: 60794 - RNA, 18 nt, Artificial Sequence
  Description of Artificial Sequence: Synthetic oligonucleotide
agaaagggucccgaggcc

SEQ ID NO: 60795 - RNA, 18 nt, Artificial Sequence
  Description of Artificial Sequence: Synthetic oligonucleotide
agaagagaaagggucccg

SEQ ID NO: 60796 - RNA, 18 nt, Artificial Sequence
  Description of Artificial Sequence: Synthetic oligonucleotide
gauucagaagagaaaggg

SEQ ID NO: 60797 - RNA, 18 nt, Artificial Sequence
  Description of Artificial Sequence: Synthetic oligonucleotide
aagcagauucagaagaga

SEQ ID NO: 60798 - RNA, 18 nt, Artificial Sequence
  Description of Artificial Sequence: Synthetic oligonucleotide
cagggaagcagauucaga

SEQ ID NO: 60799 - RNA, 18 nt, Artificial Sequence
  Description of Artificial Sequence: Synthetic oligonucleotide
aacugcagggaagcagau

SEQ ID NO: 60800 - RNA, 18 nt, Artificial Sequence
  Description of Artificial Sequence: Synthetic oligonucleotide
aucuaaacugcagggaag

SEQ ID NO: 60801 - RNA, 18 nt, Artificial Sequence
  Description of Artificial Sequence: Synthetic oligonucleotide
ccgggaucuaaacugcag

SEQ ID NO: 60802 - RNA, 18 nt, Artificial Sequence
  Description of Artificial Sequence: Synthetic oligonucleotide
ccaucccgggaucuaaac

SEQ ID NO: 60803 - RNA, 18 nt, Artificial Sequence
  Description of Artificial Sequence: Synthetic oligonucleotide
gaaugccaucccgggauc

SEQ ID NO: 60804 - RNA, 18 nt, Artificial Sequence
  Description of Artificial Sequence: Synthetic oligonucleotide
cucaggaaugccaucccg

SEQ ID NO: 60805 - RNA, 18 nt, Artificial Sequence
  Description of Artificial Sequence: Synthetic oligonucleotide
gcuuucucaggaaugcca

SEQ ID NO: 60806 - RNA, 18 nt, Artificial Sequence
  Description of Artificial Sequence: Synthetic oligonucleotide
ggguugcuuucucaggaa

SEQ ID NO: 60807 - RNA, 18 nt, Artificial Sequence
  Description of Artificial Sequence: Synthetic oligonucleotide
gguucggguugcuuucuc

SEQ ID NO: 60808 - RNA, 18 nt, Artificial Sequence
  Description of Artificial Sequence: Synthetic oligonucleotide
cagcugguucggguugcu

SEQ ID NO: 60809 - RNA, 18 nt, Artificial Sequence
  Description of Artificial Sequence: Synthetic oligonucleotide
aaggacagcugguucggg

SEQ ID NO: 60810 - RNA, 18 nt, Artificial Sequence
  Description of Artificial Sequence: Synthetic oligonucleotide
gucagaaggacagcuggu

SEQ ID NO: 60811 - RNA, 18 nt, Artificial Sequence
  Description of Artificial Sequence: Synthetic oligonucleotide
gagcugucagaaggacag

SEQ ID NO: 60812 - RNA, 18 nt, Artificial Sequence
  Description of Artificial Sequence: Synthetic oligonucleotide
acaccgagcugucagaag

SEQ ID NO: 60813 - RNA, 18 nt, Artificial Sequence
  Description of Artificial Sequence: Synthetic oligonucleotide
gcugaacaccgagcuguc

SEQ ID NO: 60814 - RNA, 18 nt, Artificial Sequence
  Description of Artificial Sequence: Synthetic oligonucleotide
uguaagcugaacaccgag

SEQ ID NO: 60815 - RNA, 18 nt, Artificial Sequence
  Description of Artificial Sequence: Synthetic oligonucleotide
gucucuguaagcugaaca

SEQ ID NO: 60816 - RNA, 18 nt, Artificial Sequence
  Description of Artificial Sequence: Synthetic oligonucleotide
ggguggucucuguaagcu

SEQ ID NO: 60817 - RNA, 18 nt, Artificial Sequence
  Description of Artificial Sequence: Synthetic oligonucleotide
ccucucccuguggaggaa

SEQ ID NO: 60818 - RNA, 18 nt, Artificial Sequence
  Description of Artificial Sequence: Synthetic oligonucleotide
aggagccucucccugugg

SEQ ID NO: 60819 - RNA, 18 nt, Artificial Sequence
  Description of Artificial Sequence: Synthetic oligonucleotide
gagggaggagccucuccc

SEQ ID NO: 60820 - RNA, 18 nt, Artificial Sequence
  Description of Artificial Sequence: Synthetic oligonucleotide
caggagagggaggagccu

SEQ ID NO: 60821 - RNA, 18 nt, Artificial Sequence
  Description of Artificial Sequence: Synthetic oligonucleotide
ugucccaggagagggagg

SEQ ID NO: 60822 - RNA, 18 nt, Artificial Sequence
  Description of Artificial Sequence: Synthetic oligonucleotide
ugagcugucccaggagag

SEQ ID NO: 60823 - RNA, 18 nt, Artificial Sequence
  Description of Artificial Sequence: Synthetic oligonucleotide
accugugagcugucccag

SEQ ID NO: 60824 - RNA, 18 nt, Artificial Sequence
  Description of Artificial Sequence: Synthetic oligonucleotide
cuaggaccugugagcugu

SEQ ID NO: 60825 - RNA, 18 nt, Artificial Sequence
  Description of Artificial Sequence: Synthetic oligonucleotide
aaucacuaggaccuguga

SEQ ID NO: 60826 - RNA, 18 nt, Artificial Sequence
  Description of Artificial Sequence: Synthetic oligonucleotide
gagagaaucacuaggacc

SEQ ID NO: 60827 - RNA, 18 nt, Artificial Sequence
  Description of Artificial Sequence: Synthetic oligonucleotide
ggguugagagaaucacua

SEQ ID NO: 60828 - RNA, 18 nt, Artificial Sequence
  Description of Artificial Sequence: Synthetic oligonucleotide
uguuaggguugagagaau

SEQ ID NO: 60829 - RNA, 18 nt, Artificial Sequence
  Description of Artificial Sequence: Synthetic oligonucleotide
gacgguguuaggguugag

SEQ ID NO: 60830 - RNA, 18 nt, Artificial Sequence
  Description of Artificial Sequence: Synthetic oligonucleotide
ugccagacgguguuaggg

SEQ ID NO: 60831 - RNA, 18 nt, Artificial Sequence
  Description of Artificial Sequence: Synthetic oligonucleotide
aaucgugccagacggugu

SEQ ID NO: 60832 - RNA, 18 nt, Artificial Sequence
  Description of Artificial Sequence: Synthetic oligonucleotide
gucacaaucgugccagac

SEQ ID NO: 60833 - RNA, 18 nt, Artificial Sequence
  Description of Artificial Sequence: Synthetic oligonucleotide
cagcggucacaaucgugc

SEQ ID NO: 60834 - RNA, 18 nt, Artificial Sequence
  Description of Artificial Sequence: Synthetic oligonucleotide
uacuucagcggucacaau

SEQ ID NO: 60835 - RNA, 18 nt, Artificial Sequence
  Description of Artificial Sequence: Synthetic oligonucleotide
ugguguacuucagcgguc

SEQ ID NO: 60836 - RNA, 18 nt, Artificial Sequence
  Description of Artificial Sequence: Synthetic oligonucleotide
gcucgugguguacuucag

SEQ ID NO: 60837 - RNA, 18 nt, Artificial Sequence
  Description of Artificial Sequence: Synthetic oligonucleotide
cuggagcucgugguguac

SEQ ID NO: 60838 - RNA, 18 nt, Artificial Sequence
  Description of Artificial Sequence: Synthetic oligonucleotide
gaagccuggagcucgugg

SEQ ID NO: 60839 - RNA, 18 nt, Artificial Sequence
  Description of Artificial Sequence: Synthetic oligonucleotide
uuucugaagccuggagcu

SEQ ID NO: 60840 - RNA, 18 nt, Artificial Sequence
  Description of Artificial Sequence: Synthetic oligonucleotide
accacuuucugaagccug

SEQ ID NO: 60841 - RNA, 18 nt, Artificial Sequence
  Description of Artificial Sequence: Synthetic oligonucleotide
ucagcaccacuuucugaa

SEQ ID NO: 60842 - RNA, 18 nt, Artificial Sequence
  Description of Artificial Sequence: Synthetic oligonucleotide
aguucucagcaccacuuu

SEQ ID NO: 60843 - RNA, 18 nt, Artificial Sequence
  Description of Artificial Sequence: Synthetic oligonucleotide
gagcaaguucucagcacc

SEQ ID NO: 60844 - RNA, 18 nt, Artificial Sequence
  Description of Artificial Sequence: Synthetic oligonucleotide
ucuuggagcaaguucuca

SEQ ID NO: 60845 - RNA, 18 nt, Artificial Sequence
  Description of Artificial Sequence: Synthetic oligonucleotide
cuucuucuuggagcaagu

SEQ ID NO: 60846 - RNA, 18 nt, Artificial Sequence
  Description of Artificial Sequence: Synthetic oligonucleotide
uuugacuucuucuuggag

SEQ ID NO: 60847 - RNA, 18 nt, Artificial Sequence
  Description of Artificial Sequence: Synthetic oligonucleotide
uuugguuugacuucuucu

SEQ ID NO: 60848 - RNA, 18 nt, Artificial Sequence
  Description of Artificial Sequence: Synthetic oligonucleotide
gcaaguuugguuugacuu

SEQ ID NO: 60849 - RNA, 18 nt, Artificial Sequence
  Description of Artificial Sequence: Synthetic oligonucleotide
caacugcaaguuugguuu

SEQ ID NO: 60850 - RNA, 18 nt, Artificial Sequence
  Description of Artificial Sequence: Synthetic oligonucleotide
caaaucaacugcaaguuu

SEQ ID NO: 60851 - RNA, 18 nt, Artificial Sequence
  Description of Artificial Sequence: Synthetic oligonucleotide
gaccccaaaucaacugca

SEQ ID NO: 60852 - RNA, 18 nt, Artificial Sequence
  Description of Artificial Sequence: Synthetic oligonucleotide
aacaugaccccaaaucaa

SEQ ID NO: 60853 - RNA, 18 nt, Artificial Sequence
  Description of Artificial Sequence: Synthetic oligonucleotide
accuaaacaugaccccaa

SEQ ID NO: 60854 - RNA, 18 nt, Artificial Sequence
  Description of Artificial Sequence: Synthetic oligonucleotide
uucugaccuaaacaugac

SEQ ID NO: 60855 - RNA, 18 nt, Artificial Sequence
  Description of Artificial Sequence: Synthetic oligonucleotide
ggugauucugaccuaaac

SEQ ID NO: 60856 - RNA, 18 nt, Artificial Sequence
  Description of Artificial Sequence: Synthetic oligonucleotide
ggcacggugauucugacc

SEQ ID NO: 60857 - RNA, 18 nt, Artificial Sequence
  Description of Artificial Sequence: Synthetic oligonucleotide
ucaagggcacggugauuc

SEQ ID NO: 60858 - RNA, 18 nt, Artificial Sequence
  Description of Artificial Sequence: Synthetic oligonucleotide
cuuguucaagggcacggu

SEQ ID NO: 60859 - RNA, 18 nt, Artificial Sequence
  Description of Artificial Sequence: Synthetic oligonucleotide
accugcuuguucaagggc

SEQ ID NO: 60860 - RNA, 18 nt, Artificial Sequence
  Description of Artificial Sequence: Synthetic oligonucleotide
ccccuaccugcuuguuca

SEQ ID NO: 60861 - RNA, 18 nt, Artificial Sequence
  Description of Artificial Sequence: Synthetic oligonucleotide
aagccccccuaccugcuu

SEQ ID NO: 60862 - RNA, 18 nt, Artificial Sequence
  Description of Artificial Sequence: Synthetic oligonucleotide
uuaucaagccccccuacc

SEQ ID NO: 60863 - RNA, 18 nt, Artificial Sequence
  Description of Artificial Sequence: Synthetic oligonucleotide
uuaaguuaucaagccccc

SEQ ID NO: 60864 - RNA, 18 nt, Artificial Sequence
  Description of Artificial Sequence: Synthetic oligonucleotide
gaaaguuaaguuaucaag

SEQ ID NO: 60865 - RNA, 18 nt, Artificial Sequence
  Description of Artificial Sequence: Synthetic oligonucleotide
acguggaaaguuaaguua

SEQ ID NO: 60866 - RNA, 18 nt, Artificial Sequence
  Description of Artificial Sequence: Synthetic oligonucleotide
uguccacguggaaaguua

SEQ ID NO: 60867 - RNA, 18 nt, Artificial Sequence
  Description of Artificial Sequence: Synthetic oligonucleotide
aauucuguccacguggaa

SEQ ID NO: 60868 - RNA, 18 nt, Artificial Sequence
  Description of Artificial Sequence: Synthetic oligonucleotide
aaaaaaauucuguccacg

SEQ ID NO: 60869 - RNA, 18 nt, Artificial Sequence
  Description of Artificial Sequence: Synthetic oligonucleotide
caaaaaaaaaaauucugu

SEQ ID NO: 60870 - RNA, 18 nt, Artificial Sequence
  Description of Artificial Sequence: Synthetic oligonucleotide
caaaacaaaaaaaaaaau

SEQ ID NO: 60871 - RNA, 18 nt, Artificial Sequence
  Description of Artificial Sequence: Synthetic oligonucleotide
aaaaacaaaacaaaaaaa

SEQ ID NO: 60872 - RNA, 18 nt, Artificial Sequence
  Description of Artificial Sequence: Synthetic oligonucleotide
aaaacaaaaacaaaacaa

SEQ ID NO: 60873 - RNA, 18 nt, Artificial Sequence
  Description of Artificial Sequence: Synthetic oligonucleotide
ucugcaaaacaaaaacaa

SEQ ID NO: 60874 - RNA, 18 nt, Artificial Sequence
  Description of Artificial Sequence: Synthetic oligonucleotide
cugugucugcaaaacaaa

SEQ ID NO: 60875 - RNA, 18 nt, Artificial Sequence
  Description of Artificial Sequence: Synthetic oligonucleotide
cuagacugugucugcaaa

SEQ ID NO: 60876 - RNA, 18 nt, Artificial Sequence
  Description of Artificial Sequence: Synthetic oligonucleotide
cagagcuagacugugucu

SEQ ID NO: 60877 - RNA, 18 nt, Artificial Sequence
  Description of Artificial Sequence: Synthetic oligonucleotide
ggcgacagagcuagacug

SEQ ID NO: 60878 - RNA, 18 nt, Artificial Sequence
  Description of Artificial Sequence: Synthetic oligonucleotide
gccugggcgacagagcua

SEQ ID NO: 60879 - RNA, 18 nt, Artificial Sequence
  Description of Artificial Sequence: Synthetic oligonucleotide
cuccagccugggcgacag

SEQ ID NO: 60880 - RNA, 18 nt, Artificial Sequence
  Description of Artificial Sequence: Synthetic oligonucleotide
cugcacuccagccugggc

SEQ ID NO: 60881 - RNA, 18 nt, Artificial Sequence
  Description of Artificial Sequence: Synthetic oligonucleotide
ugccacugcacuccagcc

SEQ ID NO: 60882 - RNA, 18 nt, Artificial Sequence
  Description of Artificial Sequence: Synthetic oligonucleotide
gaucgugccacugcacuc

SEQ ID NO: 60883 - RNA, 18 nt, Artificial Sequence
  Description of Artificial Sequence: Synthetic oligonucleotide
gcugagaucgugccacug

SEQ ID NO: 60884 - RNA, 18 nt, Artificial Sequence
  Description of Artificial Sequence: Synthetic oligonucleotide
agugagcugagaucgugc

SEQ ID NO: 60885 - RNA, 18 nt, Artificial Sequence
  Description of Artificial Sequence: Synthetic oligonucleotide
cuugcagugagcugagau

SEQ ID NO: 60886 - RNA, 18 nt, Artificial Sequence
  Description of Artificial Sequence: Synthetic oligonucleotide
uagagcuugcagugagcu

SEQ ID NO: 60887 - RNA, 18 nt, Artificial Sequence
  Description of Artificial Sequence: Synthetic oligonucleotide
ggagguagagcuugcagu

SEQ ID NO: 60888 - RNA, 18 nt, Artificial Sequence
  Description of Artificial Sequence: Synthetic oligonucleotide
acccgggagguagagcuu

SEQ ID NO: 60889 - RNA, 18 nt, Artificial Sequence
  Description of Artificial Sequence: Synthetic oligonucleotide
cgugaacccgggagguag

SEQ ID NO: 60890 - RNA, 18 nt, Artificial Sequence
  Description of Artificial Sequence: Synthetic oligonucleotide
aauggcgugaacccggga

SEQ ID NO: 60891 - RNA, 18 nt, Artificial Sequence
  Description of Artificial Sequence: Synthetic oligonucleotide
aggagaauggcgugaacc

SEQ ID NO: 60892 - RNA, 18 nt, Artificial Sequence
  Description of Artificial Sequence: Synthetic oligonucleotide
gaggcaggagaauggcgu

SEQ ID NO: 60893 - RNA, 18 nt, Artificial Sequence
  Description of Artificial Sequence: Synthetic oligonucleotide
aggcugaggcaggagaau

SEQ ID NO: 60894 - RNA, 18 nt, Artificial Sequence
  Description of Artificial Sequence: Synthetic oligonucleotide
ucgggaggcugaggcagg

SEQ ID NO: 60895 - RNA, 18 nt, Artificial Sequence
  Description of Artificial Sequence: Synthetic oligonucleotide
gcuacucgggaggcugag

SEQ ID NO: 60896 - RNA, 18 nt, Artificial Sequence
  Description of Artificial Sequence: Synthetic oligonucleotide
ucccagcuacucgggagg

SEQ ID NO: 60897 - RNA, 18 nt, Artificial Sequence
  Description of Artificial Sequence: Synthetic oligonucleotide
uguagucccagcuacucg

SEQ ID NO: 60898 - RNA, 18 nt, Artificial Sequence
  Description of Artificial Sequence: Synthetic oligonucleotide
gcaucuguagucccagcu

SEQ ID NO: 60899 - RNA, 18 nt, Artificial Sequence
  Description of Artificial Sequence: Synthetic oligonucleotide
ggugggcaucuguagucc

SEQ ID NO: 60900 - RNA, 18 nt, Artificial Sequence
  Description of Artificial Sequence: Synthetic oligonucleotide
cugguggugggcaucugu

SEQ ID NO: 60901 - RNA, 18 nt, Artificial Sequence
  Description of Artificial Sequence: Synthetic oligonucleotide
cgggccugguggugggca

SEQ ID NO: 60902 - RNA, 18 nt, Artificial Sequence
  Description of Artificial Sequence: Synthetic oligonucleotide
uuagccgggccugguggu

SEQ ID NO: 60903 - RNA, 18 nt, Artificial Sequence
  Description of Artificial Sequence: Synthetic oligonucleotide
aaaaauuagccgggccug

SEQ ID NO: 60904 - RNA, 18 nt, Artificial Sequence
  Description of Artificial Sequence: Synthetic oligonucleotide
acaaaaaaaauuagccgg

SEQ ID NO: 60905 - RNA, 18 nt, Artificial Sequence
  Description of Artificial Sequence: Synthetic oligonucleotide
aaaauacaaaaaaaauua

SEQ ID NO: 60906 - RNA, 18 nt, Artificial Sequence
  Description of Artificial Sequence: Synthetic oligonucleotide
uacuaaaaauacaaaaaa

SEQ ID NO: 60907 - RNA, 18 nt, Artificial Sequence
  Description of Artificial Sequence: Synthetic oligonucleotide
gucucuacuaaaaauaca

SEQ ID NO: 60908 - RNA, 18 nt, Artificial Sequence
  Description of Artificial Sequence: Synthetic oligonucleotide
accccgucucuacuaaaa

SEQ ID NO: 60909 - RNA, 18 nt, Artificial Sequence
  Description of Artificial Sequence: Synthetic oligonucleotide
gugaaaccccgucucuac

SEQ ID NO: 60910 - RNA, 18 nt, Artificial Sequence
  Description of Artificial Sequence: Synthetic oligonucleotide
acacggugaaaccccguc

SEQ ID NO: 60911 - RNA, 18 nt, Artificial Sequence
  Description of Artificial Sequence: Synthetic oligonucleotide
ggcuaacacggugaaacc

SEQ ID NO: 60912 - RNA, 18 nt, Artificial Sequence
  Description of Artificial Sequence: Synthetic oligonucleotide
auccuggcuaacacggug

SEQ ID NO: 60913 - RNA, 18 nt, Artificial Sequence
  Description of Artificial Sequence: Synthetic oligonucleotide
agaccauccuggcuaaca

SEQ ID NO: 60914 - RNA, 18 nt, Artificial Sequence
  Description of Artificial Sequence: Synthetic oligonucleotide
gaucgagaccauccuggc

SEQ ID NO: 60915 - RNA, 18 nt, Artificial Sequence
  Description of Artificial Sequence: Synthetic oligonucleotide
caggagaucgagaccauc

SEQ ID NO: 60916 - RNA, 18 nt, Artificial Sequence
  Description of Artificial Sequence: Synthetic oligonucleotide
gaggucaggagaucgaga

SEQ ID NO: 60917 - RNA, 18 nt, Artificial Sequence
  Description of Artificial Sequence: Synthetic oligonucleotide
aucacgaggucaggagau

SEQ ID NO: 60918 - RNA, 18 nt, Artificial Sequence
  Description of Artificial Sequence: Synthetic oligonucleotide
ggcggaucacgaggucag

SEQ ID NO: 60919 - RNA, 18 nt, Artificial Sequence
  Description of Artificial Sequence: Synthetic oligonucleotide
aggcgggcggaucacgag

SEQ ID NO: 60920 - RNA, 18 nt, Artificial Sequence
  Description of Artificial Sequence: Synthetic oligonucleotide
ggccgaggcgggcggauc

SEQ ID NO: 60921 - RNA, 18 nt, Artificial Sequence
  Description of Artificial Sequence: Synthetic oligonucleotide
ugggaggccgaggcgggc

SEQ ID NO: 60922 - RNA, 18 nt, Artificial Sequence
  Description of Artificial Sequence: Synthetic oligonucleotide
cacuuugggaggccgagg

SEQ ID NO: 60923 - RNA, 18 nt, Artificial Sequence
  Description of Artificial Sequence: Synthetic oligonucleotide
ccuagcacuuugggaggc

SEQ ID NO: 60924 - RNA, 18 nt, Artificial Sequence
  Description of Artificial Sequence: Synthetic oligonucleotide
guaauccuagcacuuugg

SEQ ID NO: 60925 - RNA, 18 nt, Artificial Sequence
  Description of Artificial Sequence: Synthetic oligonucleotide
cgccuguaauccuagcac

SEQ ID NO: 60926 - RNA, 18 nt, Artificial Sequence
  Description of Artificial Sequence: Synthetic oligonucleotide
gcucacgccuguaauccu

SEQ ID NO: 60927 - RNA, 18 nt, Artificial Sequence
  Description of Artificial Sequence: Synthetic oligonucleotide
cgguggcucacgccugua

SEQ ID NO: 60928 - RNA, 18 nt, Artificial Sequence
  Description of Artificial Sequence: Synthetic oligonucleotide
gggcgcgguggcucacgc

SEQ ID NO: 60929 - RNA, 18 nt, Artificial Sequence
  Description of Artificial Sequence: Synthetic oligonucleotide
gggccgggcgcgguggcu

SEQ ID NO: 60930 - RNA, 18 nt, Artificial Sequence
  Description of Artificial Sequence: Synthetic oligonucleotide
aaaaagggccgggcgcgg

SEQ ID NO: 60931 - RNA, 18 nt, Artificial Sequence
  Description of Artificial Sequence: Synthetic oligonucleotide
aaaaaaaaaagggccggg

SEQ ID NO: 60932 - RNA, 18 nt, Artificial Sequence
  Description of Artificial Sequence: Synthetic oligonucleotide
aaaaaaaaaaaaaaaggg

SEQ ID NO: 60933 - RNA, 18 nt, Artificial Sequence
  Description of Artificial Sequence: Synthetic oligonucleotide
aaaaaaaaaaaaaaaaaa

SEQ ID NO: 60934 - RNA, 18 nt, Artificial Sequence
  Description of Artificial Sequence: Synthetic oligonucleotide
caauuaaaaaaaaaaaaa

SEQ ID NO: 60935 - RNA, 18 nt, Artificial Sequence
  Description of Artificial Sequence: Synthetic oligonucleotide
cgucucaauuaaaaaaaa

SEQ ID NO: 60936 - RNA, 18 nt, Artificial Sequence
  Description of Artificial Sequence: Synthetic oligonucleotide
gacuccgucucaauuaaa

SEQ ID NO: 60937 - RNA, 18 nt, Artificial Sequence
  Description of Artificial Sequence: Synthetic oligonucleotide
agugagacuccgucucaa

SEQ ID NO: 60938 - RNA, 18 nt, Artificial Sequence
  Description of Artificial Sequence: Synthetic oligonucleotide
aaaagagugagacuccgu

SEQ ID NO: 60939 - RNA, 18 nt, Artificial Sequence
  Description of Artificial Sequence: Synthetic oligonucleotide
uaagcaaaagagugagac

SEQ ID NO: 60940 - RNA, 18 nt, Artificial Sequence
  Description of Artificial Sequence: Synthetic oligonucleotide
cagccuaagcaaaagagu

SEQ ID NO: 60941 - RNA, 18 nt, Artificial Sequence
  Description of Artificial Sequence: Synthetic oligonucleotide
cacuccagccuaagcaaa

SEQ ID NO: 60942 - RNA, 18 nt, Artificial Sequence
  Description of Artificial Sequence: Synthetic oligonucleotide
cacugcacuccagccuaa

SEQ ID NO: 60943 - RNA, 18 nt, Artificial Sequence
  Description of Artificial Sequence: Synthetic oligonucleotide
cacaccacugcacuccag

SEQ ID NO: 60944 - RNA, 18 nt, Artificial Sequence
  Description of Artificial Sequence: Synthetic oligonucleotide
gagaucacaccacugcac

SEQ ID NO: 60945 - RNA, 18 nt, Artificial Sequence
  Description of Artificial Sequence: Synthetic oligonucleotide
gagcugagaucacaccac

SEQ ID NO: 60946 - RNA, 18 nt, Artificial Sequence
  Description of Artificial Sequence: Synthetic oligonucleotide
ucagugagcugagaucac

SEQ ID NO: 60947 - RNA, 18 nt, Artificial Sequence
  Description of Artificial Sequence: Synthetic oligonucleotide
ugcagucagugagcugag

SEQ ID NO: 60948 - RNA, 18 nt, Artificial Sequence
  Description of Artificial Sequence: Synthetic oligonucleotide
gagguugcagucagugag

SEQ ID NO: 60949 - RNA, 18 nt, Artificial Sequence
  Description of Artificial Sequence: Synthetic oligonucleotide
agguggagguugcaguca

SEQ ID NO: 60950 - RNA, 18 nt, Artificial Sequence
  Description of Artificial Sequence: Synthetic oligonucleotide
ccgggagguggagguugc

SEQ ID NO: 60951 - RNA, 18 nt, Artificial Sequence
  Description of Artificial Sequence: Synthetic oligonucleotide
ucaacccgggagguggag

SEQ ID NO: 60952 - RNA, 18 nt, Artificial Sequence
  Description of Artificial Sequence: Synthetic oligonucleotide
acgcuucaacccgggagg

SEQ ID NO: 60953 - RNA, 18 nt, Artificial Sequence
  Description of Artificial Sequence: Synthetic oligonucleotide
gagcaacgcuucaacccg

SEQ ID NO: 60954 - RNA, 18 nt, Artificial Sequence
  Description of Artificial Sequence: Synthetic oligonucleotide
ggcaggagcaacgcuuca

SEQ ID NO: 60955 - RNA, 18 nt, Artificial Sequence
  Description of Artificial Sequence: Synthetic oligonucleotide
auugaggcaggagcaacg

SEQ ID NO: 60956 - RNA, 18 nt, Artificial Sequence
  Description of Artificial Sequence: Synthetic oligonucleotide
gggagauugaggcaggag

SEQ ID NO: 60957 - RNA, 18 nt, Artificial Sequence
  Description of Artificial Sequence: Synthetic oligonucleotide
uaauugggagauugaggc

SEQ ID NO: 60958 - RNA, 18 nt, Artificial Sequence
  Description of Artificial Sequence: Synthetic oligonucleotide
ccagcuaauugggagauu

SEQ ID NO: 60959 - RNA, 18 nt, Artificial Sequence
  Description of Artificial Sequence: Synthetic oligonucleotide
uaaucccagcuaauuggg

SEQ ID NO: 60960 - RNA, 18 nt, Artificial Sequence
  Description of Artificial Sequence: Synthetic oligonucleotide
accuguaaucccagcuaa

SEQ ID NO: 60961 - RNA, 18 nt, Artificial Sequence
  Description of Artificial Sequence: Synthetic oligonucleotide
agcacaccuguaauccca

SEQ ID NO: 60962 - RNA, 18 nt, Artificial Sequence
  Description of Artificial Sequence: Synthetic oligonucleotide
gauggagcacaccuguaa

SEQ ID NO: 60963 - RNA, 18 nt, Artificial Sequence
  Description of Artificial Sequence: Synthetic oligonucleotide
ggcaugauggagcacacc

SEQ ID NO: 60964 - RNA, 18 nt, Artificial Sequence
  Description of Artificial Sequence: Synthetic oligonucleotide
agccgggcaugauggagc

SEQ ID NO: 60965 - RNA, 18 nt, Artificial Sequence
  Description of Artificial Sequence: Synthetic oligonucleotide
aaauuagccgggcaugau

SEQ ID NO: 60966 - RNA, 18 nt, Artificial Sequence
  Description of Artificial Sequence: Synthetic oligonucleotide
uagaaaaauuagccgggc

SEQ ID NO: 60967 - RNA, 18 nt, Artificial Sequence
  Description of Artificial Sequence: Synthetic oligonucleotide
aauaauagaaaaauuagc

SEQ ID NO: 60968 - RNA, 18 nt, Artificial Sequence
  Description of Artificial Sequence: Synthetic oligonucleotide
cuacuaauaauagaaaaa

SEQ ID NO: 60969 - RNA, 18 nt, Artificial Sequence
  Description of Artificial Sequence: Synthetic oligonucleotide
ugucucuacuaauaauag

SEQ ID NO: 60970 - RNA, 18 nt, Artificial Sequence
  Description of Artificial Sequence: Synthetic oligonucleotide
aacccugucucuacuaau

SEQ ID NO: 60971 - RNA, 18 nt, Artificial Sequence
  Description of Artificial Sequence: Synthetic oligonucleotide
gguaaaacccugucucua

SEQ ID NO: 60972 - RNA, 18 nt, Artificial Sequence
  Description of Artificial Sequence: Synthetic oligonucleotide
aacaugguaaaacccugu

SEQ ID NO: 60973 - RNA, 18 nt, Artificial Sequence
  Description of Artificial Sequence: Synthetic oligonucleotide
uggccaacaugguaaaac

SEQ ID NO: 60974 - RNA, 18 nt, Artificial Sequence
  Description of Artificial Sequence: Synthetic oligonucleotide
cagccuggccaacauggu

SEQ ID NO: 60975 - RNA, 18 nt, Artificial Sequence
  Description of Artificial Sequence: Synthetic oligonucleotide
cagaccagccuggccaac

SEQ ID NO: 60976 - RNA, 18 nt, Artificial Sequence
  Description of Artificial Sequence: Synthetic oligonucleotide
gguuccagaccagccugg

SEQ ID NO: 60977 - RNA, 18 nt, Artificial Sequence
  Description of Artificial Sequence: Synthetic oligonucleotide
ggguuccagaccagccug

SEQ ID NO: 60978 - RNA, 18 nt, Artificial Sequence
  Description of Artificial Sequence: Synthetic oligonucleotide
gaucacuugaggucaggg

SEQ ID NO: 60979 - RNA, 18 nt, Artificial Sequence
  Description of Artificial Sequence: Synthetic oligonucleotide
aggcggaucacuugaggu

SEQ ID NO: 60980 - RNA, 18 nt, Artificial Sequence
  Description of Artificial Sequence: Synthetic oligonucleotide
gaggcaggcggaucacuu

SEQ ID NO: 60981 - RNA, 18 nt, Artificial Sequence
  Description of Artificial Sequence: Synthetic oligonucleotide
aggccgaggcaggcggau

SEQ ID NO: 60982 - RNA, 18 nt, Artificial Sequence
  Description of Artificial Sequence: Synthetic oligonucleotide
uugggaggccgaggcagg

SEQ ID NO: 60983 - RNA, 18 nt, Artificial Sequence
  Description of Artificial Sequence: Synthetic oligonucleotide
gcacuuugggaggccgag

SEQ ID NO: 60984 - RNA, 18 nt, Artificial Sequence
  Description of Artificial Sequence: Synthetic oligonucleotide
ucccagcacuuugggagg

SEQ ID NO: 60985 - RNA, 18 nt, Artificial Sequence
  Description of Artificial Sequence: Synthetic oligonucleotide
uguaaucccagcacuuug

SEQ ID NO: 60986 - RNA, 18 nt, Artificial Sequence
  Description of Artificial Sequence: Synthetic oligonucleotide
augccuguaaucccagca

SEQ ID NO: 60987 - RNA, 18 nt, Artificial Sequence
  Description of Artificial Sequence: Synthetic oligonucleotide
ggcucaugccuguaaucc

SEQ ID NO: 60988 - RNA, 18 nt, Artificial Sequence
  Description of Artificial Sequence: Synthetic oligonucleotide
acaauggcucaugccugu

SEQ ID NO: 60989 - RNA, 18 nt, Artificial Sequence
  Description of Artificial Sequence: Synthetic oligonucleotide
caggcacaauggcucaug

SEQ ID NO: 60990 - RNA, 18 nt, Artificial Sequence
  Description of Artificial Sequence: Synthetic oligonucleotide
agggccaggcacaauggc

SEQ ID NO: 60991 - RNA, 18 nt, Artificial Sequence
  Description of Artificial Sequence: Synthetic oligonucleotide
cguguagggccaggcaca

SEQ ID NO: 60992 - RNA, 18 nt, Artificial Sequence
  Description of Artificial Sequence: Synthetic oligonucleotide
guccacguguagggccag

SEQ ID NO: 60993 - RNA, 18 nt, Artificial Sequence
  Description of Artificial Sequence: Synthetic oligonucleotide
gaaguguccacguguagg

SEQ ID NO: 60994 - RNA, 18 nt, Artificial Sequence
  Description of Artificial Sequence: Synthetic oligonucleotide
cuaaagaaguguccacgu

SEQ ID NO: 60995 - RNA, 18 nt, Artificial Sequence
  Description of Artificial Sequence: Synthetic oligonucleotide
auaugcuaaagaaguguc

SEQ ID NO: 60996 - RNA, 18 nt, Artificial Sequence
  Description of Artificial Sequence: Synthetic oligonucleotide
uaaccauaugcuaaagaa

SEQ ID NO: 60997 - RNA, 18 nt, Artificial Sequence
  Description of Artificial Sequence: Synthetic oligonucleotide
gucccuaaccauaugcua

SEQ ID NO: 60998 - RNA, 18 nt, Artificial Sequence
  Description of Artificial Sequence: Synthetic oligonucleotide
gaaaggucccuaaccaua

SEQ ID NO: 60999 - RNA, 18 nt, Artificial Sequence
  Description of Artificial Sequence: Synthetic oligonucleotide
uucuagaaaggucccuaa

SEQ ID NO: 61000 - RNA, 18 nt, Artificial Sequence
  Description of Artificial Sequence: Synthetic oligonucleotide
ggaauuucuagaaagguc

SEQ ID NO: 61001 - RNA, 18 nt, Artificial Sequence
  Description of Artificial Sequence: Synthetic oligonucleotide
ucuuuggaauuucuagaa

SEQ ID NO: 61002 - RNA, 18 nt, Artificial Sequence
  Description of Artificial Sequence: Synthetic oligonucleotide
gucugucuuuggaauuuc

SEQ ID NO: 61003 - RNA, 18 nt, Artificial Sequence
  Description of Artificial Sequence: Synthetic oligonucleotide
uuaaagucugucuuugga

SEQ ID NO: 61004 - RNA, 18 nt, Artificial Sequence
  Description of Artificial Sequence: Synthetic oligonucleotide
gcuucuuaaagucugucu

SEQ ID NO: 61005 - RNA, 18 nt, Artificial Sequence
  Description of Artificial Sequence: Synthetic oligonucleotide
gggcuucuuaaagucugu

SEQ ID NO: 61006 - RNA, 18 nt, Artificial Sequence
  Description of Artificial Sequence: Synthetic oligonucleotide
cuaagguuucccgacggg

SEQ ID NO: 61007 - RNA, 18 nt, Artificial Sequence
  Description of Artificial Sequence: Synthetic oligonucleotide
uuggccuaagguuucccg

SEQ ID NO: 61008 - RNA, 18 nt, Artificial Sequence
  Description of Artificial Sequence: Synthetic oligonucleotide
caucauuggccuaagguu

SEQ ID NO: 61009 - RNA, 18 nt, Artificial Sequence
  Description of Artificial Sequence: Synthetic oligonucleotide
aaccacaucauuggccua

SEQ ID NO: 61010 - RNA, 18 nt, Artificial Sequence
  Description of Artificial Sequence: Synthetic oligonucleotide
aauguaaccacaucauug

SEQ ID NO: 61011 - RNA, 18 nt, Artificial Sequence
  Description of Artificial Sequence: Synthetic oligonucleotide
uuuuuaauguaaccacau

SEQ ID NO: 61012 - RNA, 18 nt, Artificial Sequence
  Description of Artificial Sequence: Synthetic oligonucleotide
auuuauuuuuaauguaac

SEQ ID NO: 61013 - RNA, 18 nt, Artificial Sequence
  Description of Artificial Sequence: Synthetic oligonucleotide
agauaauuuauuuuuaau

SEQ ID NO: 61014 - RNA, 18 nt, Artificial Sequence
  Description of Artificial Sequence: Synthetic oligonucleotide
uucccagauaauuuauuu

SEQ ID NO: 61015 - RNA, 18 nt, Artificial Sequence
  Description of Artificial Sequence: Synthetic oligonucleotide
ugaaauucccagauaauu

SEQ ID NO: 61016 - RNA, 18 nt, Artificial Sequence
  Description of Artificial Sequence: Synthetic oligonucleotide
gucugugaaauucccaga

SEQ ID NO: 61017 - RNA, 18 nt, Artificial Sequence
  Description of Artificial Sequence: Synthetic oligonucleotide
gugaagucugugaaauuc

SEQ ID NO: 61018 - RNA, 18 nt, Artificial Sequence
  Description of Artificial Sequence: Synthetic oligonucleotide
cauuugugaagucuguga

SEQ ID NO: 61019 - RNA, 18 nt, Artificial Sequence
  Description of Artificial Sequence: Synthetic oligonucleotide
ccugacauuugugaaguc

SEQ ID NO: 61020 - RNA, 18 nt, Artificial Sequence
  Description of Artificial Sequence: Synthetic oligonucleotide
guaagccugacauuugug

SEQ ID NO: 61021 - RNA, 18 nt, Artificial Sequence
  Description of Artificial Sequence: Synthetic oligonucleotide
accauguaagccugacau

SEQ ID NO: 61022 - RNA, 18 nt, Artificial Sequence
  Description of Artificial Sequence: Synthetic oligonucleotide
aaccuaccauguaagccu

SEQ ID NO: 61023 - RNA, 18 nt, Artificial Sequence
  Description of Artificial Sequence: Synthetic oligonucleotide
cccuaaaccuaccaugua

SEQ ID NO: 61024 - RNA, 18 nt, Artificial Sequence
  Description of Artificial Sequence: Synthetic oligonucleotide
cgguccccuaaaccuacc

SEQ ID NO: 61025 - RNA, 18 nt, Artificial Sequence
  Description of Artificial Sequence: Synthetic oligonucleotide
ucaaacgguccccuaaac

SEQ ID NO: 61026 - RNA, 18 nt, Artificial Sequence
  Description of Artificial Sequence: Synthetic oligonucleotide
gucucucaaacggucccc

SEQ ID NO: 61027 - RNA, 18 nt, Artificial Sequence
  Description of Artificial Sequence: Synthetic oligonucleotide
ucuuugucucucaaacgg

SEQ ID NO: 61028 - RNA, 18 nt, Artificial Sequence
  Description of Artificial Sequence: Synthetic oligonucleotide
guagaucuuugucucuca

SEQ ID NO: 61029 - RNA, 18 nt, Artificial Sequence
  Description of Artificial Sequence: Synthetic oligonucleotide
ugaauguagaucuuuguc

SEQ ID NO: 61030 - RNA, 18 nt, Artificial Sequence
  Description of Artificial Sequence: Synthetic oligonucleotide
auauaugaauguagaucu

SEQ ID NO: 61031 - RNA, 18 nt, Artificial Sequence
  Description of Artificial Sequence: Synthetic oligonucleotide
gcuacauauaugaaugua

SEQ ID NO: 61032 - RNA, 18 nt, Artificial Sequence
  Description of Artificial Sequence: Synthetic oligonucleotide
guauagcuacauauauga

SEQ ID NO: 61033 - RNA, 18 nt, Artificial Sequence
  Description of Artificial Sequence: Synthetic oligonucleotide
uauauguauagcuacaua

SEQ ID NO: 61034 - RNA, 18 nt, Artificial Sequence
  Description of Artificial Sequence: Synthetic oligonucleotide
guacauauauguauagcu

SEQ ID NO: 61035 - RNA, 18 nt, Artificial Sequence
  Description of Artificial Sequence: Synthetic oligonucleotide
aaaaaguacauauaugua

SEQ ID NO: 61036 - RNA, 18 nt, Artificial Sequence
  Description of Artificial Sequence: Synthetic oligonucleotide
agaagaaaaaguacauau

SEQ ID NO: 61037 - RNA, 18 nt, Artificial Sequence
  Description of Artificial Sequence: Synthetic oligonucleotide
aacuaagaagaaaaagua

SEQ ID NO: 61038 - RNA, 18 nt, Artificial Sequence
  Description of Artificial Sequence: Synthetic oligonucleotide
aaagaaacuaagaagaaa

SEQ ID NO: 61039 - RNA, 18 nt, Artificial Sequence
  Description of Artificial Sequence: Synthetic oligonucleotide
uuuaaaaagaaacuaaga

SEQ ID NO: 61040 - RNA, 18 nt, Artificial Sequence
  Description of Artificial Sequence: Synthetic oligonucleotide
augucuuuaaaaagaaac

SEQ ID NO: 61041 - RNA, 18 nt, Artificial Sequence
  Description of Artificial Sequence: Synthetic oligonucleotide
auaaaaugucuuuaaaaa

SEQ ID NO: 61042 - RNA, 18 nt, Artificial Sequence
  Description of Artificial Sequence: Synthetic oligonucleotide
gagugauaaaaugucuuu

SEQ ID NO: 61043 - RNA, 18 nt, Artificial Sequence
  Description of Artificial Sequence: Synthetic oligonucleotide
cgaaugagugauaaaaug

SEQ ID NO: 61044 - RNA, 18 nt, Artificial Sequence
  Description of Artificial Sequence: Synthetic oligonucleotide
augagcgaaugagugaua

SEQ ID NO: 61045 - RNA, 18 nt, Artificial Sequence
  Description of Artificial Sequence: Synthetic oligonucleotide
ugcuaaugagcgaaugag

SEQ ID NO: 61046 - RNA, 18 nt, Artificial Sequence
  Description of Artificial Sequence: Synthetic oligonucleotide
caaugugcuaaugagcga

SEQ ID NO: 61047 - RNA, 18 nt, Artificial Sequence
  Description of Artificial Sequence: Synthetic oligonucleotide
auucccaaugugcuaaug

SEQ ID NO: 61048 - RNA, 18 nt, Artificial Sequence
  Description of Artificial Sequence: Synthetic oligonucleotide
cacacauucccaaugugc

SEQ ID NO: 61049 - RNA, 18 nt, Artificial Sequence
  Description of Artificial Sequence: Synthetic oligonucleotide
aaauacacacauucccaa

SEQ ID NO: 61050 - RNA, 18 nt, Artificial Sequence
  Description of Artificial Sequence: Synthetic oligonucleotide
cuaccaaauacacacauu

SEQ ID NO: 61051 - RNA, 18 nt, Artificial Sequence
  Description of Artificial Sequence: Synthetic oligonucleotide
uuucccuaccaaauacac

SEQ ID NO: 61052 - RNA, 18 nt, Artificial Sequence
  Description of Artificial Sequence: Synthetic oligonucleotide
uuucauuucccuaccaaa

SEQ ID NO: 61053 - RNA, 18 nt, Artificial Sequence
  Description of Artificial Sequence: Synthetic oligonucleotide
gugccuuucauuucccua

SEQ ID NO: 61054 - RNA, 18 nt, Artificial Sequence
  Description of Artificial Sequence: Synthetic oligonucleotide
gcaaggugccuuucauuu

SEQ ID NO: 61055 - RNA, 18 nt, Artificial Sequence
  Description of Artificial Sequence: Synthetic oligonucleotide
aacaggcaaggugccuuu

SEQ ID NO: 61056 - RNA, 18 nt, Artificial Sequence
  Description of Artificial Sequence: Synthetic oligonucleotide
gauggaacaggcaaggug

SEQ ID NO: 61057 - RNA, 18 nt, Artificial Sequence
  Description of Artificial Sequence: Synthetic oligonucleotide
guagagauggaacaggca

SEQ ID NO: 61058 - RNA, 18 nt, Artificial Sequence
  Description of Artificial Sequence: Synthetic oligonucleotide
aaggaguagagauggaac

SEQ ID NO: 61059 - RNA, 18 nt, Artificial Sequence
  Description of Artificial Sequence: Synthetic oligonucleotide
gaaaaaaggaguagagau

SEQ ID NO: 61060 - RNA, 18 nt, Artificial Sequence
  Description of Artificial Sequence: Synthetic oligonucleotide
caaaagaaaaaaggagua

SEQ ID NO: 61061 - RNA, 18 nt, Artificial Sequence
  Description of Artificial Sequence: Synthetic oligonucleotide
uaaaacaaaagaaaaaag

SEQ ID NO: 61062 - RNA, 18 nt, Artificial Sequence
  Description of Artificial Sequence: Synthetic oligonucleotide
aauccuaaaacaaaagaa

SEQ ID NO: 61063 - RNA, 18 nt, Artificial Sequence
  Description of Artificial Sequence: Synthetic oligonucleotide
uagaaaauccuaaaacaa

SEQ ID NO: 61064 - RNA, 18 nt, Artificial Sequence
  Description of Artificial Sequence: Synthetic oligonucleotide
accuuuagaaaauccuaa

SEQ ID NO: 61065 - RNA, 18 nt, Artificial Sequence
  Description of Artificial Sequence: Synthetic oligonucleotide
gucucaccuuuagaaaau

SEQ ID NO: 61066 - RNA, 18 nt, Artificial Sequence
  Description of Artificial Sequence: Synthetic oligonucleotide
ccagugucucaccuuuag

SEQ ID NO: 61067 - RNA, 18 nt, Artificial Sequence
  Description of Artificial Sequence: Synthetic oligonucleotide
uuccaccagugucucacc

SEQ ID NO: 61068 - RNA, 18 nt, Artificial Sequence
  Description of Artificial Sequence: Synthetic oligonucleotide
cccaguuccaccaguguc

SEQ ID NO: 61069 - RNA, 18 nt, Artificial Sequence
  Description of Artificial Sequence: Synthetic oligonucleotide
gcuaccccaguuccacca

SEQ ID NO: 61070 - RNA, 18 nt, Artificial Sequence
  Description of Artificial Sequence: Synthetic oligonucleotide
aagcagcuaccccaguuc

SEQ ID NO: 61071 - RNA, 18 nt, Artificial Sequence
  Description of Artificial Sequence: Synthetic oligonucleotide
gucccaagcagcuacccc

SEQ ID NO: 61072 - RNA, 18 nt, Artificial Sequence
  Description of Artificial Sequence: Synthetic oligonucleotide
gguacgucccaagcagcu

SEQ ID NO: 61073 - RNA, 18 nt, Artificial Sequence
  Description of Artificial Sequence: Synthetic oligonucleotide
uaggugguacgucccaag

SEQ ID NO: 61074 - RNA, 18 nt, Artificial Sequence
  Description of Artificial Sequence: Synthetic oligonucleotide
aacuauaggugguacguc

SEQ ID NO: 61075 - RNA, 18 nt, Artificial Sequence
  Description of Artificial Sequence: Synthetic oligonucleotide
gccacaacuauagguggu

SEQ ID NO: 61076 - RNA, 18 nt, Artificial Sequence
  Description of Artificial Sequence: Synthetic oligonucleotide
aaauagccacaacuauag

SEQ ID NO: 61077 - RNA, 18 nt, Artificial Sequence
  Description of Artificial Sequence: Synthetic oligonucleotide
cugugaaauagccacaac

SEQ ID NO: 61078 - RNA, 18 nt, Artificial Sequence
  Description of Artificial Sequence: Synthetic oligonucleotide
cuucucugugaaauagcc

SEQ ID NO: 61079 - RNA, 18 nt, Artificial Sequence
  Description of Artificial Sequence: Synthetic oligonucleotide
ugcugcuucucugugaaa

SEQ ID NO: 61080 - RNA, 18 nt, Artificial Sequence
  Description of Artificial Sequence: Synthetic oligonucleotide
cuagcugcugcuucucug

SEQ ID NO: 61081 - RNA, 18 nt, Artificial Sequence
  Description of Artificial Sequence: Synthetic oligonucleotide
ucugucuagcugcugcuu

SEQ ID NO: 61082 - RNA, 18 nt, Artificial Sequence
  Description of Artificial Sequence: Synthetic oligonucleotide
gggagucugucuagcugc

SEQ ID NO: 61083 - RNA, 18 nt, Artificial Sequence
  Description of Artificial Sequence: Synthetic oligonucleotide
cagaugggagucugucua

SEQ ID NO: 61084 - RNA, 18 nt, Artificial Sequence
  Description of Artificial Sequence: Synthetic oligonucleotide
auuuacagaugggagucu

SEQ ID NO: 61085 - RNA, 18 nt, Artificial Sequence
  Description of Artificial Sequence: Synthetic oligonucleotide
uguuuauuuacagauggg

SEQ ID NO: 61086 - RNA, 18 nt, Artificial Sequence
  Description of Artificial Sequence: Synthetic oligonucleotide
ucucuuguuuauuuacag

SEQ ID NO: 61087 - RNA, 18 nt, Artificial Sequence
  Description of Artificial Sequence: Synthetic oligonucleotide
uccuaucucuuguuuauu

SEQ ID NO: 61088 - RNA, 18 nt, Artificial Sequence
  Description of Artificial Sequence: Synthetic oligonucleotide
ccucuuccuaucucuugu

SEQ ID NO: 61089 - RNA, 18 nt, Artificial Sequence
  Description of Artificial Sequence: Synthetic oligonucleotide
uucccccucuuccuaucu

SEQ ID NO: 61090 - RNA, 18 nt, Artificial Sequence
  Description of Artificial Sequence: Synthetic oligonucleotide
ucuauuucccccucuucc

SEQ ID NO: 61091 - RNA, 18 nt, Artificial Sequence
  Description of Artificial Sequence: Synthetic oligonucleotide
ccaaaucuauuucccccu

SEQ ID NO: 61092 - RNA, 18 nt, Artificial Sequence
  Description of Artificial Sequence: Synthetic oligonucleotide
cuccuccaaaucuauuuc

SEQ ID NO: 61093 - RNA, 18 nt, Artificial Sequence
  Description of Artificial Sequence: Synthetic oligonucleotide
gcugccuccuccaaaucu

SEQ ID NO: 61094 - RNA, 18 nt, Artificial Sequence
  Description of Artificial Sequence: Synthetic oligonucleotide
guagggcugccuccucca

SEQ ID NO: 61095 - RNA, 18 nt, Artificial Sequence
  Description of Artificial Sequence: Synthetic oligonucleotide
gaaauguagggcugccuc

SEQ ID NO: 61096 - RNA, 18 nt, Artificial Sequence
  Description of Artificial Sequence: Synthetic oligonucleotide
uguuugaaauguagggcu

SEQ ID NO: 61097 - RNA, 18 nt, Artificial Sequence
  Description of Artificial Sequence: Synthetic oligonucleotide
auguauguuugaaaugua

SEQ ID NO: 61098 - RNA, 18 nt, Artificial Sequence
  Description of Artificial Sequence: Synthetic oligonucleotide
agggaauguauguuugaa

SEQ ID NO: 61099 - RNA, 18 nt, Artificial Sequence
  Description of Artificial Sequence: Synthetic oligonucleotide
aaaaaagggaauguaugu

SEQ ID NO: 61100 - RNA, 18 nt, Artificial Sequence
  Description of Artificial Sequence: Synthetic oligonucleotide
aaucuaaaaaagggaaug

SEQ ID NO: 61101 - RNA, 18 nt, Artificial Sequence
  Description of Artificial Sequence: Synthetic oligonucleotide
aaaaaaaucuaaaaaagg

SEQ ID NO: 61102 - RNA, 18 nt, Artificial Sequence
  Description of Artificial Sequence: Synthetic oligonucleotide
aaaaaaaaaaaaucuaaa

SEQ ID NO: 61103 - RNA, 18 nt, Artificial Sequence
  Description of Artificial Sequence: Synthetic oligonucleotide
aaaaaaaaaaaaaaaaau

SEQ ID NO: 61104 - RNA, 18 nt, Artificial Sequence
  Description of Artificial Sequence: Synthetic oligonucleotide
accaaaaaaaaaaaaaaa

SEQ ID NO: 61105 - RNA, 18 nt, Artificial Sequence
  Description of Artificial Sequence: Synthetic oligonucleotide
ugaaaaccaaaaaaaaaa

SEQ ID NO: 61106 - RNA, 18 nt, Artificial Sequence
  Description of Artificial Sequence: Synthetic oligonucleotide
aaaacugaaaaccaaaaa

SEQ ID NO: 61107 - RNA, 18 nt, Artificial Sequence
  Description of Artificial Sequence: Synthetic oligonucleotide
ccaucaaaacugaaaacc

SEQ ID NO: 61108 - RNA, 18 nt, Artificial Sequence
  Description of Artificial Sequence: Synthetic oligonucleotide
ucccaccaucaaaacuga

SEQ ID NO: 61109 - RNA, 18 nt, Artificial Sequence
  Description of Artificial Sequence: Synthetic oligonucleotide
uccaaucccaccaucaaa

SEQ ID NO: 61110 - RNA, 18 nt, Artificial Sequence
  Description of Artificial Sequence: Synthetic oligonucleotide
uauuuuccaaucccacca

SEQ ID NO: 61111 - RNA, 18 nt, Artificial Sequence
  Description of Artificial Sequence: Synthetic oligonucleotide
agcucuauuuuccaaucc

SEQ ID NO: 61112 - RNA, 18 nt, Artificial Sequence
  Description of Artificial Sequence: Synthetic oligonucleotide
agccaagcucuauuuucc

SEQ ID NO: 61113 - RNA, 18 nt, Artificial Sequence
  Description of Artificial Sequence: Synthetic oligonucleotide
ccucaagccaagcucuau

SEQ ID NO: 61114 - RNA, 18 nt, Artificial Sequence
  Description of Artificial Sequence: Synthetic oligonucleotide
aauguccucaagccaagc

SEQ ID NO: 61115 - RNA, 18 nt, Artificial Sequence
  Description of Artificial Sequence: Synthetic oligonucleotide
aggaaaauguccucaagc

SEQ ID NO: 61116 - RNA, 18 nt, Artificial Sequence
  Description of Artificial Sequence: Synthetic oligonucleotide
accccaggaaaauguccu

SEQ ID NO: 61117 - RNA, 18 nt, Artificial Sequence
  Description of Artificial Sequence: Synthetic oligonucleotide
gugccaccccaggaaaau

SEQ ID NO: 61118 - RNA, 18 nt, Artificial Sequence
  Description of Artificial Sequence: Synthetic oligonucleotide
uaauggugccaccccagg

SEQ ID NO: 61119 - RNA, 18 nt, Artificial Sequence
  Description of Artificial Sequence: Synthetic oligonucleotide
agaaauaauggugccacc

SEQ ID NO: 61120 - RNA, 18 nt, Artificial Sequence
  Description of Artificial Sequence: Synthetic oligonucleotide
uuucaagaaauaauggug

SEQ ID NO: 61121 - RNA, 18 nt, Artificial Sequence
  Description of Artificial Sequence: Synthetic oligonucleotide
uucuauuucaagaaauaa

SEQ ID NO: 61122 - RNA, 18 nt, Artificial Sequence
  Description of Artificial Sequence: Synthetic oligonucleotide
uaagauucuauuucaaga

SEQ ID NO: 61123 - RNA, 18 nt, Artificial Sequence
  Description of Artificial Sequence: Synthetic oligonucleotide
auaaguaagauucuauuu

SEQ ID NO: 61124 - RNA, 18 nt, Artificial Sequence
  Description of Artificial Sequence: Synthetic oligonucleotide
ucaccauaaguaagauuc

SEQ ID NO: 61125 - RNA, 18 nt, Artificial Sequence
  Description of Artificial Sequence: Synthetic oligonucleotide
cagugucaccauaaguaa

SEQ ID NO: 61126 - RNA, 18 nt, Artificial Sequence
  Description of Artificial Sequence: Synthetic oligonucleotide
cuugccagugucaccaua

SEQ ID NO: 61127 - RNA, 18 nt, Artificial Sequence
  Description of Artificial Sequence: Synthetic oligonucleotide
aagugcuugccaguguca

SEQ ID NO: 61128 - RNA, 18 nt, Artificial Sequence
  Description of Artificial Sequence: Synthetic oligonucleotide
cucacaagugcuugccag

SEQ ID NO: 61129 - RNA, 18 nt, Artificial Sequence
  Description of Artificial Sequence: Synthetic oligonucleotide
agguucucacaagugcuu

SEQ ID NO: 61130 - RNA, 18 nt, Artificial Sequence
  Description of Artificial Sequence: Synthetic oligonucleotide
ucuucagguucucacaag

SEQ ID NO: 61131 - RNA, 18 nt, Artificial Sequence
  Description of Artificial Sequence: Synthetic oligonucleotide
auccgucuucagguucuc

SEQ ID NO: 61132 - RNA, 18 nt, Artificial Sequence
  Description of Artificial Sequence: Synthetic oligonucleotide
ccucaauccgucuucagg

SEQ ID NO: 61133 - RNA, 18 nt, Artificial Sequence
  Description of Artificial Sequence: Synthetic oligonucleotide
aaugaccucaauccgucu

SEQ ID NO: 61134 - RNA, 18 nt, Artificial Sequence
  Description of Artificial Sequence: Synthetic oligonucleotide
caucaaaugaccucaauc

SEQ ID NO: 61135 - RNA, 18 nt, Artificial Sequence
  Description of Artificial Sequence: Synthetic oligonucleotide
cugagcaucaaaugaccu

SEQ ID NO: 61136 - RNA, 18 nt, Artificial Sequence
  Description of Artificial Sequence: Synthetic oligonucleotide
aacuucugagcaucaaau

SEQ ID NO: 61137 - RNA, 18 nt, Artificial Sequence
  Description of Artificial Sequence: Synthetic oligonucleotide
cacccaacuucugagcau

SEQ ID NO: 61138 - RNA, 18 nt, Artificial Sequence
  Description of Artificial Sequence: Synthetic oligonucleotide
cccagcacccaacuucug

SEQ ID NO: 61139 - RNA, 18 nt, Artificial Sequence
  Description of Artificial Sequence: Synthetic oligonucleotide
agggacccagcacccaac

SEQ ID NO: 61140 - RNA, 18 nt, Artificial Sequence
  Description of Artificial Sequence: Synthetic oligonucleotide
aaggcagggacccagcac

SEQ ID NO: 61141 - RNA, 18 nt, Artificial Sequence
  Description of Artificial Sequence: Synthetic oligonucleotide
cugagaaggcagggaccc

SEQ ID NO: 61142 - RNA, 18 nt, Artificial Sequence
  Description of Artificial Sequence: Synthetic oligonucleotide
ucggacugagaaggcagg

SEQ ID NO: 61143 - RNA, 18 nt, Artificial Sequence
  Description of Artificial Sequence: Synthetic oligonucleotide
agaacucggacugagaag

SEQ ID NO: 61144 - RNA, 18 nt, Artificial Sequence
  Description of Artificial Sequence: Synthetic oligonucleotide
aaaggagaacucggacug

SEQ ID NO: 61145 - RNA, 18 nt, Artificial Sequence
  Description of Artificial Sequence: Synthetic oligonucleotide
aaaugaaaggagaacucg

SEQ ID NO: 61146 - RNA, 18 nt, Artificial Sequence
  Description of Artificial Sequence: Synthetic oligonucleotide
cccaaaaaugaaaggaga

SEQ ID NO: 61147 - RNA, 18 nt, Artificial Sequence
  Description of Artificial Sequence: Synthetic oligonucleotide
ccccacccaaaaaugaaa

SEQ ID NO: 61148 - RNA, 18 nt, Artificial Sequence
  Description of Artificial Sequence: Synthetic oligonucleotide
cgccuccccacccaaaaa

SEQ ID NO: 61149 - RNA, 18 nt, Artificial Sequence
  Description of Artificial Sequence: Synthetic oligonucleotide
gaacccgccuccccaccc

SEQ ID NO: 61150 - RNA, 18 nt, Artificial Sequence
  Description of Artificial Sequence: Synthetic oligonucleotide
ucuuggaacccgccuccc

SEQ ID NO: 61151 - RNA, 18 nt, Artificial Sequence
  Description of Artificial Sequence: Synthetic oligonucleotide
agggcucuuggaacccgc

SEQ ID NO: 61152 - RNA, 18 nt, Artificial Sequence
  Description of Artificial Sequence: Synthetic oligonucleotide
aaugaagggcucuuggaa

SEQ ID NO: 61153 - RNA, 18 nt, Artificial Sequence
  Description of Artificial Sequence: Synthetic oligonucleotide
ccaccaaugaagggcucu

SEQ ID NO: 61154 - RNA, 18 nt, Artificial Sequence
  Description of Artificial Sequence: Synthetic oligonucleotide
gaacuccaccaaugaagg

SEQ ID NO: 61155 - RNA, 18 nt, Artificial Sequence
  Description of Artificial Sequence: Synthetic oligonucleotide
cuugugaacuccaccaau

SEQ ID NO: 61156 - RNA, 18 nt, Artificial Sequence
  Description of Artificial Sequence: Synthetic oligonucleotide
cuugccuugugaacucca

SEQ ID NO: 61157 - RNA, 18 nt, Artificial Sequence
  Description of Artificial Sequence: Synthetic oligonucleotide
uacaccuugccuugugaa

SEQ ID NO: 61158 - RNA, 18 nt, Artificial Sequence
  Description of Artificial Sequence: Synthetic oligonucleotide
uuuuuuacaccuugccuu

SEQ ID NO: 61159 - RNA, 18 nt, Artificial Sequence
  Description of Artificial Sequence: Synthetic oligonucleotide
cuuuuuuuuuuacaccuu

SEQ ID NO: 61160 - RNA, 18 nt, Artificial Sequence
  Description of Artificial Sequence: Synthetic oligonucleotide
cccuacuuuuuuuuuuac

SEQ ID NO: 61161 - RNA, 18 nt, Artificial Sequence
  Description of Artificial Sequence: Synthetic oligonucleotide
uccugcccuacuuuuuuu

SEQ ID NO: 61162 - RNA, 18 nt, Artificial Sequence
  Description of Artificial Sequence: Synthetic oligonucleotide
ugucuuccugcccuacuu

SEQ ID NO: 61163 - RNA, 18 nt, Artificial Sequence
  Description of Artificial Sequence: Synthetic oligonucleotide
accacugucuuccugccc

SEQ ID NO: 61164 - RNA, 18 nt, Artificial Sequence
  Description of Artificial Sequence: Synthetic oligonucleotide
agcacaccacugucuucc

SEQ ID NO: 61165 - RNA, 18 nt, Artificial Sequence
  Description of Artificial Sequence: Synthetic oligonucleotide
cugccagcacaccacugu

SEQ ID NO: 61166 - RNA, 18 nt, Artificial Sequence
  Description of Artificial Sequence: Synthetic oligonucleotide
gaccucugccagcacacc

SEQ ID NO: 61167 - RNA, 18 nt, Artificial Sequence
  Description of Artificial Sequence: Synthetic oligonucleotide
uguuagaccucugccagc

SEQ ID NO: 61168 - RNA, 18 nt, Artificial Sequence
  Description of Artificial Sequence: Synthetic oligonucleotide
cccauuguuagaccucug

SEQ ID NO: 61169 - RNA, 18 nt, Artificial Sequence
  Description of Artificial Sequence: Synthetic oligonucleotide
gagagcccauuguuagac

SEQ ID NO: 61170 - RNA, 18 nt, Artificial Sequence
  Description of Artificial Sequence: Synthetic oligonucleotide
ccuuggagagcccauugu

SEQ ID NO: 61171 - RNA, 18 nt, Artificial Sequence
  Description of Artificial Sequence: Synthetic oligonucleotide
cucuuccuuggagagccc

SEQ ID NO: 61172 - RNA, 18 nt, Artificial Sequence
  Description of Artificial Sequence: Synthetic oligonucleotide
uuuuccucuuccuuggag

SEQ ID NO: 61173 - RNA, 18 nt, Artificial Sequence
  Description of Artificial Sequence: Synthetic oligonucleotide
caaccuuuuccucuuccu

SEQ ID NO: 61174 - RNA, 18 nt, Artificial Sequence
  Description of Artificial Sequence: Synthetic oligonucleotide
acaaccaaccuuuuccuc

SEQ ID NO: 61175 - RNA, 18 nt, Artificial Sequence
  Description of Artificial Sequence: Synthetic oligonucleotide
acuccacaaccaaccuuu

SEQ ID NO: 61176 - RNA, 18 nt, Artificial Sequence
  Description of Artificial Sequence: Synthetic oligonucleotide
caaacacuccacaaccaa

SEQ ID NO: 61177 - RNA, 18 nt, Artificial Sequence
  Description of Artificial Sequence: Synthetic oligonucleotide
acugacaaacacuccaca

SEQ ID NO: 61178 - RNA, 18 nt, Artificial Sequence
  Description of Artificial Sequence: Synthetic oligonucleotide
cggaaacugacaaacacu

SEQ ID NO: 61179 - RNA, 18 nt, Artificial Sequence
  Description of Artificial Sequence: Synthetic oligonucleotide
caccacggaaacugacaa

SEQ ID NO: 61180 - RNA, 18 nt, Artificial Sequence
  Description of Artificial Sequence: Synthetic oligonucleotide
auuuacaccacggaaacu

SEQ ID NO: 61181 - RNA, 18 nt, Artificial Sequence
  Description of Artificial Sequence: Synthetic oligonucleotide
ggaguauuuacaccacgg

SEQ ID NO: 61182 - RNA, 18 nt, Artificial Sequence
  Description of Artificial Sequence: Synthetic oligonucleotide
uggugggaguauuuacac

SEQ ID NO: 61183 - RNA, 18 nt, Artificial Sequence
  Description of Artificial Sequence: Synthetic oligonucleotide
agccguggugggaguauu

SEQ ID NO: 61184 - RNA, 18 nt, Artificial Sequence
  Description of Artificial Sequence: Synthetic oligonucleotide
aagucagccgugguggga

SEQ ID NO: 61185 - RNA, 18 nt, Artificial Sequence
  Description of Artificial Sequence: Synthetic oligonucleotide
gcuugaagucagccgugg

SEQ ID NO: 61186 - RNA, 18 nt, Artificial Sequence
  Description of Artificial Sequence: Synthetic oligonucleotide
ugcuagcuugaagucagc

SEQ ID NO: 61187 - RNA, 18 nt, Artificial Sequence
  Description of Artificial Sequence: Synthetic oligonucleotide
ccgguugcuagcuugaag

SEQ ID NO: 61188 - RNA, 18 nt, Artificial Sequence
  Description of Artificial Sequence: Synthetic oligonucleotide
gaccuccgguugcuagcu

SEQ ID NO: 61189 - RNA, 18 nt, Artificial Sequence
  Description of Artificial Sequence: Synthetic oligonucleotide
ucagugaccuccgguugc

SEQ ID NO: 61190 - RNA, 18 nt, Artificial Sequence
  Description of Artificial Sequence: Synthetic oligonucleotide
uuaguucagugaccuccg

SEQ ID NO: 61191 - RNA, 18 nt, Artificial Sequence
  Description of Artificial Sequence: Synthetic oligonucleotide
aacucuuaguucagugac

SEQ ID NO: 61192 - RNA, 18 nt, Artificial Sequence
  Description of Artificial Sequence: Synthetic oligonucleotide
uucccaacucuuaguuca

SEQ ID NO: 61193 - RNA, 18 nt, Artificial Sequence
  Description of Artificial Sequence: Synthetic oligonucleotide
aucucuucccaacucuua

SEQ ID NO: 61194 - RNA, 18 nt, Artificial Sequence
  Description of Artificial Sequence: Synthetic oligonucleotide
gcccuaucucuucccaac

SEQ ID NO: 61195 - RNA, 18 nt, Artificial Sequence
  Description of Artificial Sequence: Synthetic oligonucleotide
auugugcccuaucucuuc

SEQ ID NO: 61196 - RNA, 18 nt, Artificial Sequence
  Description of Artificial Sequence: Synthetic oligonucleotide
cauauauugugcccuauc

SEQ ID NO: 61197 - RNA, 18 nt, Artificial Sequence
  Description of Artificial Sequence: Synthetic oligonucleotide
guaagcauauauugugcc

SEQ ID NO: 61198 - RNA, 18 nt, Artificial Sequence
  Description of Artificial Sequence: Synthetic oligonucleotide
aacucguaagcauauauu

SEQ ID NO: 61199 - RNA, 18 nt, Artificial Sequence
  Description of Artificial Sequence: Synthetic oligonucleotide
guaccaacucguaagcau

SEQ ID NO: 61200 - RNA, 18 nt, Artificial Sequence
  Description of Artificial Sequence: Synthetic oligonucleotide
gguguguaccaacucgua

SEQ ID NO: 61201 - RNA, 18 nt, Artificial Sequence
  Description of Artificial Sequence: Synthetic oligonucleotide
cugacgguguguaccaac

SEQ ID NO: 61202 - RNA, 18 nt, Artificial Sequence
  Description of Artificial Sequence: Synthetic oligonucleotide
ugcugcugacggugugua

SEQ ID NO: 61203 - RNA, 18 nt, Artificial Sequence
  Description of Artificial Sequence: Synthetic oligonucleotide
cuggcugcugcugacggu

SEQ ID NO: 61204 - RNA, 18 nt, Artificial Sequence
  Description of Artificial Sequence: Synthetic oligonucleotide
ugacccuggcugcugcug

SEQ ID NO: 61205 - RNA, 18 nt, Artificial Sequence
  Description of Artificial Sequence: Synthetic oligonucleotide
ucuccugacccuggcugc

SEQ ID NO: 61206 - RNA, 18 nt, Artificial Sequence
  Description of Artificial Sequence: Synthetic oligonucleotide
gccuuucuccugacccug

SEQ ID NO: 61207 - RNA, 18 nt, Artificial Sequence
  Description of Artificial Sequence: Synthetic oligonucleotide
aucucgccuuucuccuga

SEQ ID NO: 61208 - RNA, 18 nt, Artificial Sequence
  Description of Artificial Sequence: Synthetic oligonucleotide
uucacaucucgccuuucu

SEQ ID NO: 61209 - RNA, 18 nt, Artificial Sequence
  Description of Artificial Sequence: Synthetic oligonucleotide
cucucuucacaucucgcc

SEQ ID NO: 61210 - RNA, 18 nt, Artificial Sequence
  Description of Artificial Sequence: Synthetic oligonucleotide
ccggccucucuucacauc

SEQ ID NO: 61211 - RNA, 18 nt, Artificial Sequence
  Description of Artificial Sequence: Synthetic oligonucleotide
accucccggccucucuuc

SEQ ID NO: 61212 - RNA, 18 nt, Artificial Sequence
  Description of Artificial Sequence: Synthetic oligonucleotide
cugauaccucccggccuc

SEQ ID NO: 61213 - RNA, 18 nt, Artificial Sequence
  Description of Artificial Sequence: Synthetic oligonucleotide
gucaucugauaccucccg

SEQ ID NO: 61214 - RNA, 18 nt, Artificial Sequence
  Description of Artificial Sequence: Synthetic oligonucleotide
gaaacgucaucugauacc

SEQ ID NO: 61215 - RNA, 18 nt, Artificial Sequence
  Description of Artificial Sequence: Synthetic oligonucleotide
ugcuggaaacgucaucug

SEQ ID NO: 61216 - RNA, 18 nt, Artificial Sequence
  Description of Artificial Sequence: Synthetic oligonucleotide
ucuagugcuggaaacguc

SEQ ID NO: 61217 - RNA, 18 nt, Artificial Sequence
  Description of Artificial Sequence: Synthetic oligonucleotide
ucuggucuagugcuggaa

SEQ ID NO: 61218 - RNA, 18 nt, Artificial Sequence
  Description of Artificial Sequence: Synthetic oligonucleotide
ccucuucuggucuagugc

SEQ ID NO: 61219 - RNA, 18 nt, Artificial Sequence
  Description of Artificial Sequence: Synthetic oligonucleotide
gugcaccucuucuggucu

SEQ ID NO: 61220 - RNA, 18 nt, Artificial Sequence
  Description of Artificial Sequence: Synthetic oligonucleotide
gcugugugcaccucuucu

SEQ ID NO: 61221 - RNA, 18 nt, Artificial Sequence
  Description of Artificial Sequence: Synthetic oligonucleotide
ucuaggcugugugcaccu

SEQ ID NO: 61222 - RNA, 18 nt, Artificial Sequence
  Description of Artificial Sequence: Synthetic oligonucleotide
gggucuaggcugugugca

SEQ ID NO: 61223 - RNA, 18 nt, Artificial Sequence
  Description of Artificial Sequence: Synthetic oligonucleotide
aggguguaccccucaggg

SEQ ID NO: 61224 - RNA, 18 nt, Artificial Sequence
  Description of Artificial Sequence: Synthetic oligonucleotide
agaucaggguguaccccu

SEQ ID NO: 61225 - RNA, 18 nt, Artificial Sequence
  Description of Artificial Sequence: Synthetic oligonucleotide
ucuagagaucagggugua

SEQ ID NO: 61226 - RNA, 18 nt, Artificial Sequence
  Description of Artificial Sequence: Synthetic oligonucleotide
ugggcucuagagaucagg

SEQ ID NO: 61227 - RNA, 18 nt, Artificial Sequence
  Description of Artificial Sequence: Synthetic oligonucleotide
cuuugugggcucuagaga

SEQ ID NO: 61228 - RNA, 18 nt, Artificial Sequence
  Description of Artificial Sequence: Synthetic oligonucleotide
aaccucuuugugggcucu

SEQ ID NO: 61229 - RNA, 18 nt, Artificial Sequence
  Description of Artificial Sequence: Synthetic oligonucleotide
auaaaaaccucuuugugg

SEQ ID NO: 61230 - RNA, 18 nt, Artificial Sequence
  Description of Artificial Sequence: Synthetic oligonucleotide
guugaauaaaaaccucuu

SEQ ID NO: 61231 - RNA, 18 nt, Artificial Sequence
  Description of Artificial Sequence: Synthetic oligonucleotide
uuuauguugaauaaaaac

SEQ ID NO: 61232 - RNA, 18 nt, Artificial Sequence
  Description of Artificial Sequence: Synthetic oligonucleotide
cacguuuuauguugaaua

SEQ ID NO: 61233 - RNA, 18 nt, Artificial Sequence
  Description of Artificial Sequence: Synthetic oligonucleotide
augaacacguuuuauguu

SEQ ID NO: 61234 - RNA, 18 nt, Artificial Sequence
  Description of Artificial Sequence: Synthetic oligonucleotide
gagagaugaacacguuuu

SEQ ID NO: 61235 - RNA, 18 nt, Artificial Sequence
  Description of Artificial Sequence: Synthetic oligonucleotide
ccuaugagagaugaacac

SEQ ID NO: 61236 - RNA, 18 nt, Artificial Sequence
  Description of Artificial Sequence: Synthetic oligonucleotide
ucaggccuaugagagaug

SEQ ID NO: 61237 - RNA, 18 nt, Artificial Sequence
  Description of Artificial Sequence: Synthetic oligonucleotide
augacucaggccuaugag

SEQ ID NO: 61238 - RNA, 18 nt, Artificial Sequence
  Description of Artificial Sequence: Synthetic oligonucleotide
ccagcaugacucaggccu

SEQ ID NO: 61239 - RNA, 18 nt, Artificial Sequence
  Description of Artificial Sequence: Synthetic oligonucleotide
agaacccagcaugacuca

SEQ ID NO: 61240 - RNA, 18 nt, Artificial Sequence
  Description of Artificial Sequence: Synthetic oligonucleotide
gucccagaacccagcaug

SEQ ID NO: 61241 - RNA, 18 nt, Artificial Sequence
  Description of Artificial Sequence: Synthetic oligonucleotide
uuaaugucccagaaccca

SEQ ID NO: 61242 - RNA, 18 nt, Artificial Sequence
  Description of Artificial Sequence: Synthetic oligonucleotide
ugggcuuaaugucccaga

SEQ ID NO: 61243 - RNA, 18 nt, Artificial Sequence
  Description of Artificial Sequence: Synthetic oligonucleotide
acuccugggcuuaauguc

SEQ ID NO: 61244 - RNA, 18 nt, Artificial Sequence
  Description of Artificial Sequence: Synthetic oligonucleotide
ggcccacuccugggcuua

SEQ ID NO: 61245 - RNA, 18 nt, Artificial Sequence
  Description of Artificial Sequence: Synthetic oligonucleotide
cacccggcccacuccugg

SEQ ID NO: 61246 - RNA, 18 nt, Artificial Sequence
  Description of Artificial Sequence: Synthetic oligonucleotide
caccgcacccggcccacu

SEQ ID NO: 61247 - RNA, 18 nt, Artificial Sequence
  Description of Artificial Sequence: Synthetic oligonucleotide
ugagccaccgcacccggc

SEQ ID NO: 61248 - RNA, 18 nt, Artificial Sequence
  Description of Artificial Sequence: Synthetic oligonucleotide
aggcgugagccaccgcac

SEQ ID NO: 61249 - RNA, 18 nt, Artificial Sequence
  Description of Artificial Sequence: Synthetic oligonucleotide
auuacaggcgugagccac

SEQ ID NO: 61250 - RNA, 18 nt, Artificial Sequence
  Description of Artificial Sequence: Synthetic oligonucleotide
cugggauuacaggcguga

SEQ ID NO: 61251 - RNA, 18 nt, Artificial Sequence
  Description of Artificial Sequence: Synthetic oligonucleotide
aagugcugggauuacagg

SEQ ID NO: 61252 - RNA, 18 nt, Artificial Sequence
  Description of Artificial Sequence: Synthetic oligonucleotide
ucccaaagugcugggauu

SEQ ID NO: 61253 - RNA, 18 nt, Artificial Sequence
  Description of Artificial Sequence: Synthetic oligonucleotide
cggccucccaaagugcug

SEQ ID NO: 61254 - RNA, 18 nt, Artificial Sequence
  Description of Artificial Sequence: Synthetic oligonucleotide
cgccucggccucccaaag

SEQ ID NO: 61255 - RNA, 18 nt, Artificial Sequence
  Description of Artificial Sequence: Synthetic oligonucleotide
ccacccgccucggccucc

SEQ ID NO: 61256 - RNA, 18 nt, Artificial Sequence
  Description of Artificial Sequence: Synthetic oligonucleotide
gugauccacccgccucgg

SEQ ID NO: 61257 - RNA, 18 nt, Artificial Sequence
  Description of Artificial Sequence: Synthetic oligonucleotide
cucaggugauccacccgc

SEQ ID NO: 61258 - RNA, 18 nt, Artificial Sequence
  Description of Artificial Sequence: Synthetic oligonucleotide
cugaccucaggugaucca

SEQ ID NO: 61259 - RNA, 18 nt, Artificial Sequence
  Description of Artificial Sequence: Synthetic oligonucleotide
aacuccugaccucaggug

SEQ ID NO: 61260 - RNA, 18 nt, Artificial Sequence
  Description of Artificial Sequence: Synthetic oligonucleotide
ucucgaacuccugaccuc

SEQ ID NO: 61261 - RNA, 18 nt, Artificial Sequence
  Description of Artificial Sequence: Synthetic oligonucleotide
gcuggucucgaacuccug

SEQ ID NO: 61262 - RNA, 18 nt, Artificial Sequence
  Description of Artificial Sequence: Synthetic oligonucleotide
gccaggcuggucucgaac

SEQ ID NO: 61263 - RNA, 18 nt, Artificial Sequence
  Description of Artificial Sequence: Synthetic oligonucleotide
uguuggccaggcuggucu

SEQ ID NO: 61264 - RNA, 18 nt, Artificial Sequence
  Description of Artificial Sequence: Synthetic oligonucleotide
caccauguuggccaggcu

SEQ ID NO: 61265 - RNA, 18 nt, Artificial Sequence
  Description of Artificial Sequence: Synthetic oligonucleotide
gguuucaccauguuggcc

SEQ ID NO: 61266 - RNA, 18 nt, Artificial Sequence
  Description of Artificial Sequence: Synthetic oligonucleotide
gacaggguuucaccaugu

SEQ ID NO: 61267 - RNA, 18 nt, Artificial Sequence
  Description of Artificial Sequence: Synthetic oligonucleotide
guagagacaggguuucac

SEQ ID NO: 61268 - RNA, 18 nt, Artificial Sequence
  Description of Artificial Sequence: Synthetic oligonucleotide
uauuaguagagacagggu

SEQ ID NO: 61269 - RNA, 18 nt, Artificial Sequence
  Description of Artificial Sequence: Synthetic oligonucleotide
uguauuauuaguagagac

SEQ ID NO: 61270 - RNA, 18 nt, Artificial Sequence
  Description of Artificial Sequence: Synthetic oligonucleotide
auuuuuguauuauuagua

SEQ ID NO: 61271 - RNA, 18 nt, Artificial Sequence
  Description of Artificial Sequence: Synthetic oligonucleotide
ggcuaauuuuuguauuau

SEQ ID NO: 61272 - RNA, 18 nt, Artificial Sequence
  Description of Artificial Sequence: Synthetic oligonucleotide
ugcccggcuaauuuuugu

SEQ ID NO: 61273 - RNA, 18 nt, Artificial Sequence
  Description of Artificial Sequence: Synthetic oligonucleotide
caccaugcccggcuaauu

SEQ ID NO: 61274 - RNA, 18 nt, Artificial Sequence
  Description of Artificial Sequence: Synthetic oligonucleotide
cgugccaccaugcccggc

SEQ ID NO: 61275 - RNA, 18 nt, Artificial Sequence
  Description of Artificial Sequence: Synthetic oligonucleotide
aggcgcgugccaccaugc

SEQ ID NO: 61276 - RNA, 18 nt, Artificial Sequence
  Description of Artificial Sequence: Synthetic oligonucleotide
auuacaggcgcgugccac

SEQ ID NO: 61277 - RNA, 18 nt, Artificial Sequence
  Description of Artificial Sequence: Synthetic oligonucleotide
cugggauuacaggcgcgu

SEQ ID NO: 61278 - RNA, 18 nt, Artificial Sequence
  Description of Artificial Sequence: Synthetic oligonucleotide
aguagcugggauuacagg

SEQ ID NO: 61279 - RNA, 18 nt, Artificial Sequence
  Description of Artificial Sequence: Synthetic oligonucleotide
ucccgaguagcugggauu

SEQ ID NO: 61280 - RNA, 18 nt, Artificial Sequence
  Description of Artificial Sequence: Synthetic oligonucleotide
cagccucccgaguagcug

SEQ ID NO: 61281 - RNA, 18 nt, Artificial Sequence
  Description of Artificial Sequence: Synthetic oligonucleotide
ugccucagccucccgagu

SEQ ID NO: 61282 - RNA, 18 nt, Artificial Sequence
  Description of Artificial Sequence: Synthetic oligonucleotide
ucuccugccucagccucc

SEQ ID NO: 61283 - RNA, 18 nt, Artificial Sequence
  Description of Artificial Sequence: Synthetic oligonucleotide
gcaauucuccugccucag

SEQ ID NO: 61284 - RNA, 18 nt, Artificial Sequence
  Description of Artificial Sequence: Synthetic oligonucleotide
uuccagcaauucuccugc

SEQ ID NO: 61285 - RNA, 18 nt, Artificial Sequence
  Description of Artificial Sequence: Synthetic oligonucleotide
ccggguuccagcaauucu

SEQ ID NO: 61286 - RNA, 18 nt, Artificial Sequence
  Description of Artificial Sequence: Synthetic oligonucleotide
gccucccggguuccagca

SEQ ID NO: 61287 - RNA, 18 nt, Artificial Sequence
  Description of Artificial Sequence: Synthetic oligonucleotide
ccuccgccucccggguuc

SEQ ID NO: 61288 - RNA, 18 nt, Artificial Sequence
  Description of Artificial Sequence: Synthetic oligonucleotide
uucaaccuccgccucccg

SEQ ID NO: 61289 - RNA, 18 nt, Artificial Sequence
  Description of Artificial Sequence: Synthetic oligonucleotide
cucucuucaaccuccgcc

SEQ ID NO: 61290 - RNA, 18 nt, Artificial Sequence
  Description of Artificial Sequence: Synthetic oligonucleotide
cucugcucucuucaaccu

SEQ ID NO: 61291 - RNA, 18 nt, Artificial Sequence
  Description of Artificial Sequence: Synthetic oligonucleotide
acaaucucugcucucuuc

SEQ ID NO: 61292 - RNA, 18 nt, Artificial Sequence
  Description of Artificial Sequence: Synthetic oligonucleotide
guggcacaaucucugcuc

SEQ ID NO: 61293 - RNA, 18 nt, Artificial Sequence
  Description of Artificial Sequence: Synthetic oligonucleotide
gcacaguggcacaaucuc

SEQ ID NO: 61294 - RNA, 18 nt, Artificial Sequence
  Description of Artificial Sequence: Synthetic oligonucleotide
cuagagcacaguggcaca

SEQ ID NO: 61295 - RNA, 18 nt, Artificial Sequence
  Description of Artificial Sequence: Synthetic oligonucleotide
ccaggcuagagcacagug

SEQ ID NO: 61296 - RNA, 18 nt, Artificial Sequence
  Description of Artificial Sequence: Synthetic oligonucleotide
gugacccaggcuagagca

SEQ ID NO: 61297 - RNA, 18 nt, Artificial Sequence
  Description of Artificial Sequence: Synthetic oligonucleotide
cucuugugacccaggcua

SEQ ID NO: 61298 - RNA, 18 nt, Artificial Sequence
  Description of Artificial Sequence: Synthetic oligonucleotide
uuucgcucuugugaccca

SEQ ID NO: 61299 - RNA, 18 nt, Artificial Sequence
  Description of Artificial Sequence: Synthetic oligonucleotide
cggaguuucgcucuugug

SEQ ID NO: 61300 - RNA, 18 nt, Artificial Sequence
  Description of Artificial Sequence: Synthetic oligonucleotide
ugagacggaguuucgcuc

SEQ ID NO: 61301 - RNA, 18 nt, Artificial Sequence
  Description of Artificial Sequence: Synthetic oligonucleotide
auuauugagacggaguuu

SEQ ID NO: 61302 - RNA, 18 nt, Artificial Sequence
  Description of Artificial Sequence: Synthetic oligonucleotide
uuguuauuauugagacgg

SEQ ID NO: 61303 - RNA, 18 nt, Artificial Sequence
  Description of Artificial Sequence: Synthetic oligonucleotide
uguuguuguuauuauuga

SEQ ID NO: 61304 - RNA, 18 nt, Artificial Sequence
  Description of Artificial Sequence: Synthetic oligonucleotide
auuuuuguuguuguuauu

SEQ ID NO: 61305 - RNA, 18 nt, Artificial Sequence
  Description of Artificial Sequence: Synthetic oligonucleotide
ggguuauuuuuguuguug

SEQ ID NO: 61306 - RNA, 18 nt, Artificial Sequence
  Description of Artificial Sequence: Synthetic oligonucleotide
cuccuggguuauuuuugu

SEQ ID NO: 61307 - RNA, 18 nt, Artificial Sequence
  Description of Artificial Sequence: Synthetic oligonucleotide
agccacuccuggguuauu

SEQ ID NO: 61308 - RNA, 18 nt, Artificial Sequence
  Description of Artificial Sequence: Synthetic oligonucleotide
ucuugagccacuccuggg

SEQ ID NO: 61309 - RNA, 18 nt, Artificial Sequence
  Description of Artificial Sequence: Synthetic oligonucleotide
uggacucuugagccacuc

SEQ ID NO: 61310 - RNA, 18 nt, Artificial Sequence
  Description of Artificial Sequence: Synthetic oligonucleotide
cacacuggacucuugagc

SEQ ID NO: 61311 - RNA, 18 nt, Artificial Sequence
  Description of Artificial Sequence: Synthetic oligonucleotide
caucccacacuggacucu

SEQ ID NO: 61312 - RNA, 18 nt, Artificial Sequence
  Description of Artificial Sequence: Synthetic oligonucleotide
auuuucaucccacacugg

SEQ ID NO: 61313 - RNA, 18 nt, Artificial Sequence
  Description of Artificial Sequence: Synthetic oligonucleotide
uuuauauuuucaucccac

SEQ ID NO: 61314 - RNA, 18 nt, Artificial Sequence
  Description of Artificial Sequence: Synthetic oligonucleotide
cucuguuuauauuuucau

SEQ ID NO: 61315 - RNA, 18 nt, Artificial Sequence
  Description of Artificial Sequence: Synthetic oligonucleotide
ucuuccucuguuuauauu

SEQ ID NO: 61316 - RNA, 18 nt, Artificial Sequence
  Description of Artificial Sequence: Synthetic oligonucleotide
uguugucuuccucuguuu

SEQ ID NO: 61317 - RNA, 18 nt, Artificial Sequence
  Description of Artificial Sequence: Synthetic oligonucleotide
acauauguugucuuccuc

SEQ ID NO: 61318 - RNA, 18 nt, Artificial Sequence
  Description of Artificial Sequence: Synthetic oligonucleotide
cagugacauauguugucu

SEQ ID NO: 61319 - RNA, 18 nt, Artificial Sequence
  Description of Artificial Sequence: Synthetic oligonucleotide
cuccccagugacauaugu

SEQ ID NO: 61320 - RNA, 18 nt, Artificial Sequence
  Description of Artificial Sequence: Synthetic oligonucleotide
ccagccuccccagugaca

SEQ ID NO: 61321 - RNA, 18 nt, Artificial Sequence
  Description of Artificial Sequence: Synthetic oligonucleotide
cucccccagccuccccag

SEQ ID NO: 61322 - RNA, 18 nt, Artificial Sequence
  Description of Artificial Sequence: Synthetic oligonucleotide
ucuagcucccccagccuc

SEQ ID NO: 61323 - RNA, 18 nt, Artificial Sequence
  Description of Artificial Sequence: Synthetic oligonucleotide
uuuugucuagcuccccca

SEQ ID NO: 61324 - RNA, 18 nt, Artificial Sequence
  Description of Artificial Sequence: Synthetic oligonucleotide
gugaauuuugucuagcuc

SEQ ID NO: 61325 - RNA, 18 nt, Artificial Sequence
  Description of Artificial Sequence: Synthetic oligonucleotide
cccgugugaauuuugucu

SEQ ID NO: 61326 - RNA, 18 nt, Artificial Sequence
  Description of Artificial Sequence: Synthetic oligonucleotide
ccccucccgugugaauuu

SEQ ID NO: 61327 - RNA, 18 nt, Artificial Sequence
  Description of Artificial Sequence: Synthetic oligonucleotide
cccugccccucccgugug

SEQ ID NO: 61328 - RNA, 18 nt, Artificial Sequence
  Description of Artificial Sequence: Synthetic oligonucleotide
cucaucccugccccuccc

SEQ ID NO: 61329 - RNA, 18 nt, Artificial Sequence
  Description of Artificial Sequence: Synthetic oligonucleotide
auugucucaucccugccc

SEQ ID NO: 61330 - RNA, 18 nt, Artificial Sequence
  Description of Artificial Sequence: Synthetic oligonucleotide
acaauauugucucauccc

SEQ ID NO: 61331 - RNA, 18 nt, Artificial Sequence
  Description of Artificial Sequence: Synthetic oligonucleotide
agggcacaauauugucuc

SEQ ID NO: 61332 - RNA, 18 nt, Artificial Sequence
  Description of Artificial Sequence: Synthetic oligonucleotide
gacccagggcacaauauu

SEQ ID NO: 61333 - RNA, 18 nt, Artificial Sequence
  Description of Artificial Sequence: Synthetic oligonucleotide
gcacagacccagggcaca

SEQ ID NO: 61334 - RNA, 18 nt, Artificial Sequence
  Description of Artificial Sequence: Synthetic oligonucleotide
cguuugcacagacccagg

SEQ ID NO: 61335 - RNA, 18 nt, Artificial Sequence
  Description of Artificial Sequence: Synthetic oligonucleotide
cccaacguuugcacagac

SEQ ID NO: 61336 - RNA, 18 nt, Artificial Sequence
  Description of Artificial Sequence: Synthetic oligonucleotide
cuggucccaacguuugca

SEQ ID NO: 61337 - RNA, 18 nt, Artificial Sequence
  Description of Artificial Sequence: Synthetic oligonucleotide
ggauucuggucccaacgu

SEQ ID NO: 61338 - RNA, 18 nt, Artificial Sequence
  Description of Artificial Sequence: Synthetic oligonucleotide
auaguggauucugguccc

SEQ ID NO: 61339 - RNA, 18 nt, Artificial Sequence
  Description of Artificial Sequence: Synthetic oligonucleotide
aacuuauaguggauucug

SEQ ID NO: 61340 - RNA, 18 nt, Artificial Sequence
  Description of Artificial Sequence: Synthetic oligonucleotide
aaugaaacuuauagugga

SEQ ID NO: 61341 - RNA, 18 nt, Artificial Sequence
  Description of Artificial Sequence: Synthetic oligonucleotide
cgaagaaugaaacuuaua

SEQ ID NO: 61342 - RNA, 18 nt, Artificial Sequence
  Description of Artificial Sequence: Synthetic oligonucleotide
gucuccgaagaaugaaac

SEQ ID NO: 61343 - RNA, 18 nt, Artificial Sequence
  Description of Artificial Sequence: Synthetic oligonucleotide
uccgugucuccgaagaau

SEQ ID NO: 61344 - RNA, 18 nt, Artificial Sequence
  Description of Artificial Sequence: Synthetic oligonucleotide
gagcuuccgugucuccga

SEQ ID NO: 61345 - RNA, 18 nt, Artificial Sequence
  Description of Artificial Sequence: Synthetic oligonucleotide
gugcagagcuuccguguc

SEQ ID NO: 61346 - RNA, 18 nt, Artificial Sequence
  Description of Artificial Sequence: Synthetic oligonucleotide
cuccagugcagagcuucc

SEQ ID NO: 61347 - RNA, 18 nt, Artificial Sequence
  Description of Artificial Sequence: Synthetic oligonucleotide
ccggccuccagugcagag

SEQ ID NO: 61348 - RNA, 18 nt, Artificial Sequence
  Description of Artificial Sequence: Synthetic oligonucleotide
gagucccggccuccagug

SEQ ID NO: 61349 - RNA, 18 nt, Artificial Sequence
  Description of Artificial Sequence: Synthetic oligonucleotide
cgccugagucccggccuc

SEQ ID NO: 61350 - RNA, 18 nt, Artificial Sequence
  Description of Artificial Sequence: Synthetic oligonucleotide
uuccacgccugagucccg

SEQ ID NO: 61351 - RNA, 18 nt, Artificial Sequence
  Description of Artificial Sequence: Synthetic oligonucleotide
uucucuuccacgccugag

SEQ ID NO: 61352 - RNA, 18 nt, Artificial Sequence
  Description of Artificial Sequence: Synthetic oligonucleotide
gaagauucucuuccacgc

SEQ ID NO: 61353 - RNA, 18 nt, Artificial Sequence
  Description of Artificial Sequence: Synthetic oligonucleotide
aaggagaagauucucuuc

SEQ ID NO: 61354 - RNA, 18 nt, Artificial Sequence
  Description of Artificial Sequence: Synthetic oligonucleotide
ugaauaaggagaagauuc

SEQ ID NO: 61355 - RNA, 18 nt, Artificial Sequence
  Description of Artificial Sequence: Synthetic oligonucleotide
cccggugaauaaggagaa

SEQ ID NO: 61356 - RNA, 18 nt, Artificial Sequence
  Description of Artificial Sequence: Synthetic oligonucleotide
gccuccccggugaauaag

SEQ ID NO: 61357 - RNA, 18 nt, Artificial Sequence
  Description of Artificial Sequence: Synthetic oligonucleotide
acacagccuccccgguga

SEQ ID NO: 61358 - RNA, 18 nt, Artificial Sequence
  Description of Artificial Sequence: Synthetic oligonucleotide
acaagacacagccucccc

SEQ ID NO: 61359 - RNA, 18 nt, Artificial Sequence
  Description of Artificial Sequence: Synthetic oligonucleotide
uuugcacaagacacagcc

SEQ ID NO: 61360 - RNA, 18 nt, Artificial Sequence
  Description of Artificial Sequence: Synthetic oligonucleotide
acuuguuugcacaagaca

SEQ ID NO: 61361 - RNA, 18 nt, Artificial Sequence
  Description of Artificial Sequence: Synthetic oligonucleotide
cuaugacuuguuugcaca

SEQ ID NO: 61362 - RNA, 18 nt, Artificial Sequence
  Description of Artificial Sequence: Synthetic oligonucleotide
aguuucuaugacuuguuu

SEQ ID NO: 61363 - RNA, 18 nt, Artificial Sequence
  Description of Artificial Sequence: Synthetic oligonucleotide
caucaaguuucuaugacu

SEQ ID NO: 61364 - RNA, 18 nt, Artificial Sequence
  Description of Artificial Sequence: Synthetic oligonucleotide
acucccaucaaguuucua

SEQ ID NO: 61365 - RNA, 18 nt, Artificial Sequence
  Description of Artificial Sequence: Synthetic oligonucleotide
ccccaacucccaucaagu

SEQ ID NO: 61366 - RNA, 18 nt, Artificial Sequence
  Description of Artificial Sequence: Synthetic oligonucleotide
ucccuccccaacucccau

SEQ ID NO: 61367 - RNA, 18 nt, Artificial Sequence
  Description of Artificial Sequence: Synthetic oligonucleotide
uucagucccuccccaacu

SEQ ID NO: 61368 - RNA, 18 nt, Artificial Sequence
  Description of Artificial Sequence: Synthetic oligonucleotide
cauccuucagucccuccc

SEQ ID NO: 61369 - RNA, 18 nt, Artificial Sequence
  Description of Artificial Sequence: Synthetic oligonucleotide
gcaugcauccuucagucc

SEQ ID NO: 61370 - RNA, 18 nt, Artificial Sequence
  Description of Artificial Sequence: Synthetic oligonucleotide
accuugcaugcauccuuc

SEQ ID NO: 61371 - RNA, 18 nt, Artificial Sequence
  Description of Artificial Sequence: Synthetic oligonucleotide
ccagaaccuugcaugcau

SEQ ID NO: 61372 - RNA, 18 nt, Artificial Sequence
  Description of Artificial Sequence: Synthetic oligonucleotide
ccuucccagaaccuugca

SEQ ID NO: 61373 - RNA, 18 nt, Artificial Sequence
  Description of Artificial Sequence: Synthetic oligonucleotide
ucacuccuucccagaacc

SEQ ID NO: 61374 - RNA, 18 nt, Artificial Sequence
  Description of Artificial Sequence: Synthetic oligonucleotide
acuucucacuccuuccca

SEQ ID NO: 61375 - RNA, 18 nt, Artificial Sequence
  Description of Artificial Sequence: Synthetic oligonucleotide
ucacuacuucucacuccu

SEQ ID NO: 61376 - RNA, 18 nt, Artificial Sequence
  Description of Artificial Sequence: Synthetic oligonucleotide
ggccuucacuacuucuca

SEQ ID NO: 61377 - RNA, 18 nt, Artificial Sequence
  Description of Artificial Sequence: Synthetic oligonucleotide
cccuuggccuucacuacu

SEQ ID NO: 61378 - RNA, 18 nt, Artificial Sequence
  Description of Artificial Sequence: Synthetic oligonucleotide
gggccccuuggccuucac

SEQ ID NO: 61379 - RNA, 18 nt, Artificial Sequence
  Description of Artificial Sequence: Synthetic oligonucleotide
ccaucggccugugauggg

SEQ ID NO: 61380 - RNA, 18 nt, Artificial Sequence
  Description of Artificial Sequence: Synthetic oligonucleotide
uuaccccaucggccugug

SEQ ID NO: 61381 - RNA, 18 nt, Artificial Sequence
  Description of Artificial Sequence: Synthetic oligonucleotide
aagucuuaccccaucggc

SEQ ID NO: 61382 - RNA, 18 nt, Artificial Sequence
  Description of Artificial Sequence: Synthetic oligonucleotide
ucucgaagucuuacccca

SEQ ID NO: 61383 - RNA, 18 nt, Artificial Sequence
  Description of Artificial Sequence: Synthetic oligonucleotide
ggcucucucgaagucuua

SEQ ID NO: 61384 - RNA, 18 nt, Artificial Sequence
  Description of Artificial Sequence: Synthetic oligonucleotide
gaucaggcucucucgaag

SEQ ID NO: 61385 - RNA, 18 nt, Artificial Sequence
  Description of Artificial Sequence: Synthetic oligonucleotide
cccaggaucaggcucucu

SEQ ID NO: 61386 - RNA, 18 nt, Artificial Sequence
  Description of Artificial Sequence: Synthetic oligonucleotide
aagaccccaggaucaggc

SEQ ID NO: 61387 - RNA, 18 nt, Artificial Sequence
  Description of Artificial Sequence: Synthetic oligonucleotide
cucagaagaccccaggau

SEQ ID NO: 61388 - RNA, 18 nt, Artificial Sequence
  Description of Artificial Sequence: Synthetic oligonucleotide
ggagucucagaagacccc

SEQ ID NO: 61389 - RNA, 18 nt, Artificial Sequence
  Description of Artificial Sequence: Synthetic oligonucleotide
cugguggagucucagaag

SEQ ID NO: 61390 - RNA, 18 nt, Artificial Sequence
  Description of Artificial Sequence: Synthetic oligonucleotide
ggcuccugguggagucuc

SEQ ID NO: 61391 - RNA, 18 nt, Artificial Sequence
  Description of Artificial Sequence: Synthetic oligonucleotide
ucuccggcuccuggugga

SEQ ID NO: 61392 - RNA, 18 nt, Artificial Sequence
  Description of Artificial Sequence: Synthetic oligonucleotide
ugcccucuccggcuccug

SEQ ID NO: 61393 - RNA, 18 nt, Artificial Sequence
  Description of Artificial Sequence: Synthetic oligonucleotide
cucccugcccucuccggc

SEQ ID NO: 61394 - RNA, 18 nt, Artificial Sequence
  Description of Artificial Sequence: Synthetic oligonucleotide
uuuggcucccugcccucu

SEQ ID NO: 61395 - RNA, 18 nt, Artificial Sequence
  Description of Artificial Sequence: Synthetic oligonucleotide
cuggauuuggcucccugc

SEQ ID NO: 61396 - RNA, 18 nt, Artificial Sequence
  Description of Artificial Sequence: Synthetic oligonucleotide
ccuagcuggauuuggcuc

SEQ ID NO: 61397 - RNA, 18 nt, Artificial Sequence
  Description of Artificial Sequence: Synthetic oligonucleotide
aaccuccuagcuggauuu

SEQ ID NO: 61398 - RNA, 18 nt, Artificial Sequence
  Description of Artificial Sequence: Synthetic oligonucleotide
ucuguaaccuccuagcug

SEQ ID NO: 61399 - RNA, 18 nt, Artificial Sequence
  Description of Artificial Sequence: Synthetic oligonucleotide
agcaaucuguaaccuccu

SEQ ID NO: 61400 - RNA, 18 nt, Artificial Sequence
  Description of Artificial Sequence: Synthetic oligonucleotide
ggaaaagcaaucuguaac

SEQ ID NO: 61401 - RNA, 18 nt, Artificial Sequence
  Description of Artificial Sequence: Synthetic oligonucleotide
gcccaggaaaagcaaucu

SEQ ID NO: 61402 - RNA, 18 nt, Artificial Sequence
  Description of Artificial Sequence: Synthetic oligonucleotide
gcccagcccaggaaaagc

SEQ ID NO: 61403 - RNA, 18 nt, Artificial Sequence
  Description of Artificial Sequence: Synthetic oligonucleotide
caggagcccagcccagga

SEQ ID NO: 61404 - RNA, 18 nt, Artificial Sequence
  Description of Artificial Sequence: Synthetic oligonucleotide
acacucaggagcccagcc

SEQ ID NO: 61405 - RNA, 18 nt, Artificial Sequence
  Description of Artificial Sequence: Synthetic oligonucleotide
aaccaacacucaggagcc

SEQ ID NO: 61406 - RNA, 18 nt, Artificial Sequence
  Description of Artificial Sequence: Synthetic oligonucleotide
ggaagaaccaacacucag

SEQ ID NO: 61407 - RNA, 18 nt, Artificial Sequence
  Description of Artificial Sequence: Synthetic oligonucleotide
cagcuggaagaaccaaca

SEQ ID NO: 61408 - RNA, 18 nt, Artificial Sequence
  Description of Artificial Sequence: Synthetic oligonucleotide
gugcacagcuggaagaac

SEQ ID NO: 61409 - RNA, 18 nt, Artificial Sequence
  Description of Artificial Sequence: Synthetic oligonucleotide
ccccugugcacagcugga

SEQ ID NO: 61410 - RNA, 18 nt, Artificial Sequence
  Description of Artificial Sequence: Synthetic oligonucleotide
gaaauccccugugcacag

SEQ ID NO: 61411 - RNA, 18 nt, Artificial Sequence
  Description of Artificial Sequence: Synthetic oligonucleotide
cguuugaaauccccugug

SEQ ID NO: 61412 - RNA, 18 nt, Artificial Sequence
  Description of Artificial Sequence: Synthetic oligonucleotide
uagaacguuugaaauccc

SEQ ID NO: 61413 - RNA, 18 nt, Artificial Sequence
  Description of Artificial Sequence: Synthetic oligonucleotide
ggacguagaacguuugaa

SEQ ID NO: 61414 - RNA, 18 nt, Artificial Sequence
  Description of Artificial Sequence: Synthetic oligonucleotide
cuuuaggacguagaacgu

SEQ ID NO: 61415 - RNA, 18 nt, Artificial Sequence
  Description of Artificial Sequence: Synthetic oligonucleotide
ccuggcuuuaggacguag

SEQ ID NO: 61416 - RNA, 18 nt, Artificial Sequence
  Description of Artificial Sequence: Synthetic oligonucleotide
cucuuccuggcuuuagga

SEQ ID NO: 61417 - RNA, 18 nt, Artificial Sequence
  Description of Artificial Sequence: Synthetic oligonucleotide
ugucacucuuccuggcuu

SEQ ID NO: 61418 - RNA, 18 nt, Artificial Sequence
  Description of Artificial Sequence: Synthetic oligonucleotide
ugccuugucacucuuccu

SEQ ID NO: 61419 - RNA, 18 nt, Artificial Sequence
  Description of Artificial Sequence: Synthetic oligonucleotide
ccaccugccuugucacuc

SEQ ID NO: 61420 - RNA, 18 nt, Artificial Sequence
  Description of Artificial Sequence: Synthetic oligonucleotide
uguccccaccugccuugu

SEQ ID NO: 61421 - RNA, 18 nt, Artificial Sequence
  Description of Artificial Sequence: Synthetic oligonucleotide
ccuucuguccccaccugc

SEQ ID NO: 61422 - RNA, 18 nt, Artificial Sequence
  Description of Artificial Sequence: Synthetic oligonucleotide
uucuuccuucugucccca

SEQ ID NO: 61423 - RNA, 18 nt, Artificial Sequence
  Description of Artificial Sequence: Synthetic oligonucleotide
cuggcuucuuccuucugu

SEQ ID NO: 61424 - RNA, 18 nt, Artificial Sequence
  Description of Artificial Sequence: Synthetic oligonucleotide
ggcuccuggcuucuuccu

SEQ ID NO: 61425 - RNA, 18 nt, Artificial Sequence
  Description of Artificial Sequence: Synthetic oligonucleotide
agggaggcuccuggcuuc

SEQ ID NO: 61426 - RNA, 18 nt, Artificial Sequence
  Description of Artificial Sequence: Synthetic oligonucleotide
uucucagggaggcuccug

SEQ ID NO: 61427 - RNA, 18 nt, Artificial Sequence
  Description of Artificial Sequence: Synthetic oligonucleotide
acaccuucucagggaggc

SEQ ID NO: 61428 - RNA, 18 nt, Artificial Sequence
  Description of Artificial Sequence: Synthetic oligonucleotide
aggugacaccuucucagg

SEQ ID NO: 61429 - RNA, 18 nt, Artificial Sequence
  Description of Artificial Sequence: Synthetic oligonucleotide
agauaaggugacaccuuc

SEQ ID NO: 61430 - RNA, 18 nt, Artificial Sequence
  Description of Artificial Sequence: Synthetic oligonucleotide
aggacagauaaggugaca

SEQ ID NO: 61431 - RNA, 18 nt, Artificial Sequence
  Description of Artificial Sequence: Synthetic oligonucleotide
agaggaggacagauaagg

SEQ ID NO: 61432 - RNA, 18 nt, Artificial Sequence
  Description of Artificial Sequence: Synthetic oligonucleotide
gggaagaggaggacagau

SEQ ID NO: 61433 - RNA, 18 nt, Artificial Sequence
  Description of Artificial Sequence: Synthetic oligonucleotide
cagaggccaguguguggg

SEQ ID NO: 61434 - RNA, 18 nt, Artificial Sequence
  Description of Artificial Sequence: Synthetic oligonucleotide
ggacccagaggccagugu

SEQ ID NO: 61435 - RNA, 18 nt, Artificial Sequence
  Description of Artificial Sequence: Synthetic oligonucleotide
gggacccagaggccagug

SEQ ID NO: 61436 - RNA, 18 nt, Artificial Sequence
  Description of Artificial Sequence: Synthetic oligonucleotide
uggguggacagagaaggg

SEQ ID NO: 61437 - RNA, 18 nt, Artificial Sequence
  Description of Artificial Sequence: Synthetic oligonucleotide
cucuguggguggacagag

SEQ ID NO: 61438 - RNA, 18 nt, Artificial Sequence
  Description of Artificial Sequence: Synthetic oligonucleotide
uuucacucugugggugga

SEQ ID NO: 61439 - RNA, 18 nt, Artificial Sequence
  Description of Artificial Sequence: Synthetic oligonucleotide
auugguuucacucugugg

SEQ ID NO: 61440 - RNA, 18 nt, Artificial Sequence
  Description of Artificial Sequence: Synthetic oligonucleotide
uuuuaauugguuucacuc

SEQ ID NO: 61441 - RNA, 18 nt, Artificial Sequence
  Description of Artificial Sequence: Synthetic oligonucleotide
caacauuuuaauugguuu

SEQ ID NO: 61442 - RNA, 18 nt, Artificial Sequence
  Description of Artificial Sequence: Synthetic oligonucleotide
agauccaacauuuuaauu

SEQ ID NO: 61443 - RNA, 18 nt, Artificial Sequence
  Description of Artificial Sequence: Synthetic oligonucleotide
aaaugagauccaacauuu

SEQ ID NO: 61444 - DNA, 483 bp, Homo sapiens
gcttcctgaactactacgatgcctgctcggagggtctgcgcgccgccagccccgccctgcggctgggaggccccggcgactccttccacaccccaccgcgatccccgctgagctggggcctcctgcgccactgccacgacggtaccaacttcttcactggggaggcgggcgtgcggctggactacatctccctccacaggaaggtgcgccctgcccctccgtccgccccggtgttctgcgccctcagccgctgtgccccgggccgcgctgaccctggtggtgctgaggcggccccgcccgcagggtgcgcgcagctccatctccatcctggagcaggagaaggtcgtcgcgcagcagatccggcagctcttccccaagttcgcggacacccccatttacaacgacgaggcggacccgctggtgggctggtccctgccacagccgtggagggcggacgtgacctacgcggccatggtggtgaag

SEQ ID NO: 61445 - DNA, 4021 bp, Homo sapiens
gctgaccacttcagtggatgctgtggttgccatctgcgtgattttctccatgtccttcgtcccagccagctttgtcctttatttgatccaggagcgggtgaacaaatccaagcacctccagtttatcagtggagtgagccccaccacctactgggtgaccaacttcctctgggacatcgtaagtgtcagtttacagcgcctccctcccctccgtgggcccaaggtggagcttgtgtgtgctctgaaggaccagaccaagaggggaggggttctcacggtgccagggctgctgaaaggcactgggccaagggccttgtgtatctgctgtcccttgacatcttctcagaaaggcacagaactaggagcccgaagctaggaaaggctgtggggtgcagcttaacaactggtgaacgggggctctctatgtcctgcactgaggggtcttctgacccatcaaataatcactgcaccgcaggcatgagtctggccttcctggcatcagtctggcgctgagaaggtaatatgaaggggtctttcaccccaagtccccttctcaaatcctgccccaccttcaaaagggtaaaggtaaaactttccctgtggtagggtcaccagataaatacaggacacccagttaaatttaatttcagatgatgaataatttttagtataagcatatgctacttcaaatattgcacaggacatatctacactaaaaaaaaaaaaaaaaaaaaaaaaaacctggttgtttatctgaaactcaaatttcactaggcatcctagatttttatttgccaaatctggcaaccccagccagtggccaaaataataagaccttcacttattagattaaccaccgctacagggaaaaatgaagaaaaaatatttattaaatcaatagcacactaccaccttcctgacaaccaaggttggtgggggtagggaggggtcaggatagcgtaccctattacaggctgcagggtcaaaggaattggtagtaaaggcctagttataatgtaacagggatcattatgacatcaaccccaatttattctaggtgtcttgagtagtaaaatctcaacattttaagaccaacatgagcctccatttcatgtgatgataagatataccaactgatggagaccaacacaaatgaccttctcatccatggttttttaaaatgatggtgaatattggaattcctgaagatatgatttctatcttactcagcttagtaagcagctatcacttaacaatacaaaaccagagattatcagtagcaactaaattatttcctctctcttctgtctacacgaggaaacactcataaatgcacggggaggaggtcagaacctgaaagcctttctttggataagagcatcaactgcaggtaccacattggccctgtgatgctaatataaaaggagctaggcccaccggtaccgaaaagttacttagaaaagtgcggaggcttttaattttactttttttaaaagataagaaatagaatttacacacttggggctggcccacgtgtttctgtgtgtgtgtatgtgtgcacgcacgcgcgtgtgcgcttacagggatctctgagcctatggagagagatgtagctaggatagagtggacatctgaggtgggaggtgatactagctggcagtccaatgaaggggtagaagatggtaggcatcatgttagcaggctttctgatgctccagaattttaaagctggcctggaatctcacctccgcgatccatcattttggaacttaggaccaccattagccagtggcaaaaaaaaagttgaatgaaggaacaaacaattattgcttatgtaattcacttagcacatatatgatgttttaaattcttatatgtgtcatctatttttctttactttaaaattttgcaacagttacagacttatggaaaagtcacaagtacagttgaaacctttttttcttagtcatttgaaagtaacttctcagcaagatgccccttctcatttatttctctcttcctgtctctctctctcacacccctcagcacgtccgatgtatacttcctacaaacgaggatacaccccatacaaccacaacacaaactgtcaacatgaggaaaccagcactgatgtgtcatcaccacctaatcctcacaccccactcctctttcgcccattgccccagtgatgtctttcagaaaaaaggatctagctcagaatcatgcatgacatttgattgtgctgtttctttagtctcgttcagcctggaagagttccacagtcttttgttaacactcatggtcttgacactttgaggactgcaggctggttattttgcagaatgtcccttggtctgagcttgtctgaggtttcctcttgcccaggttgagggtgtgcatcttggcagcagtatcagcaaacagatgctgtgttctcactgcatcctatcaggtggcttctgatttcaatttgctctgttactgatgatgttcaattcggtcacttaagaaggtgtctgctgagcttcttcactgtaaaattactcttttcccctttataataaatacaaatttcaggtagaggcacttcaaagatatataaatatcctattcattatacaattttccatttattcatccatttatttatctctgtatgcagtcatggttcatgtgttaatcaatggactatgatccaagactatcattatttattttgatattcacattatccccactgtggtcagtggggggccgttgaagctggcttctgtatcgtcttgacttgggtcctcatgcccctggacctcctccatgctcaatggcacagcaagatattccaggctcatccttccattatccccattcctaccctctccccaagaagccctggttcctgccagtgggaagtggccctcagaagccaaggtctgagtgctagatatgttcattgcctctggagcaccattggtcccaggccttctcagtgatagaactagggaagatatggatgtacacacacaggtatgcacacacctctatctatagttctctatctacctatacagtgaacactatgagctctccaaaaccaactccacagggctcattctagttttttttctttccacatctgtaactcccttctccaacagtgagacgctggcttctctcactcccaactcatttatctaccggacctatacacctgaacagtgcccaactctgccaccatcccctccccatgtggatgccgtcctctccctgctccagctgcctctgctgcatgcaggtcctcctcgttctgctctggctctgataccctgcaccagatcagcctcctgtaaggatatctttctcatcccgttgaggcctccacaccccacggcaggttgccccctgaggaagcccgtctctggttcttgccctgctcctgatcaccatggctcctcccctaaccccactgttgccgtcccctttctgtgcccagtatagtggctgtaggactaaattgtttaaaaagggtatcattatttatttgagctttgtgaagccaagaactaggctttaagtttttctgaattctgaagacatgcttagaaagaagaatcaacaaaactttatgaccaaatagaaagagtgagagaccaggcagaattttgtaattgatcctttcaaaagatacaaactaaaggttcccttggcagggaggtagggcatggggtggggtaggaggactagtgacagcttaacatatgtttgccaaccaagaactgtttaaaaagcaagtcgaatcagaatcccagaccctacgagctggaggagcctggccccacccctcattttgcagagctggcagcaggtctgagaggttaagtgacttgctctcctcttctctttccgagatgaattattccgtgagtgctgggctggtggtgggcatcttcatcgggtttcagaagaaagcctacacttctccagaaaaccttcctgcccttgtggcactgctcctgctgtatgg

SEQ ID NO: 61446 - DNA, 2695 bp, Homo sapiens
agagacagctgggccactggcagtgagggagagtgaggatggcagagaccagtgccctgcccactggcttcggggagctcgaggtgctggctgtggggatggtgctactggtggaaggtgagccaggcagaacctggggtgcagcgggggcccagtgggttctgaggacccaggccaccagtgtggagctggcaaggagaggagaggtccccaaacccagctgggtgtccggtcccattggctgccttcccctctgtgcccggactcggggggtgttctgacaattgaacctgtgaggtgcagcacactgcccgctgggagcagagaggaagccaggcaagggtcagggagggagggactttgaaaggggacatctgcccaggagatgatcaagagccaggctttaggacttttcatgtccctccagccgggagaaaatttaatccactccttggaaatcctgctgagaatcccacataagatcagtcccccaaaaggctctggggacagacagctctgcctcctgctcttgtgtggctggaaccaagtcccttcagctctctgccctcaatgccttgacattccgaatgggtggttgtaaagattaaatgggataatgggtataaagtgctagcctaaatagactctagggtatttaagttcattcactcccatcctctccagccccaccactattttcactgtgtctactcctatgagcccaagcacttcacctctggaggcaacctgggtctgcgaggtacctacctcaacctagaatccctaagatgctcgctgaggccagagctagagacagtgtcaatcctgaatctgggccagcccaagctaaattgatggagaacgcagctttggttcaaagcagacccagagaaatcatcagcacgttttctcacctaatgagaactgacaatggagaggaagtgacagtcattagattggtcctgaaggctctggacacgactgtctggtggccccagcccgtgtctccctttcctgagaaccctacaatctagcatccttccaggtcctcaaacatgccataaaattttaccactttattttttggaaggggtttaaatttacatttttatttcatgtttaatgactagaaatgtcattatatacacaatgctttggtttttattttatttaaaatatgttttaaatttcaatagctttggggatacaagtgatttttgtttacatagatgaattacatcgtggcaaatgctaggactttagtgcactcatcacccaagtagcgtacattgtgcctcatttgtaggtttttttaatcccactccctctcccacccttccccttctgagtctccagagtccattgtgtcctctgaatgcctttgcgtactcacggtttagctcccacttgtaactgagaacaaacagcatttggttttccattcctgagttacttcacttacaataatggcctccagctccatccaaattgctgtaataagacattatttcattcctttttacagctattattccatgatgtatatatactacattttctttatccattcattggtcagtgggcacttacattgatttcgtatctttgcaattgtgaattgtgcctcggtaagcatagatgtgcatgtgtgtttttggctggattaaatggcagatctacttttagttatttaaggaatctctatactgttttccatagaggttgtattaatttacatattcccaccagcagtgcataagcattccctttttaccacatccatggcattgatctattgttttttgactttttaatgatggtcattcttataggagtaaggtggtatctcattgtaccatagcatgtctttgcacatgctattccctcctggaatgctcttccatgcactgtcctgcaggtaagtgcttctcatagttttgaaggcaggattttttcctgttcctcactttagataggggaagctgaggttcagagagcttaaggagcagcaagcgaggcaaccaagccaaaattcaaggtcgggtctctctgttgccagagtacgcccccttcatgttcacttccatgcctggcgtcctgggcagctcccagctctaacatcgactcttctccttggagcctctctgactttgctctacagtccttggagaaggcattttgaaatccaaaaggcctgaattcaagttccagctccaccgcttactagctgtgtacttagggcaagttagctagtgtctctgagcctcagtttcccagctataaatggagaagagagtatccaagtaaagattgaatgagatgactcatataaagtgcttatcctggtgcctggtgtgtgctaagtgcctggcagctgtcagtgattatgactgttatagcatgaagcatgctaccctatattgattgtcttccttgtctgtccaggaggttgctgatgttccatccaccccacacacactgttctgaccccagctgggcctcagcagccccaatgccagcccccacccttcctttcagctctctccggtctcagcctcaataccctgaccatcttctctttctgcaagaccccggagctgcggactccctgccacctactggtgctgagcttggctcttgcggacagtgggatcagcctgaatgccctcgttgcagccacatccagccttctccg

SEQ ID NO: 61447 - DNA, 1253 bp, Homo sapiens
ctgatgagaatattgatgtcaccagcaatgaccctgagttcccctcctctccatactcctcttcctccccctgcggcctggacagcatccatgagacctcggctcgcctactcttcatggccgtcaagtgggccaagaacctgcctgtgttctccagcctgcccttccgggatcaggtacctaccggcctgcctgctggggagctaggctgggctggggtcaggcggcccactcgagtcaaccagacagggcacacacatccccacgccagtatgaatgcacacagcttggatggtgatggctggggacacacatacctctgattcagcgatggctggggtgcatctcagggatggtgacggtgggggtgcatgcatctctggcacagggatgatggtcggggtgcacacctaggagatgatgatggctagggacctacagggcccagggtcttcttaagttctggaagaccctcaggccctgcagacattctgtgggtaacaagtgacctgcacaccctgaacaggctgagtggctgactctaggcccccttggagcacaagtgcctacgacttcagggcttgcattttagttcaatctctccagctctgggccatccctctcggcttctaatgggcaagcagatctttcaggaaaaccaggaggagaggcatgaggagggtttgaggccctcagccagtctgtgtgctggggtggagcaactcagaagagtcaggccacaccacttgaatacactcaacttaggacactcatgaggcatgtctctgaggctgcccaacttccaatggctctgggcgttcctaaatgtcccagctgcagctctggatggaacccagtgtctcagatgataggcagctgagccggatggtgccaaatcccagagctctgagcctctggctgatgtcaggagagcattctcgggtcccaggacagcacttccattccttgggtgcctgagatggtggcagaggctccagactgagccagagaagctgtgtgtctgccataacaggcacccctgtctgagcacaggtgatcctgctggaagaggcgtggagtgaactctttctcctcggggccatccagtggtctctgcctctggacagctgtcctctgctggcaccgcccgaggcctctgctgccggtggtgcccagggccggctcacgctggccagcatggagacgcgtgtcctgcaggaaactatctctcggttccgggcattggcggtgga

SEQ ID NO: 61448 - DNA, 1274 bp, Homo sapiens
gtcacagcggagtgaatcagctcggtggtgtctttgtcaacgggcggccactgccggactccacccggcagaagattgtagagctagctcacagcggggcccggccgtgcgacatttcccgaattctgcaggtgatcctcccggcgccgccccactcgccgcccccgcggccctccactctcaacgccctctcttcatttcttactgtaaacgatgctaattatggacccccccaccctcacccaccccagtccccagtccccccacccactcccctgccttcccactttcccctctccttccaccatccttccctatctctttcaacctgggtcagttacataagataactcatctgcttcagaaaaatattgtgtgcggatttttttaaaaaaatctttctctttttatttggtaaagacattcattgtgggaacagtttatgaaccgtaataagctgagttatataaaccggcataatttcattctgctctccccagcccatgcttacctcagcttttgaggtatttgtttattcttcatgtttatgaataatatatattgattttaaaaggcaaatgctatttactcctccctaactcacatttactcaattgagtattttttaaagaagaagaagtaaaaaaatcagtttattttttacctttgttctttaaaacataacgccactttaagcaaggtcagcacaaaaataaatttatctacttcgttttgatgcatcttcaggcagtgtttaagaaaagttttttttttaaaaaaagcttttaaattcgttttttagttcaaattgtttgaaagtatcatcatatttgtagtttttagggctacaaatgtaattttaagaaaaaaagctctctacagtaagttctcataccattgaaggtatatttttgtgttatagacccatgcagatgcaaaagtccaagtgctggacaatcaaaacgtaagcttgtcattgtttaatgcatacttaaacaattttatttttgtcttgaaattattaataatgtggttttctgtccacttcccctatgcaggtgtccaacggatgtgtgagtaaaattctgggcaggtattacgagactggctccatcagacccagggcaatcggtggtagtaaaccgagagtagcgactccagaagttgtaagcaaaatagcccagtataagcgggagtgcccgtccatctttgcttgggaaatccgagacagattactgtccgagggggtctgtaccaacgataacataccaagc

SEQ ID NO: 61449 - DNA, 387 bp, Homo sapiens
gcgtgagcccctcgctccagtgccgcgtgtgcggagacagcagcagcgggaagcactatggcatctatgcctgcaacggctgcagcggcttcttcaagaggagcgtacggcggaggctcatctacaggtgagtgcggtgggccctgctgggcgtctgcccctgaggggttctggaggggtgagggggtgctcaggggaagaggggcttgggcaaaaatgtccaagcccatggctcagggcatgggagggacactgacccctggggtctcctcttcacctgcaggtgccaggtgggggcagggatgtgccccgtggacaaggcccaccgcaaccagtgccaggcctgccggctgaagaagtgcctgcaggcggggatgaaccaggacg

SEQ ID NO: 61450 - DNA, 644 bp, Homo sapiens
ttctgccaacaccatgtttgagatggagtggcgtggccggcgggtagcactcaaagccagcaacgggcgctacgtgtgcatgaagaagaatgggcagctggcggctatcagcgattttgtcggtgagcactctgcctgccaggtactggggcaggggctgtctccacccagggaaaggacctgcccagacaccccatctccaccaagagctggaccctccccagcccacggaacgggtgctgtcatggagtcatacttgctagtcaagataactcgtcttggcaagggaaacaggtctgaatgtccttatctccgctgctgggaaccccctaggcgccttgccaaggccgcacatgaggcaatggcaggcctgggtccctaagtccaggtgtggcgtttcccagggcccccaccccgcccggcctggacagggaaggtggcgggaggggcagcgcagcagacgctctccccgccaggcaaggacgaagagttcaccctcaagctcatcaaccggcccatcctggtgctgcgcggcctggacggcttcgtctgccaccaccgcggctccaaccagctggacaccaaccgctccgtctacgacgtcttccacctgagcttcagcgacggcgcctaccggatccgag

SEQ ID NO: 61451 - DNA, 644 bp, Homo sapiens; identical to SEQ ID NO: 61450

SEQ ID NO: 61452 - DNA, 504 bp, Homo sapiens
ggtgcgcgcagctccatctccatcctggagcaggagaaggtcgtcgcgcagcagatccggcagctcttccccaagttcgcggacacccccatttacaacgacgaggcggacccgctggtgggctggtccctgccacagccgtggagggcggacgtgacctacgcggccatggtggtgaaggtgggccggcccaacgccctgcgcgccccccggccaccttcctcccgagacgggacaggcgagcggtggccgcgccacccggtcccagctgccctggacacccgcaggtcatcgcgcagcatcagaacctgctactggccaacaccacctccgccttcccctacgcgctcctgagcaacgacaatgccttcctgagctaccacccgcaccccttcgcgcagcgcacgctcaccgcgcgcttccaggtcaacaacacccgcccgccgcacgtgcagctgttgcgcaagccggtgctcacggccatggggctgctggcgctgctgg

SEQ ID NO: 61453 - DNA, 586 bp, Homo sapiens
acgctgctcaggttcaacgccgtgctgaggaagctgctcattgtcttcccccacttctgcctgggccggggcctcattgaccttgcactgagccaggctgtgacagatgtctatgcccggtttggtgggtggtagccgaggcccatggagcatgggccctgggtccaaagctgggagggttaccgggggggctcctgcatcagactgtggcaggggctggtgctaggaggggaccttgttgggctggaggtgtcctgccagctggagaggattagggtgcctctgtttccatggctggggagccacaggagggatggagggcagcccttatgaggcgggtgtttggctcttgctcagttcccacataaggcctggtctagtgggccctgtgctgtggccaggtctgtggggtgagctggggcggctgaagtggactcaattcctgttgatgcccaggtgaggagcactctgcaaatccgttccactgggacctgattgggaagaacctgtttgccatggtggtggaaggggtggtgtacttcctcctgaccctgctggtccagcgccacttcttcctctcccaatg

SEQ ID NO: 61454 - DNA, 1764 bp, Homo sapiens
acaaacaggcgccggacgcggagccgccaggaagcgcgggagggggggcgggcccgagggggggccgggccgcttggtaacccctccctgtccgggcctcgccgctcagtacgggggcggggctagccggctgaccccctggcctactcccggcctccggctccaggcccttcccggatccccgcccccggattcccaggggacggggaagggagcgcccgccccgatatctccgccccccagcccctaacccctcagggttgagcggaccaaccccaccacttccgcgaggggcaggggcggggtcacaaaacgggccctcggcctaggggcggagtttctcgtaaggggcaaggccaaggcatcttgtattggggctgacaggggggcgggttattagggctgaggatgggaggatgctcagggtattggggtcagggtggcattagcccagctcaagccgggccgggctgactcagcatcctgccccagccagcttccatccctgacacctctgcattcccttgggcagagatgggagatggcgccggtgttgcccctggtgctgcccctgcagccccgcatccgcctggcacaagggctctggctcctctcctggctgctggcgctggctggtggcgtcatcctcctctgtagtgggcacctcctggtccagctaaggcaccttggcaccttcctggctccctcctgtcagttccctgtcctgccccaggctgccctggcagcgggcgcggtggctctgggcacaggactagtgggtgtaggagccagccgggcaagtctgaatgcagctctataccctccctggcgaggggtcctgggcccgctgctggtggctggcacggctggtgggggggggctcctggtcgtcggcctcgggctagccctggctttgcctgggagtctggatgaggcgctggaggagggcctggtgactgccttggctcactacaaggacacagaggtgcctgggcactgtcaggccaaaaggctggtggatgagctgcaactgaggtaccactgctgcgggcgccacgggtacaaggattggtttggggtccagtgggtcagcagccgttacctggatcccggtgaccgggatgtggctgagtgagtgatttgcgtctcccttcctcctcctcctcctccctggacaggctccctcctgctgccttgaatccccacctcgctcagaggggcaataagtagaacatagtggctgagagactggttacagctctgccatttattagctgtgaaacccagggcatgttaccaaaccaccctgggcccattccttcacctgtaaaatggaaataatagtacttatctgatagagttgttgtgaagatgtgaattatgcttggctggcacatagtacagcagtcagtaaatgttttactattctttttcccttctgaacacctgtgcccttcagtccctcccccaggcctctatctccagacatcctaacccctctgtccctccctttgcagccggatccagagcaatgtagaaggcctatacctgactgatggggtccctttctcctgttgcaacccccactcaccccggccttgcctgcaaaaccgtctttcagactcctacgcccaccccctgttcgatccccgacaacccaaccaaaacctctgggcccaagggtgccatgaggtgctgctggagcacttgcaggacttggcaggcacactgggtagcatgctggctgtcaccttcctactgcag

SEQ ID NO: 61455 - DNA, 795 bp, Homo sapiens
gctgccacctgtaggtcacttgggctccagctatgtggctgcctcttctgctgggtgccttactctgggcagtgctgtggttgctcagggaccggcagagcctgcccgccagcaatgcctttgtcttcatcaccggctgtgactcaggctttgggcgccttctggcactgcagctggaccagagaggcttccgagtcctggccagctgcctgaccccctccggggccgaggacctgcagcgggtggcctcctcccgcctccacaccaccctgttggatatcactgatccccagagcgtccagcaggcagccaagtgggtggagatgcacgttaaggaagcaggtaagtatggtagaccaccaggaatatggtgtggggtgtcctgatccccacagtcaccccaggagtcacctgcaagggctgtggtaagctaaagggacaatttgaggagaagcagttttcagatgctcccaggaagaagagggagctgtgggagtgcctcacctacccccagcatccttttcatctccccacagggctttttggtctggtgaataatgctggtgtggctggtatcatcggacccacaccatggctgacccgggacgatttccagcgggtgctgaatgtgaacacaatgggtcccatcggggtcacccttgccctgctgcctctgctgcagcaagcccggggccgggtgatcaacatcaccagcgtcctgggtcgcctggcagccaatggtgggggctactgtgtctccaaatttggcctggaggccttctctgacagcctgag

SEQ ID NO: 61456 - DNA, 2265 bp, Homo sapiens
gccaaggatgagctgaacgagagagaggagacccgggaggaggcagtgcgagagctgcaggagatggtgcaggcgcaggcggcctcgggggaggagctggcggtggccgtggcggagagggtgcaagagaaggacagcggcttcttcctgcgcttcatccgcgcacggaagttcaacgtgggccgtgcctatgagctgctcagaggtgaggccagtgcttggagggacggccctgggaagacgggaggccatgaggatgctatccgctctcatcctggcactgaacaggcctgcttccatactgtgggcaagtcagtttctctgagcctccacatccttacctgtaaaatgggtcagctctgataatgagcgaacgaatgaatgaatgaagtgtgtcaggagcagatttctggaggtctgagtcctctcaactctctcccagtcttgggattcaatgagtaaaacttgggtaccccatttgggtgacgaggggaggaatttcccctccagacccccaccatgagaacctaagctttggctctggaatgctgcaggaaggtggatagtgcctctctcagggcagttacctaagcctcatgtgcagtggaactgaagatggtgtcagacctgggaatgaaccccggggacagaaccgctctggcactgctggctggatgaagacaggatgcctcaagaaatcatcggccggttgcggtggctcacgcctgtaatcccagcactttgcgaggccaaggcgggcagatcatctgaagtcgggggtttgagaccagcctgaccaacgtggagaaaccccatctctactaaaaatacaaaactagccgggcgtggtggcgcatgcctgtaatctcagctactggggaggctgaagcaggagaatcgcttgaacgcaggaggcagaggttgcggtgagctgagatcgtgccattgcactccagcctgggcaacaagagcaaaactctatctcaaaaaagaaagaaagaaaaaaaaaaagggggtggttccctcaagaaatcgaatcttgggcactggtggacggaaatggggtctgagtgggccctctgcaggctaatgattttccttttcctacttcttccttctccaaatggtaattcagggccatgctgtgccaagaactgttttaggccaagggatgcagtggagacaaaacagacaagttccctgccctggtggaactcatattctaatggtggaaacaatacatccaataaataaagtaaaattatatagggttaaataatggtaaggaataaggaaagaaattaaggaggtggatataaagtcttgaggggctgaagttttagataaagtggccagggaagtcccagtgcaaagggaattttgaagaaaaacccgaaggaaatgagatatctgtggggaagagcagccagggcagaggcaacagcaaagacaaaggccaggggttgggaggtgcccagagtgttccagagcagtgagcaagttgatgtggcagtctcttggcagaggtgcccaggtcctctaggggctcaaatttggtggtgcaggccacagaggtggggaactgctcaggatgggtaaggatggtgtttgtggaccgtagaggtgctgctggaatcaggagctctgtgtcctgcttggggtttggattttacttgggagcttctcctcagccctgtgcacacctcaccactcagcttatcctgtgcccagctgaaaaatctgtgtcttgtccccatggggaagaaaataacaagtaatgattatcctcatatttaagactatgcctcatgtttgcccaagcttatgatgatgtttacaccttgaatctcatttgattgccacaacaatttggtgagataggccactatctagactatctagaatagataggtcaatatcgagatcccattttttggagaggaaacatggggctcggataggttgagtagccagctcggtcacacataggacctggcaggaggtcaggtctctgagtcccactaggagggatggggtagggatgggatggctccctgagggggttcctctgctctccttcctccaggctatgtgaatttccggctgcagtaccctgagctctttgacagcctgtccccagaggctgtccgctgcaccattgaagctggctaccctggtgtcctctctagtcgggacaagtatggccgagtggtcatgctcttcaacattgagaactggcaaagtcaagaaatcacctttgatgag

SEQ ID NO: 61457 - DNA, 378 bp, Homo sapiens
ggggtccactggacggggcctgagctacaacttcacccacctggacgggtacctggaccttctcagggagaaccagctcctcccaggtgagctgtgggctctgccctcccagcccgcctgcacccccttgccctgcccaccctctccctcacccagcccctctgagtccttggatgtccattcagggctggccttggtgccggagcacaggcctggcagagcatgggtgtggtgtgtggtgggcggtggggcagccctcctgtgttccagggtttgagctgatgggcagcgcctcgggccacttcactgactttgaggacaagcagcaggtgtttgagtggaaggacttggtctccagcctggccaggagatacatcg

SEQ ID NO: 61458 - DNA, 14037 bp, Homo sapiens
gaagcctcaccaagcctctgcaatgaggttcttctgtgcacgttgctgcagctttgggcctgagatgccagctgtccagctgctgcttctggcctgcctggtgtgggatgtgggggccaggacagctcagctcaggaaggccaatgaccagagtggccgatgccagtataccttcagtgtggccagtcccaatgaatccagctgcccagagcagagccaggccatgtcagtcatccataacttacagagagacagcagcacccaacgcttagacctggaggccaccaaagctcgactcagctccctggagagcctcctccaccaattgaccttggaccaggctgccaggccccaggagacccaggaggggctgcagagggagctgggcaccctgaggcgggagcgggaccagctggaaacccaaaccagagagttggagactgcctacagcaacctcctccgagacaagtcagttctggaggaagagaagaagcgactaaggcaagaaaatgagaatctggccaggaggttggaaagcagcagccaggaggtagcaaggctgagaaggggccagtgtccccagacccgagacactgctcgggctgtgccaccaggctccagagaaggtaagaatgcagagtggggggactctgagttcagcaggtgatatggctcgtagtgacctgctacaggcgctccaggcctccctgcctgccctttctcctagagactgcacagctagcacaagacagatgaattaaggaaagcacagcgatcaccttcaagtattactagtaatttagctcctgagagcttcatttagattagtggttcagagttcttgtgcccctccatgtcagttttcacagtccatagcaaaaggagaaataaaaggaccgggtgagatgtgtctgcatatgagcagtagaaagttgtcaattgtcccttttgaaaaactatccttttttgaacctttgctcagattgttatttgtaccttttgatgttaaaatgacctttatttatgaaattacaatagatttgggaaatgataataagtggtaagtttttgtttatttttaaatgttcttccctggcaaaataaagagatggcacctctctgtcagttttcttaatatgttgttctgaaagttttcttactcagtccaatctgagaacctctgcttttaagtcatcagacaaattcttgagatggctttttctgagaggctcttctgttcatcctggtcccttcttgcctaaaggtgagtctgtgtgtgtgtggggggggtgcgggggtgaggtgttgggggaggtcttcttattagctgggaagatggtatttgtgtcactttttgtgaaagtgggctcccaaatattccctgttgaggaagtgttctaatcatgaggaaataagcaagcaaatccagttgttggacaattagtttggactggtcaaagatgtcagtgccaaggaagaaagaaaaaaggggtggggaagggcttgttctatattaaagagactaaagaaatgtgttaaccaaatgtagtgcatgagtcttgattggtgtcttcatccaagggggaaaaaggctatgaggaacaggtttgggataactgaggcaatttgactgctcattattatgttactgtattaatgttcagtttcttggtgagataatgatactgtggttgcgaaggataaaatctttgttctatggagatacatgcttaagtacccagggtgaggcgtcaggatgtctgcaatttgctctcaaatggttgaagaaagactgcaaatatatagataatgagagaaagaaaggtaaaacaactgtggcaaaatattaataactggtgaattacaaactggtgaatctaagtatatggggagcttattgtactattctttcagtttttctataggcttgaaaagctttaaaattatgagaaaatatttcctaaaaagagccttctacgtgaaaggcaagctcttcatagctatggggttagaaaacctaagagccagagcctggggatgaccttgggcaagttattgaaccctctgcatcttcatttcttgtccataacataacaaagaaaattcctgctgtgaataatttttgtggggttcacatgaaatacctataagatgtaaaggatttttaaaaaatgtttagattgttagaattagaagagatccaattctgaattttacaaccaaggaaagtgaagtcctaagatgctaaggggccaaggttgcccagctggtcagtggtagagcttgagacttgaatctgtggagacaattgaaagaatcatcattaccagaagtgtgatgaggcattacttatttcagactgttgaatgaagttacattctcaataaaaactcctgcatgtgtgtatgtgggtgtgggtggtgtgtgtgtgtgtgtacaaaaatagtggcaatgttttgcctttttttttcttttgtggtcatttaacaagtctttggggatttattagatgtgtttcctaattttatattttttcttgatctttccagctactccacttttgaaataagggcaacatcccattatattgaacaccaaacatggaagttcttttctagtagtagatgtttttcatgagcaggaaattacattagtacaagaatgtggaactggaaagggacctaatgagcatccggtaccgctggctgatttttgcagatatggaaactgaggcccagagaggttattcagcttgtccatggccatctaccagttagtggcaaagctcgaattctggcctcttcctctgaagttcagtgactttctttctttttttttgagacagagtttcactcttgttgcccaggctagagtgtaatggcacgatcttggctcactgaaacctctgcctcccgggttcaagcaattctcctacctcagcctcctgagtagctgggattataggcatgtgccaccatgcccggctaattttgtatttttagtagagacagggtttcaccatgttggtcaggctagtctcgaactcctgacctcaggtgatctgccgacctcggccttccaaagcactgggattacaggtgtgagccctccctgtacatggccatgaggttcattgactttcaagaccttcagctgacctctggtttatagaccctaaaggtaaaagacagaaaggtacaggaatgcttggaacaaaagatctgtttcaaggccagatctagggaaaagggggcattctggaggctggaatataagtctaggtatgcttttttgcaggagtggcaagaactaggtgtgaaggtttgggtagagaagcttagtgaggctgagtggacaaaggtaaggcctgagaaggcagcctttctgtattccacctgcaactcaaattgttaccaccactttcttgatcatgtattaatagttgttatgtagaaaaaaattccttataatcatagaaatcacttgtttatacatacacataatatgacatattttactacataactattactacaaagttatatataactttttcttctctgggcttatataaattttcatatatatacatatataaattttatgtatatataatagtttttgaaaagtagaaaaaaaatacaattagccaagtgtggtggctcacacctgtaaccttagcactttgggaggccgaggtggacagatcacttgaggtcaggagtttaagaccagcctggccactgtggtgaaaacttgtctctactaaaaatacaaaaattagccgggtgtggtggcgggcacctgtaatccagttactccagaggctgaggcaggagaatcgcttgaacctgggaggcagacgttgcagtgagccaagatcacgctactgcactccagcctgggtgacagagcgagactccatctcaaaaaaatatatatattacatataatacatataaatatatataattatatatataaatttattatatatataataaaatacatatataatttactagaagataaattagagttggttattactgtcacaagagaaggactgctttgtttgttatttagcccctgctttggactggtctcctgttgaacagagcctggaagagggcttgtgtgcagttggtttatatggaccatgatcctagagaagagaagttgagacaggggaaagtgagacagggaaggcaggaaagccacaaaatgggggccttctccagctagtcaccacagtgggcaatggaggctcaatcccatcaagcccttcagaggggctgtgtagactgcaacagaagaggggaggtttacgcatggatctgataccctcttggccaagggctatcccatggagtatattgcgcttccctgatactcagatgtggggacgaggtttgttcttgcagactgattttttttttttttttaagatggagtctttctctgtcccccaggctggagtgcggtggcacgatcttggctcactgcaacctccgcctcctgggttcaagcaattctcctgcctcagcctcccgagtagctgggattacaggtgcacactaccacgcccagctaacttttgtatttttttttttttccagtacagacagggtttcaccatgttggccaggctggtcttgaactcctgacctcaagtatccacccatcttgacctcccaaagtgctgggattacaggcatgagccacggcgcctggcctgttcttgtagactttctatgcagaaagtcagagaagctgggccacggtggctgaggcgaggtccccgcaggtgataactgcaagaggcaggttgcctcagcaatgactgcaaaaaagtgggcaggatgtgaggggagggtgaggggagaaacctgaggtgttcaacacaagtgctgcagattccctttcctcacctagaataggatggggatgagaatccctcatgggagtcatcatgcaaattagcagtcacacagggaagcacccagtgcagcgctgagcagtggccacccagtgaataaaatataactagaaaggcttattttacttgagttccactattgtttttgttttttgttttgttttgttttttgaagatggagtctcgctctatcaccaggctggagtgcagtggcgtggtcttggctcactgcaacctccacctcctggattcaagcaattctcctgcctcagcctcccaagtagctgggattacaggcacacgccaccatgcccggctaatttttgtatttttagtggagatggggtttcaccatgttggccaggctggtcttgaactcccgacctcgtgatccacccgcctcagcctcccaaagtgctgggattacaggcatgagccactgcacctggccagggttccactattgttttaaagcatcattcaataatcaatatgtcaacatgtgcataacattttaataacatgcgttgattctagagacagtacaagttagagcagtactcaggacaatagtctattagctagtcttcactttcctaagatgtttctgacaacctgtagataattaggcatagcttgttttacttcattcctttcatttatgtaatatggactgaactttccagtgatagaaaatatctatgaaaattattacaatgcctatgtctacaggcaaacgagttaataaattcagtttccgggttgaggtctctaaaatgccaagtctataaagaagcgacggcagagaacacagaacatttccagaattttgtaatagacatgaacctttaaaccacagaaggactgaatttaacattttaaaaaacctagaaaaaaaacagctgggcgtggtggctcacgcctgtaatcccagcactttgggaggctgaggcaggcggatcacgaggtcaggagttcgtgaccagcctggccaatatggtaaaaccctgtctctactaaaaatacaaaaattagccaggcgtggtggcaggcacctgtagtcccagctactcaggaggctgaggcagaagaatcacttgaacccaggaggcagaggttgcaatgagctgagatcatgccactgtactccagcctgggtgacagagcgagaccctgtctcaaaaaaaaaaaaacaaaaaaaaaaaccttaaaaaataaaagccccaaaaatgctaactatctgacacagtacagcccttaatattttcacagtctctttttggttttcctccacattcacaatgaaatgttagtgattttaaaacattccagagaaattttagtgttgacacatctttattgagggccatttcatttatagttacttatgtaatcatccaaacaattcagctcagcatactggggctcagagaggtggagtcatttacccaaagtcacacagctgggacatggcagagctgaactaggagctatgacttccggcttaggtccaggcccctttacgagattgtttccctgcctttgggttttgcatcctctattctgggcttccacccgcatgccagatggctctattcctggagtctgaccattgccagatgctcctggctgacatgacctagaagaagccagcaggctcataacttaaccatcgcccctgccaaatgggaactggccttgccgtcatcctggaagccattccctgacattttgttttattgcagttcatgtttattccagctaatgcacataaggagtggttcctgcaaggcacaatctgaagggctccttgctcagagccgtaagggccatggtgggattcagcagggaacttggcaccagccaggcacttttgctgcctcttctttgccagtgagggtagaagaactgataagaggattgagtgcacagcccaggagctgagagtttacaaggcaacccactgggacctgagctcagccccaggagtgggtcaccccacaaagtgctgagcagcatctttgagactcttctgaagcctccagtagccatctgggtccagtcgggagatagaaatcacacagtgggttaagctggggaagtttactttaaagaattactaaccgtgatgaaagagcaactatagatagacgtgaactccataggcacctagggctgagggagggtgccggacaagcttggaaggggaaggtgaggttcagcacatcagcttgcagagaaggtggctaaggtgtgcaggcctcagctggtctgcagctgcaataggccgcctcccagtgcaggtgaggagggcaacctgcaacgtgtggcaagggcatggtgggagtcagggcaggcacaggcaggaggcctccagagcactgaggtccgtgtgcagggactctgggttccttgttgggagggctgtggaaaggttatggccaggctgtggctgtgaggtcacagaagaacttcgctctgggtccgtggctggggtaggactccaacaaatgtcctcacagtcataccacctatggacgcaggacaggaaaactgcagacctttttcctcccacgatgtccctccagcgccctctactgagatagttcaacatcgcgctcacttcaaagctcttgttcttcagacagcatacatgggagggtgcattcagctctgagaggcaatgcgtttataactgacacacctcctcagcacaggatggaagagttcgcagctgccatggcctcggaagacatgggttcaagtcccagcgataccacttagctgtgtgaccttgggcatgttacttaacctctctgaacctcggtttcctcatttgcaaaaggggatattaatgttcactttcaggaccattatttgaaagtagtgagtagcaagcacccagcacagtactggctcataagagacacttaataagtagtagcgatagttcaactttatcaggcgctatctgcagtcctaaagcctttctctatttctctgaaactttgaaggcaccagatcacatttaaaaattacataaaaattacttgaaatgggcaaagagctataaatgccgacaaaccatcttgtttcacaaaaaaaaaaaaaaaaaaagctgttttttagagttgcaaagccagtacatactttagctatccacaaggaagtcatctgtgaaaatgcctgacttttttgggtttcactttcttccttccctctatagcaaaaggggcatttctttcttaattttctccccactgactggtaggtaggtacccctacttttcttagtatacatcttttctcggtaagttgttaaattaaataaccagcataaaatacatcattttgtatgtgtaaaggggccagatgcaggggagggatggctcgcctgaatttaatatttttttaaaaacctaaaaaaaaaagccctaaaaatgttaacgatctgtcacaatatagcccttaatattttcataatctctttttggttttcttccacattcagaatgaaatgttagtgattttgaaacattccagagaaattttagtattgacacatttattaagggaccctcccatggcaactgtggatggcatagctgaagtgtagggacaaggttggggcagtcctccagactttgtgtacagatggcatgcagtatttctctctcctcacattgcctgaaaccaactcctttttttttttttttttttttttttgagacagagtctctctgtcacccaggctggagtccaatggcacaatctcagctcactgcaacctttgcctcccaggttcaaacgattctcctgacttagcctccctagttgctgagattacaggcatgtgccactatgcccggctaatttttgtatttttagtagagacagggtttcagcatgttggtcaggctggtctcgaactcctgacctcatgatccacccacctcagcctcccaaagtgctggaattacaggcgtgagccaccatgcccagcaactcttatattctgagagttgagacaatgaaagaaaagaaatttgagttgtcctgaggcagagtctgcagtgatccaagaagaggtacagatgaaaggaaaccagctcaattcaaggaacttgcttaatgccctgattttgaaaaattgtcctggcaagactttgccacatcgaatgagcctctgcacattgcaggaggctggcagggccagggagcggtgggctgctcctaacagcctgggtgtgtgttctgggcctaagagagaaggcatggcaatcggcgaggcagcatcagagaggaaggttacagatggttctgccacctgtgtacaggaaggcggtcactctctcttacctctccctggcagcacagaagaacagggaacctcgggcaccctgtccctctcccccataggcagcaccaagtccctgccggaggtgtgtgttgcctgcacagggggagaagggaagcagctggtactggtctcaggtcgatctaaggaaactccatttgacctagtgaatcagtccctgccctggataccctcctaggccaatgcaacctttagaatgaagaacaaaggggtttcctcacccctgcacaacctcagatagggagaaggagacgcagggaatgaaataaaagtttccaggactctccaggagccattcagattgtccaagaaactggtttccgcagcagcctggaataaacccattttccttctcgggtatgaggactttgccagattatgatttccttaagggcatggactgattgtgtctttttttttttttttttaaacatagactagcctattagacaaacttgtgtcttagacacctttttttcttgagcacctagcacagccttgcactcaataggtgctccaatgatgtgactaaaaggatggataaatagctctgtggatttgaggctaggaataatgaaggcctgccatgtcccggggggtactcccaattgcccctggagtttggaatgcacattgaggatgtcctcagttacatatacattttggcttatgagtctttctttttttaattttttttttttttaagacagggtctcactctgtcacccagactggagtgcagtggcatgatcatggctcactgcagccttgccctcttggactcaagagtcatcttcctgcctcagcctcccgagtagctgagaccacagactgcaccaccacacccagctaactctttaattttttgtaaagatggggtctcgctatgttgcccagcctggtcccaaactcttggcctcatgcaatcctgccacctcggcctcccaaagtgctgggtttacaggcatgagccactgcgcctggccagcttatgggttttaactacttacatggtgcactctagactgagggatatcccagggatggaggacccacccacctccagggcattaacacttttagggaggctaacaactgcagccacacagaggcaggggtggagaggagagaagggtagctgggatcaggggcaggcagctgcagcagctactgagctggctcactgtgggcagcatggctgtctggcccagcctgcacctgagagctagctgaatgttttcttcacctccttccagggagaaattttttccagtactataatttgttgaagctgaaccccagcaactcaaacaaggtaccctgactctggagatgtgaaaatgtaaaataatgtgtggctttgatgaaatgtggtagaaccagaggattaagacttctgtggtgatcctctctgcctgaaatctaaatttaggagagctgagcaaacaaatgatcaaaggcagaacatgtcttcccgaccctctcggctgtgtaggcgctccggcctcaggggatgcactgactttcctcccactgtcctgaacacctgagaatcctgagcggggaacaagttgctcaaagggcagagaagtgactcagaggttcagcaagagaaaagcccagtgtattaagcatgtctttttattctgatgctttgctgtctgggccttgcaaacgtgagagggactgcccctcccaggggtagccagttcctacggttagcaaaggactcacctgggaggacagctttcatatgcaaaccaaccaatccagagcccacaccctgtgaccacctccatctggctcaaactcaaggccactgtccccctgacctaatcacccagggcctggtaccagacaattagagataactcctgtgaccccagatcctgctgaaattattcaaactccccaatcctaaacctgcttaccctgcctcccctttctttccttcccatggaaagaataaaggcgctttcccacattttcccctggtgccctcttctggagcaaccctggtgcttccccaggtggcctcctgggcttagtgtgcccccttcctcttgggctctgtgagtacaacaacttgtaaagataatttttttttagagcagttttatgttcacagccaaattgagagaaaagtacaaacagttcccagatactactggcccccacacatgcacagcctccccgattatcatcatctcccgccacagcagttgttacaactgatgaacctgcatcagcacgcacaacacccaaggtccacggtttaaattagggttcatttttggtgttgcgccttctatgggtttagacaaatgcatagtgacatgtgtccaccattatagtatcatacacagtattcattgccctaaaaatcgtctgtgcctcacctagtcatcccttcctcacccaacaactgctgatctttttactgtctccataattttgctttaacttgcttttcagtgacaattgcctcctgggatgttggccttgccacacctgaataatcatcaaacctgcattttatttgtttttatgtgtatgtgatgggttttttgggaggttggaggggaggacagggtctcactctacgccagggctggagtgcagaggtacgatcactgctcaccacagccttgacctcccggtctcaagtgatcctcccacctcagcctcccaagtagctgggactgcaggtacacatcaccacccaggctaactttttgtagtttttgtagagatgggatttcaccatgttgcccaggtttgtcttgaactcctgggctccagtgatctgtctaccttggcttcccaaagtgctgggattacaggtatgagccactgggcctggccaaactgcattttaaaatagccaagcctgttccttgtgactattgcctcatccttgtattcaagactgctgtaagatcataatcctaagcaagagtagagacatgtagcacaccatgatcacttactgtctaaccaatgctgcccacccgcttcccttctgtatggctcaccacccccaccccaaactcctataggaactctgcacacactccctctccattatgcaaaactggtctcagaaaggaatcagacagaatatttctactgaaagtataaagcttaatatgttacttcttacaagaatatttgcatataacaagggaaaaaaccttaagtcatgcagtaaacttttatcttttttttttttttaacaggagtctccctatgttgcccaagctggtcttgaacacctgggctcaagtactcctcctgtcttggcctcccaaagtgctgggattacagacatgagccacacttctttttttttttttttttttttttttttcttgagacagagtcttgctctgttgcccagactggagtacagttgcacaatcccggctccctgcaacctttgcctcctgggttcaagtgatcctcaacctcctgagtatctggaactacaggcatgtgccaccacaccctgctaattcttgtatttctagtaaagatggaatttcaccacgctggccaggctagtcttgaactcctggccttaagtgatccgcctgcctcggcctcccaaagtgctgggatttcagtgtgagccactgtgcccggtctctttttttttttttttgagaccttgagaccgggccttgctctgttacccaagctggagtgcagtggcaggatcatagctcactgcagccttgaacttctgggctcaagcaatcctcccacatcagcctcccaagtacctaggactgcagatgcttaccaccatgcccagctaatttttcatgaatttttaattattgaaattcagacatctaagaagatgctgaggactgtctccatattcctgaaattacgactcacctattcacaaaccagcccttctagtggaattaaaatattatttgattttgaataccctactctaaggtaggcacattgccctgcaatttattatttatgaggtttttaattatggaattgttcaaatattcacaaaagtagagagactacaatgaactccaatgtagccatcactcaggcccaactgttatcagcacagtccaatcatgttttatcttcccttctctgacccccaacccatccccagtccttatctaaaatcaaatctcaaacaccatatctttgggagcctatttatttagttagttagttttcagacagagtttctttcttgttgcccaagctggagtacaatagtgtagtctcggctcacagcaatctccccctccttggttcaagcaattctcctgcctcagtctcccaagaagctgggattataggcacctgccaccacatccagctaattcttttgtgtttttagcaaagacagggtttcaccatgttggccaggctggtctcgaactcctgacctcaggtgatccgcctgcctcggcctcccaaagtgctgggattacaggcatgagccaccacgcctggccggcagcctatttaaatgtcatcctcaacatagtcaatccttgggccattttttcttacagtaaaattttgtctctttcttttaatgcagtttctacgtggaatttggacactttggccttccaggaactgaagtccgagctaactgaagttcctgcttcccgaattttgaaggagagcccatctggctatctcaggagtggagagggagacaccg

SEQ ID NO: 61459 - DNA, 6818 bp, Homo sapiens
gcaggcagggggttcgtgacgccggctgggtctgggggctgtgggccagccgagccgacccgggcttctgggggaccgcgggggccgtgagcactcagagggcgcatcccaggcccctccggggacccggccagcctgaagatgccgacgaacggcctgcaccaggtgctgaagatccagtttggcctcgtcaacgacactgaccgctacctgacagctgagagcttcggcttcaaggtcaatgcctcggcacccagcctcaagaggaagcagacctgggtgctggaacccgacccaggacaaggcacggctgtgctgctccgcagcagccacctgggccgctacctgtcggcagaagaggacgggcgcgtggcctgtgaggcagagcagccgggccgtgactgccgcttcctggtcctgccgcagccagatgggcgctgggtgctgcggtccgagccgcacggccgcttcttcggaggcaccgaggaccagctgtcctgcttcgccacagccgtttccccggccgagctgtggaccgtgcacctggccatccacccgcaggcccacctgctgagcgtgagccggcggcgctacgtgcacctgtgcccgcgggaggacgagatggccgcagacggagacaagccctggggcgtggacgccctcctcaccctcatcttccggagccgacggtactgcctcaagtcctgtgacagccgctacctgcgcagcgacggccgtctggtctgggagcctgagccccgtgcctgctacacgctggagttcaaggcgggcaagctggccttcaaggactgcgacggccactacctggcacccgtggggcccgcaggcaccctcaaggccggccgaaacacgcgacctggcaaggatgagctctttgatctggaggagagtcacccacaggtggtgctggtggctgccaaccaccgctacgtctctgtgcggcaaggtagggagggcacaggtggcgacctcctgaggggtgctgggacccccctgcttcagggaggaggccgtgggggtctcacggggagtggtatcgtgtctgtgcgttcacatgtctgttctgggctgggggtccatgtgggacatgtgtggccactcagggtgtaggtgggtgggcctcgggccatgcccaggcgacccccactgaggggtggtggcttcagggtcagaggcaagggttcctggcctttctcagcatagctggagaatgtctcagccaagccctgggcagctgcggagtctgagactggagaggtgtgggccaggcgatgggcagtgcccagcaggggcaggaggcccacagcctggcctggtgccatgaggggcatgtgggcaggaggctgtggggggtccatatctccccttctttttctccaccccattttctggacttcatttatttatttattttttgagacagagtctcgctctgtcacccaggctggagcgcagtggcgtgatctcggctcactgcaagcgccgcctcacgggttcacgccattctcctgcctcagcctcccgagtagctgggactacaggcgcccgccaccacgcccggctaattttttgtattttttagaagagacggggtttcactgtgttagccaggatggtcttgatctcctgaccttgtgatctgtccacctcggcctcccaaagtgctgggattacaggcgtgagccaccgtgcccggctgcattttctggactttaaaggaaattggggaggagcccagggtagggcagggagctggggatcgggcggggatagcaccaccacgtgcctgaccagtggagcctcgtgtcctcaggagtgggggggcttaaggtcagctccagtgatggaggacacggtgggcaggcagctttacccggggcctgggctcctggtggggaggcacctccctgccccagtggggcgtggcctggctctccccagttcccaggtcaccagttgcctgtctgtgtgactccctccaccgcctatggggtgaaccccagcagttcctccttccccacaagctgagctctgagggaaaagccctggcccgggcagtcactacccacctgggctcctggctccatgcaccccagagtggctcggaggtggtctgaaaaggcgaggtggggagagccgggtgcatggagctcctcctcccaactcaggtccttccagaccagcatcagctgggcaaggagagctcccctgtctcctggcagctcccaggtgcccaccaagcccccaccctgacggatgtccaggccccctgggtacactgacactctggggccagatggcagaggccccaccctgtgcatggagaggggagcccagccatggctatggggtcctgcacctgcagttggcatcctcgggcctgtcccagcagtgacagggtcccaggagtgagaattcaactgtggatgcacggccatggcccttccttcctatcacagcccacagtccagctgtaatgcctgctggcctgggcccaggccgggcatgtggcaatccttaggtggttaaagggggtaagtgggacagtggcagtgagaatgcttcctccatggaagccaaagacactagacctttaggcatttgtatatggacagcttggaaagcagactcaaagtggcagtcatggccgtggccgtggcattgtggtgtgatgtgcatggtggcgtggaagtggaggtgaggacggtggtgacagtgtggtggcagcagcgacaatgatggtgatggtgatgatggtggtgatggtgatgatggtggtgatggtggtgatggtggtgatggtggtgatggtgataatggtgatggtggtgatgatggtgatggtgatgatggtggtgatggcggtggtgatggtgatggtggtgatggtgatggtggtggtggtgatgatggtggtggtggtgatggtggtggtgatgatggtgatggtgatgatggtggtggtgatggtggtgatggtgatgatggtgatggtgatggtggtggtgatagtgatgatggagatggtggtgatggtggtggtgatggtgatgatggtggtggtggtgatggtgatgatggtgatggtgatggtggtgatggtgatggtggtgatggcgatggtggtgatgatggtgatggcgatgatggtgatgatagtgatggtgatgatggtgatggtgatagtgatgataatggtgatgatggtgatggtggtggtgatggtggtggtggtgatgatagtgatggtgatgatgatggtgatgatgatggtgatgatggtgatggtgatgatgatagtgatggtggtgatggtgatggtgatgatggtgatgatagtgatggcgatgatggtgatgatagtgatggtgatgatggtgatgatgataatggtgatgatggtggtggtgatggtggtggtggtgatggtggtgatggtgatggtggtgatggcgatgatggtgatgatggtgatggcgatgatggtgatagtgatggtgatgatggtgatggtgatagtgatgataatggtgatgatgatggtgatggtgatagtgatgataatggtgatgatgatggtgatggtggtggtgatggtagtggtggtgatgatagtgatggtgatgatgatggtgatgatggtgatggtgatgatagtgatggtggtgatggtgatggtgatgatggtgatgatagtgatggcgatgatggtgatgatagtgatggtgatgatggtgatggtgatgatgatggtgatggtggtggtgatggtggtggtgatggtggtggtggtgatgatagtgatggtgatgatgataatggtgatgatggtgatggtgatgatgatgatgatagtgatggtggtgatggtgatggtggtgatgatgatgatagtgatggcgatgatggtgatgatagtgatggtgatgatgatgatagtgatggtggtgatggtgatggtgatgatagtgatggcgatgatggtgatgatagtgatggtgatgatggtgatggtgatgataatggtgatgatgatggtgatggtggtggtgatggtggtggtggtgatgatagtgatggtgatgatggtgatgataatggtgacgatggtgatgatgatgatagtgatggtggtgatggtgatggtggtgatggtgatggtggtgatgatagtgatggtgatggtgatgatggtgatggtgatgataatggtgatgatggtgatggtgatgatggtggtgatggtgatgatggaggcaatggtgatgatagtgatggtgatggcgatagtgatagtgatggtggtggtgatagtgatggtgatggtgatgatgacagtgatgatggtgatggtggtgatggaggggtgctgacagagtggtggagggatggggactgtatggaccatttttcagtctcttgatcctcaaccaccctgcatctgaccctatcatccctttgaggggagaatcccctactcaagaccagctcccatctcccactttagaagcaggaagcagcagccactcgcctccctgccttcaacagggctgagggtgaggacccaaccaccaggtgtttcaggctctggattggcggccagggctgtagggagcgggacatggcatctcagtcctggggcatggaacctcacggcttccaaggcagctgcagcgtgggtggtgccatagcatcacccctacccggcctctgtggagtggctacatggcaggcccttcatcgaggcatctccctggctgggcggcccctaaccctctcttcccccctgggaggggagtgagcacccaggcttgcatgtatccccccccatcggccagagcctgctcatttctgccaacagacagcatggcaggcagtgtctgatgctgccagtaacagaaaactggccacaggctggctcaagcagtgacactgatcatctcctgaaacgggagtccagagagccctgggcatggtgggttcccaggcagccactatcacccgctcagcagcttccccggagtcctccgttcttacctcctcaccgaaccactctcctgggtcagctctgacctcagcctgacgccctcacggtagtaatgtggctgctggtattccaggcctcacatccaggcaggacaaagtccagaggaaaaagaggcactggctctgcttgtgtcttcataggagtaagaaaacttctcccctaagtcctagcagacacttcttcacactcatttgccagaactgagtcccccaactgctcagctagcccctctggaggggggtaaaaccagtgttgcccagaccaaggcggactccactcctctcctattttgaggccatgtccccggaagcaggtggctgaatgagtagccccagacagcatcctgtctgaagggggtgtggggcaactctggggacaccaaagtgctggcctgggaggtgcagtggcggggggagccctgcgatgctgtggcttccttcagtgcccgcagggacggcgttcccacacctctcatgggcccctcctgcgggctcctgctgcccccgggtaccgtgtcagtgttgccctccactgggcccaggcagctgcttttagttcagtatttgccaggatctagagctggtggcagtggggatgctggcacgaatactcggtcacagtgcaggggacatgccgggtgctcctctgcgtctgatcagtgatgagtgtgagggagatcccagcctggggcgtgaggggcagctttggggctggcagaaggcaaaaggtcccaagctgtctggcatggtcacagcctggcatcctctcccctgggcacagcgtgggatgggatctggccccaccctcaggccctgtgggggctctgcccaccactccctcccagtccccagctggacaggccaccagagtccctgggccttgtgggaagctccgcaatctgacacaccactcccagtgtctggctgccatgcaaacagggaggtggtttgtgggaggagccagggacttagttcacagaagatcctgggtaggctctggtgcctgctgtccccatgctgggcatgggtgcccctccatcccctcgcaggaaccccagatggagcccggggcagtcttgtcctcccccaggggtcctgggagaccaagcacagatggttggggaaagctgcagaggtgacagggaccagcccctggctggagcccaggggtgccccatcaccatccgcaccatccccttcattaggtcctgcctgtgcccatccagcagcttagggtgagttataaatagaggctggggtaagccctgggtcaagagagcagggcaaggagattaccagctgattactgattagcagagagtgggggctgtgccaagcagaagggcctggctcctgggggtgtggagggaggtcagggctcccttggggacagtgtgcagggtccacagacggcacatatggccctggggcagggttcccagggtctctgagaggtgccttccaaatcttctcaagtcaagagggttctagatgagacccacctctggcttcaggggtgccccccaaaatatgccccctcccctgctccctacccaggagaggcgtgaggggcttccccatctcctccctccaggggtcaacgtctcagccaatcaggatgatgaactagaccacgagaccttcctgatgcaaattgaccaggagacaaagaagtgcaccttctattccagcactgggggctactggaccctggtcacccatgggggcattcacgccacagccacacaagt

SEQ ID NO: 61460 - DNA, 6846 bp, Homo sapiens
atttgagtttgtttataattacttatatttagccaatttacgtgagaactgggaagaggtgaaaaaaaatgccagaaaggctccccaacctgaagttaggagatatgtacttcctttgaatattgacaaggtaacctgcttctctgtagatttcagatttaaccagaatgtttcatctctctcaggaattgtcctcctgcctcatgtttatacataaagtcttgaaatttgagagctagaaggagctttaaaaataggctaattaaacttccttcattttacaaatgaaactaaagctcagaagagtactgtgacttagcaaaagcaactgcagcagagccaggataagaaccaggtttttaaattctaaatctgccgttcttgtatttacaaaattgtctttaaaatatacttcctcggtgaatagtgcagatccactgattcctatgatactttatcaataatataaatagtttaaataatttgaagttctggagagatgaagcatcaaaaagtactcttgtagggaaaccagttcattattttggttttctataaatcttctgaaaaatatcactagaggttaaaaatcattactaacaatagacagtcatctctttatttctactttttcttccctgtatttagagactgtctttttagaataaccagagtaacatctagaatttgtagtgtgatggaaataccagtcaaaatcaataaaatataattctcacatataggtatgtgaatatatgctttcttttatatctatttgctccctggttgcacaaaaggggttattaaaacagctacatggaatgtaaaactttgcaccaaaggcttagatatggtgtagtagaaaataaactcaatttagaaccaaacaccactgctcttaagcaagtttgtaagctctatgaagaatgagaaagagggagaaggttgaggttgagtgttacagacaggcaaaggggcgtctataaaggcaaggaggagttaaaaatgcaagatttcatctataaatatgaagtagttgctgagtttggtttatttaggggtgtaggggagatgggttttgggcagagagactggaaagataggttggagcaatattgtaatgggctatataagcctttgagtgttatataaatatagggagccatttaagtattttaaatgtgtattttaagtgtattttaggacatgattagatctgtgattcagaaagttactctggcagcatcatggaagacagactggaaagtggagagtctagagcagaggctagaagccctattacaggattaatgcaatgaggcaaataaaagggaataagtagttgagttaagaaaatggtgactgagagatgaagatgcaaagctgagaaatatttaggcagcaaaatcaacagcagttggtatctaattacatgtgaggggtaagggagaggaaggagttcaggatgacttcaagatttccatcctgagcagttgagtgaatgatggtataattcactgaactgaaaacatagaagtaagaggagctgggccaggcgcagtggctcacacctgtaatcccagcagtttgggaggccgaggcgggtgcatcacccgaggttgggagttcaagaccagccttaccaacatggagaaacctcatctttactaaaaacacaaaattagctgggcatggtggtgcatgcctgtaatcccagctactcaggaggctgaagcaagagaatcgcttgaacccaggaggcagaggttgcagtgagccgagatcatgccattgcactccagcctgggcaacaagagtgaaattccatcataaataaataaataaataaataaataaataaataaataaatagaagtaacaggagctagcttgtagaaaaaagaataaattttactttatagatgtaatttgaaagtacccactagcaatcttagcaaagcattccataggcagctgctgtacatggatctggagctccaaagaaagatcatggagagagatcaatctgggtaccttaaggatttttgctttccccttaagaagcatatcactgacatgtagttgagcattcccaaaatactcaccaaatggatgagtcagttaatttcagtaaactcttacttcgctaataatggtaaaaatcacaatcatctttaaggaaataaaagaggatcacttaacttaaatattcacattgcaaaataaagaaaaaagaaggatttttctaactgtatggttatcacggcctgaagaaatattacccaattatagaatagggaactgtaataatcataaaaaatgtctaacatcatcaaatccgtctcctctttcttctaatagttattgagtagccactaaaacaggcatcatactatttgttgcagtgggtacataaaatacacttctagttctcatggagcccgttacctagtgtatcagagagaaagaagccgaatcaggaatagccatgcatgtcagcacaggagtagtactctcaggagggataaattgatttgttaatagctagtcagatgataatgtaggggagattaatggaacatagttatttgcaatgggcagtaatatggcaggtggagatgggattgaggcagaacaactgaagacagaaagaacagtttgaggaaagacagataggtggagagggagatacgcagagagaattggctattataattggttgaaacataggcaaaagtagtaaagtaaatgggataaaaagttataaaagtacgttgtactcttagaaggctttaaggccaggctaagaaatttgcactttattgaactggtaatggaaagacagtgaaggtttttacacaaaagaaaagcccataattaatggtattgaaatgataatgaaatatgtaagaatagagagataagactgcaggcagggggggaaatcatattttagattaggttttccaaaagaaacatttaaaatttgcttatttaaaaaataaagaatttgagagccagagaatacagagagagaagacagccaagcacagtagctccagaaaataaacatgtgtagaaaatggtagaaacaagagaagccagaaaaagaaacaagagaagccagaaaaagaaacaagagccaccagaaagccctagttcctactaagagagagtaacgtcacaaagatgagtgcaggtgagggttatacggtgcccattgccatagacaagttgaaaagggtgaagactaagaataaagcactaggtttggtgatctctaagggaatagagtgagagagacagaagtcaggcttcagggctcttaaggtaagcagttgagtatctggaaagcagttactgcgtgcacactcttaaaagtttggcaatgaagagaaaaatagaaagggcttaggtcccagttacttggaagactgaggcaggaggattgcttgagtccaggagttcaaagttacagtgagctacatgccattgcagtccagcctgaggaaaagaacaagaccccatctcaacaaacaaacaaacaaaacagaacaagactccatctcaagaaacaaacaaacaaacaaacaaacaggaaatctaatttaacaatgaaaataagcaaaatagaacaaagtaaaaaattcaacttgaaaccacataaataatatattaaacatagacatagacatttgtacttattgtatgcatgtacataaatatgcatacatgtgcacacccctcgcttcttcccagcatcaccactaagtacctcgagtcccttatttcacaaaatcttgcagaatcttctcctctattggctcccacctcccatcctttccctattctgaaaatcttccactatttacttttaattcttagtccaccaccagaaaaaatctcctgtcttctcttcttagaatgttgccttcaacctccttttttaaccaaaatctggctctctcccctaaggacactggtctccccaacagtaatttccaggggaatcagtttctcctctgtacagggtacagcccttttaccacttggcctggagttggggtagaggtccttcttctttgctgctttcagatcattgttccctctattcacccttaaaattccctaagttttcatctcattttatctaatcatatagccaagtgatgtatatgtgtgtgtgtgtgtgtgtgtgtgtatatatatatatatatatatatatccctcatgccctcgactttgccactacttaagactatactccttccataatctgtttcatgcatgacccactctgaccttttatctttcaacatcacttgccctactgcaatttccaccaggaacttccaatccattgaacacagtactttctcactctctctcactacgttgaggatttaccttctctcctcactcaatttaagctttacagtcaataattacaaacactttctcatgtagaccttcctttcccttgcctctttcttaccttatcaaagtcatttgtcaaaatcacaaccctagttaaattcagctctccaccccctccatgcttatacctctgaggctgaactaagtgcagacaacacacaatcatgttaattggttccattttagatgcatgaccacaaatctttctgctacatttcccggcttcacttactctctcactttgctagttaaatattccacaccctcctctctttaaacttttaccacctcccacttcccgcctccacactcagatgcagctgatggctatgttttctttttctctgaaacaaatgaaagaaatcagaaaggaaccatagacttgccagcacatctacccacccaccagcatctgtactcatatactgaattatccatcttcctatccagagctgatctctttcatcctccttcacattctcagggaaatcactctcccaattctccccatctttcctagatcaccactctcctacccttttcgatggatcatttttgtcaggctcttacaaaatccttctcttgacatttttgccccaaccagctaccttctcattcctcgtcttgttggagggccttggttcccctatcttccatttatacactcactcgttgttaaatattcatgccttattcatttacatttttagctttctcttaaactcaaggttcttacctgctagcgccagctccacatctgcatttggatgcccaatagacatctcaagtctaataagacaagacttgaacttctcatcttcccccaccaaaaatttactccacctgtagttcctatctttgttgtgacatcaacattgtacaggtcaaacaccttggtgttatgcttgatgcctctcttactttcatgcctcttcctcgtcccatatcctatttaacaggaaatcttcttgactctgtcctccacttcttccacttctcactgactgcaatgctactggcctagtgtgaaccattgttttctttcaactagactactacaagacaaactggtttccctgattccactcttggatcctccctactaacaaggctaccctaaaaataaatcatagcatctcactcctgtgctgaaaaccctccaatggcttcccatcactcactcacagagaaagatcaagtcctcataatgacctacgaggctttgtacagcctggctcgtgacctccccaccttcctttcttattctctcccctagctcagttgatagaatccacactggactctttgatgctcctcaaacacactcagcatcctcctccctcaggcctttgcacaatttgttctcttagcgtgaacactcttccccagatatctgcattgctaattctctcatcttctaagagttttgtctcctctgccacctgttcaaagagacctacccgaaccatctattcaaattttaaccgcttacccttcacgtttctgatcttttttcctctattctatttttcccccacatttgtggtatattataaaatttattaattatatttattgtatatctccttgaactagaatgtaggcttcatgaggacagggacttcactctccaaaacatcctgaatgccaagaatagagtctagaataaaatatgtaatcaagtatttgatgaaattattaataagtagatatgttagaaaaatctcatggtatttcataaaataatcagaaaaatcatgtgtgtgtgacaagagatcttaggaaacatatggtccagcgttttttttttttctttttgtcaacataactgtaaggattttttttttcaagcaaaatcaaaacatattctacgtgtgaacgaaatatacattctttcatccctcaggcagtcgaagtctttgttgttctgcagaaaaacattaattattattattattggttttgagatttttgtttggtttttgtttttttgtttttcagaggcctttctttggagccctaaattttcttcaaggatggtctcattttactgaagagaaaattgatggcctaagaggttatgtgactttcccagtgatacatagccagtgactgacacaggcacagatagcttgcccagtcgcgtcccagggtccctcatctatagcttcctgcagttcctccctgcatgttgacctaaaaaagaacttaggagccaagacttaagaactctgcatttctggctgtttgaattctttcctgctcactgaggtttctgttatcttctctcctaggctgacacaggcaagaatttagtcacgctccccaatacaactgccactgcaattctgtgcagtgacgagactatctggctggagcctgaagttctcttttcagggcctcgtcaag

SEQ ID NO: 61461 - DNA, 2651 bp, Homo sapiens
gtaggaatgaattgatagccagatacatcaaactcaggacaggcaagacgaggaccagaaaacaggtaaaataacccacctggaaattgtgcatgtcagcgaatggcccaaaaaggcattttggctgcagtggctggctatgctttggctcctaggagcccccaatttgagttccctgtaaggacgtcagtgttggaggtattttaaattggctcagttttcactgttcatcatttcagtgaccctttattatgtggtcttacaagttccttttatactcacatgggaaaatgtcactgctaaggacggtgtatgaaccgctcctgtactgtatttcaaagctgacatttctttcccaaaatgtgcacctgtgaacactgcaaaaactgcaagtgcaaatgcacttgcaggtcatgaaattttgaggttttgtgcattgtaaaatcctggagcgattatatattagtcataatttcaatgaaaaagtaacgccagcagccttgagtattggcctgaatgtaatgctaaatgatgtgcgtccagggaactgttgctttttaagcgatggctttttgtcagtagctgctgtgactgaaatgaagttacaacttcaatacctctgtgcagagcagtatcaggaattctctgccctttggcagagctctgcctttcctcgttctttcagatgtaaaacagcccaaatctctgacatgagccagtttagaactggaacgaatgagaaattagtgtttaactaaaaacaaaaaaaagaaaggaggaaaaaaaaaaccctaaaaacctcatgggtgagttgttcacagaaaagaattattttttaatgtcgatttatgctgaatgatacagcatgaaccttaaaaactgtaatcagaccaaaaggctaactaaaccgtggtctcattaagattgagcagcagatttcagttctcttcccagtgaggaattgttttcatgagtgtttataacggggagaggcttttcccaggaatgctacttgtgccacagcctgggagcctggctgctgagtcagcacaaagagaggtggcctcctgccagcacgcagaggcagcgcattgtctgtttgggggatgctagtggccctcgtcaagtcagagaatcacagaagaacaaaattcgggtgaaaacaagtaacagcaggagccagatggagggctgaagaggatgggggagtttctgcttctctgtacttaagaaaagtaccaaagcaaattggaaaaaaaaataattgaataattgaagctcaaagacaaagttaaagataaaaggaccgtttattataaatcctgttttagagccgctggagagttggaaatggggtaatcaccacacagtctgagtcgctgaacttttaaatggaaagttctacatttcggaaaccagtggatctaatcatctacattctgacagtgcgggacctgggctgtctgctggtctgtgagctctggtcatttgcccggtgaccccttcactgagggactcttctaaatttaaccaagtcccactgaaagagatgcagatttcagtggaatcattgtgtttcagaagctgggctcggctacatttccacgccccggcatcctggggatgtttttaggcagcagttggtgatacctctccaatgtgaatttgttgttcagcaaatccatgtggttttcaacccagatttttaacaggatggctggctggctgtattcacacatttcgctttgtaataatatgcaaatccacttggcgcccagtcaatacccaaaagagtggaaggattaaagatttttataagggcaaaaaaaaaaaaaaatagctctgctaactgggtctttccatttctctttgagatctaatttacatgtcagtattattttaacgtttgctacagaatccagagctcttaatgagatcagaatacaaccaacagcttcagctttttgattctgcagaatgtgctaatttatggatagtctcttctaaattgagaaaaagggattttccctcctgatactgagaagctataaatattttcatttacctttactcccacctttttaattttagaatgaaaacagcccctctcatccctcccaaaattagtttttcccagtgcccatgatttctcttgggtgggaagactaagatgagtcttaactttcatcctgaatcaagtcactgcagtgatgacccagtatgaaaagcttagagcagcgctgggggcttgtgtctggctgggactgtgtattcctaactgcagagctttgttgagatgcaaataaccaccccccaaccccaccccaaaaccctcccaaagagtagcgattttatatttgatttccttttttgttttgttttgttttgttttgttttgttttgttttgtttcccctcataaacccgaacaatgtaggtgtctagtcatatacaggtcttagcaagaaagaaagttcgagaaattcaagccgccattaaggtacgtctggcttgcccacttgtagggggcttttcatctccatggttacaggcttttcctttgttttcctcccttcccctaccctgcaggtgtctagtcacattcaggttcttgccagaaggaaatctcgtgattttcattccaagctaaag

SEQ ID NO: 61462 - DNA, 896 bp, Homo sapiens
ggaacaaccaagactggggttaaatctcacagcctgcaagtggaagagaagaacttgaacccaggtccaacttttgcgccacagcaggctgcctcttggtcctgacaggaagtcacaacttgggtctgagtactgatccctggctattttttggctgtgttaccttggacaagtcacttattcctcctcccgtttcctcctatgtaaaatggaaataataatgttgaccctgggtctgagagagtggatttgaaagtacttagtgcatcacaaagcacagaacacacttccagtctcgtgattatgtacttatgtaactggtcatcacccatcttgagaatgaatgcattggggaaagggccatccactaggctgcgaagtttctgagggactccttcgggctggagaaggatggccacaggagggaggagagattgccttatcctgcagtgatcatgtcattgagaacagagccagattctttttttcctggcagggccaacttgttttaacatctaaggactgagctatttgtgtctgtgccctttgtccaagcagtgtttcccaaagtgtagcccaagaaccatctccctcagagccaccaggaagtgctttaaattgcaggttcctaggccacagcctgcacctgcagagtcagaatcatggaggttgggacccaggcacctgcgtttctaacaaatgcctcgggtgattctgatgcaattgaaagtttgagatccacagttctgagacaataacagaatggtttttctaacccctgcagccctgacttcctatcctagggaaggggccggctggagaggccaggacagagaaagcagatcccttctttttccaaggactctgtgtcttccataggcaacatgtcagaaggg

SEQ ID NO: 61463 - DNA, 2179 bp, Homo sapiens
gtgaggagcactctgcaaatccgttccactgggacctgattgggaagaacctgtttgccatggtggtggaaggggtggtgtacttcctcctgaccctgctggtccagcgccacttcttcctctcccaatggtacgtccatgccacaccctgggccagtgggcagctcagggcatccagaactggaccttatacccacatggtcatttctttcctcaggagccccactccacaatgttttttctacattctcaaagcctggcttttctccaataatacaagtagaggatcgggttaaaataggcacattcaaatatgtgaagagcatccactttaaaatatttaaaatgcagtgctattaatttcaattgctgatatttaatccttctcatttaattaccaaatgtgtattttgattagatgatagtattgcaaataacaatggttacagggtatccaaagtactaggaaatagactaatgtatttatgagagaaaggacacagcaggcccctttgctaattagagatttgggagcatgggagtaatatgggagccatgtggaggggtgcgggcagtgatcacgaccccccactcctggaggaaggtgggtagctgccaaccctgacttttgaccagggcttctcaaatgccaggttagctggcaattgccattcttccgcaggctcttcctgaagctgggtgggcccctgcctcactcccctctgcaatccagtcctacctttattgtcctcacccaggggcctgaattgccaagcagcagcccttcctagcaagctttccccaatagtgttttgtttcttaacttttcctcctctcaggctgagtgtggtcacctgtaaatagattccaaggacttggttttatgttttgatccacagggaattgatttattggaaatgaatctgcctttctactcacaggactgtgagaggtgaatgagatcacaggtgtcaacacacgcctgatgaaacaggatacacaagcagttctagttatgggagacagtgtcaggaattgttgtccttggcaccctcagcccctgcagaccctttctgcagccttggccataccttttagaggcttttgtgtgggagagagcaggtcaggaggttgactacccaaattgactcattagcttcaaactctgatgtcaacacatttgaatgagtcctgcctgctttagggcctaaagaggaccagagaagtacaccatagtccctggcttccagaaggtcagggagggtttcaaagaagaggctgtgtctttaagaatggggaagattccatttggtggggcaggaggaggagaacattgagggactggaaacacatgcggaggctgggagacgggaatgaccaataggactgggaaccagggggagatgccaattgctgacagaggagttagtgcaagaggtaagtgagaagggtaggtggggctggattgcagggctgtaactacagctgcagagggagggcttcaacctacagctgatggggaacaacagaaggttttgaggcatgaggtggcctgatgacaactctgttttggaaaggtggagttggcagggcagactggaggaagtgggaggctcggaggttagtaactaccccttactgagtgcttgctgtagaggaagcattttagtcctgacggtgatcccaggccctgagtctttactctgtgccaggcactgtgctgagttcatcttcagcacaatcctatgagacaggtattgttaccctcctcctcatcacatggttgaagtaggcaaggttcagagaggtccaatgcccaagatcacacatgaggaggccaggactggaacccaaggctgactctggacatgagcacctgacctctctacctaatgcctaatgcctctcctgctgggagccctttttagaatttaagtcttaaaggatggaagcccagaaggaagcagaagcaaggaagtggaagagaggtcccatggaaaggacagtgccaaggacactgtacagccagcccaatcctgaccccttttcttcatctaggattgccgagcccactaaggagcccattgttgatgaagatgatgatgtggctgaagaaagacaaagaattattactggtggaaataaaactgacatcttaaggctacatgaactaaccaag

SEQ ID NO: 61464 - DNA, 12704 bp, Homo sapiens
ccaccttggccgggattaccctccgagttccaggccatgacaaatgacatcactcccggcccaggcttaaaatctccccatgtgaggggatgtgtttccttcagcctctgctgtctggccgctctgtctaggtcctgggccacgggagagccccgtccctcctttctgaaggtgagcgtctgcaggagaggcggaggggaccgaggaggggagaaaaaagagaggggagaagttgggtttatcttattcgtggctgtgtttgccgtgctctgcaggtgatgtttgctgaatagtcacacacaaaacagaggtgccgtcctggcatttgtggaaacggggctaggctgtgattgcagcaggagggagtaaggttagacagcagggactggctgatggcactcggggcattgggaggattcagggtggcttgtgggcaagggggtcccctcaagccctgacggcatccggggttgggggcttctcaccgtggttctaaggcaactcctcagcataccgctctgttggatgttctttaaaactcttagcactgcctgaaattttcatttgcgcgatgatccacaaatggcctgtctccctcccttgttgagcactgatttttccccagtgcccagcgtgtggttgggatttgcctaaatatgtgttgcatagatggatggatgaatgacagacaagggacggaacagacatatacgcagagagcccaggtctgtggctgcaacaggaagaactccgggtggacttgggcctgcccgagagagccaggaatgtgatgactggggatcactgtgctggtgaattgatcacttagggcctcaatgcacccagaggctctggctttcagcccaggctctacttcgggactggggaatcctcacgcccccgccctcttagcttccagcacagtcactctctctgatcttctttctgcaaagtttttttttgtttgtttttgagatggagtcttgctctgttgcccaagctggagtgcagtgccacgatctccactcactgcaacctctacctcctaggtccaaggagtccatccacctcagcctcttgagtagctggaattacaggcgcgtgcccccatgcccagctattttttgtatttttagtagagatggggggtctctccatgttgtccaggctggtctcgaactcctgacctcaagtgatcagcccgcctgagcctcccaaagtgctgggattatgggtatgagcctctgcgcccagccggtctcctgcaaaactcttgattgacaccttgtttcccgtctgcccctgtcaggagggctgaggccttgtctgtcttgctctcggctgtattcccagtgcttgggtcagtcctagacacacagtgagtgctcagtgaatatgcagggaatgaatgaatgaatgaagggcagaagggtagaagcaggtagacagactgccacagagaggaggtgtgatgcggttttcccaaaaggaacgagcgagggctgtgattgccacagagtgaggtccgacttcagggctgcccactgtgtgtgaatttctggatgcttcagggatcacattgttgatcacggagttgatttgctcaggctctaactgtgccgtggatcccagcttcccccaggtctcatggccggcagtgggtgcatccacccagctccttgtccccgctggacagaggagccaacagaggctgcagagagaggctggagtggctgacaagggagggccctgaatgtggctgagctgggagggtcttgccaagggctggcatgaagccacatgagtctggttttttttttttttttttgagacggagtctcactctgtggcccaggctggagtgcagtggcatgacctcagctcagtgcaacctccacctcccaggttcaagcgattctcctgcctcagcctctcaagtatctgggattacaggcgtgcaccaccatgcctggcttatttttgtatttttagtagagatggggtttcaccttgttagccaggctggtctcaaactcctgacctcaggtgatccacctgcctcggcctcccaaagtgctgggattacaggcgtgagccaccacacccggccgagtctgcgtttaaatcttgttcttttctcactgtgtggccttggacccctcatgtgggctctctgggccttggttgcctcctctgcaaagtggggacaatgataagctgtcaccatgatccagccagatgagccatattgcaggcctggcctgcagtgggagcagggcaggagaccagcctcattctgtttctagggtccctaggtagacttgggggtgaagagcggggctcgggggccaaagagatttaaattttacccctggttcttccactcatcacctgtgtgacctcgggaattgacgaaacctctttcagcctcagtttcctcctctgagaaagggacctctgagctccgtggggctgtggggagcatcctaagaggccatatcgccgggtgatcaggagggcaccggctccggggcaggtgctggcccagctctggctctgccgctgacgtgcgagacagaactggagactacacttctctcagcctcagtttccttctctgtaaagtggggatgataccagaagccgcctgggaggaagtttccatggagttactgttgcctgagatcttgttcccaaggtccatggtgcatgcagtgtgtgagaagctggggccccctggaggtccttaaggtcatcagccacctgaactgtgggcacctccctccctcccaggctcagtctcccccgctgtagaatggagttatctgcatgtctgccccaccaggtggctgtgagcattcagacctcacctgtgggaacaactgctcagctgggaacctgggacccagtgagtgccgaaccccacagctctgagaatcagcctggggcctcccaggttgatccccagggcagagacactgatattctttgttccaccccttgaaatcataaaacatcagtgtctggaaattgttgtcattgtgagatcttgtatataaagcctgggccaagtgtctgccgagtgatgaattcctggacattcttttttttttttcctccccaggagacaggtcctctttcgattgattgattttttttttttttttttgggatggagtcgtgctctgtcgcccaggttggaatgcagtggtgcaatctcagctcactgcagcctccgcctcccgagttcaagagatttttgtacctcagcctccccagaagctgggacaacaccatgcccggctaatttttgtatttttagtagacggggtttcaccacgttggccaggctggccttgaactcctgacctcaagtgatccgcctgcttcagcctcccaaagtgctgagccactggcctggcctgttttgttttgttttgagagaggatcttgctctgttgcccaggctggagtgcagtggctggatcatagctcactgcagcctccaactcctgggctcaagcgatcttcccacctcagcctcccagagtgctgggattacaggtacgtgccaccacgcccagccctcactggaggcccttctgtcatcagctgcctcaggttgctgccaaacccagggaaagatttcagtggatgttcaatattattattgttattattctctgctgacatcttgtctaggcagcactttatcattattatcagctgtttgatctggggcccacactttcctcctgctgagcctcctctcccctatccgttaaaagggatgatcctggccaggcactgtggcccacgcctgtgattccagcacttagggaggccgaggtgggcggatcacctgaggtcagaagtttgagaccagcctggccaacatggagaaacccaatctctactaaaaatacaaaaaaaaaattagccaggcatgatggcacatgcctgttgtcccaggttgggaggctgaggcagaagaatcgcttgaatccgggaggtggaggttgcagtgagccaagattgcgccactgcactccagcatgggtgacagagactccgtctcaaaataacaacaacaacaaaaacaaaaacccagaaagtggtgatcgtaaatgtgagctttcttggctttcctggaaggttaactgcttagccaggcaatctgactcagatttgacggcgaagacaatgaaagtgtgtgcttttgttccaggccctgcaaatggtccccagtggggcaggttcaccagtttccttgtctccactctctggaggttcatatttaacattattggtttttggagaagtgggagaggacagagggaacccaggttagggggctgggggaataggaccttcaggaattactctagccttgaaatcctggattctccactgccagcctgtgtgtgatcccgggtaagtcacactttcgagcctgaagatgttctctaaactgtaagcatcaggcaaaagcagtgtctcatgcctgtaatctcagcaatttgggaggctgaggcaggaggatctgctcaggccaggagttcaagaccagcctgggcaacatggcaagacacctctctctacacaaaaatttaaaaaattagctaggcgttgtggcacacctgtagtcccagctacttgggaggctgaggtgggaggatggcttgagctcaggaggtcgaggctgcagtgagctatgattgtgccactgcactccagcctgggtgacagagtgacatgctgtccctaagaccaaaaccaaaaccaaaatgtaagcatcatagtaatacagtctctacctcccaaggttgtgctggggatttaatgactacctgtatagagaaggcttgtgtattagttaactattgctgggtaacacttatcctaaaattgagcagcttcaaacaataaacatttctgatctcttatagtttccaagggacaggaatccaagagtggcttaactggattattccggctcagggtgttccatgtggttgtggtcagatgtcggccaggactgaagtcacttaatggcttggctgaggctggggaactaacctccatggtagcttactctcatagctgttggcaggaggcctcatttctttgccacatagacctctccgtgggatggcttgagcatcctcacaacatggcggctggctttccttagagctagccttggaagccacgctctgtcatttctgcaatatcctgttggttacacacgtcagccagcttgttagtagggactacacagggcatgaatatcagggggtaaggattattgggagttaccttggaggcagtttgattttggggatttaatgtagctgcttttgattttattgtcagcactgagccttctcgtgacattcctaccaggttttacttgttctttctgcttttctccatgatcaatctgctatggtcacacagggtgccttgtttcttctccaacaagaccaagttggagaccctgtcttgctcagggtgacggtgtgagattccagcctccaagcctttgcacctgctgtttttttaattttttttttttgcctggaaatctctattccagatccacacaaattcctagatgcctcacccaccccaaatgccttcactctcataacaacctgttttattttcctgggagttcttgaaactttctgaaggctttttttttttttttttttttgacagagtcttgctctgttgcccaggctggagtgcagtagtgccatctcagctcactgcaacctccgcctcccgggttcaagcgattctcaagtagttgggattacaggcacccatcatcatgtctggctaatttttgtattttagtagagatggggtttcaccatgttggccaggctgatctcaaactcctgacctcaagtgatcctcataactcagcctcccaaagtgttgggattacaggcaagagcccctgctcctggccatggcatctttattaaaaaaaaaaaaaaaaaaaaaaaaaaaaaaaaaaaggcagggcgtggtggctcacgcctgtaatcccagcactttgggaggccgaggcgggtggatcacatgaggtcaggagttcgagaccagcctggccaacatggtgaaaccccatctctactaaaaatacaaaaattagccaggtatggtggcaggcccctgtagtctcagctacttgggaggctgaggcaggagaatcacttgaccctgggaggcagaggctgcagtgagccgagatcaagccattgcactccagcctgggggacaagagtgagacttcatctcaaaaaaaaaaaatttttttttccttgtttgttattggtttctctaggaacggaaccaagaagttcaattctatgagaacagagaagctgcggtcttatttcttcctatattcctagttcctagagcagggaaggcattcaaaaaatatttactgaatgaacagtagaatctcaacttaaaataaacagaatctgtccccctcctcatgtgagggatgagaaggaaaggacagtgagaggaacggaagagtgggagctcacaataaacaccatccatttttaattctttttcttatgtttcaaatatttattgggggtgctggggacatggcaggaaccgagatattaccagtccctgaactcaggtaactgatagaatttgagggagagagatagataaacaaacatataaatatgtcgtttaatacaagctgtgtcttgaagaaaaggaggtagggagcgtgtgtgtgtgtgtgtaaaatccagtttaggggcgtaggttgctttctctggggaaagtagctgagctgagacgtggaggagaaggggttagctggtgagaggggctttggggtgggggagaggcgttcctagcccaggaaacggcttatgcaaatagctgtggagggtgagaggttttctgagtccatcctaatgagggcaatgaggaaccctcagagggttttcatgttctgtttgcttttttgaagattttattgttgtttttgcttttgacaagaacacacacacacacacacacacacacacacacacacacacacacacacaattaaaaagtaatccaaactatagagacaagatatggctttagcattccttcccagaggcagtcactggtgccagtagcttgcttccttcctgggaattttctacgcatatacaagtgtatattctacacatgagtaaaatcaatgcctcattttgtttattaattcataattataatacttattatttttgagatggagtctcactctgcctcccaggctggagtgcactggcataatctcggctcactgcaacctccacctcccaggttccagagggtctcctgcctccgcttcccaagtagctgggattacaggcatgcaccaccatgcctggctaatttttgtatttttattttattgtatttttatttttaaatttactttattattatgactctttttttgagatggagtttcgctcttgttgcccaggctggagtgcaatggcgtgatctcggctcactgcaacctctgcctcccgggttcaagtgattctcctgcctcagcctctggagtagctgggattacaggcgcccaccaccacgcctgcctaattttgtatttttagtagagacagggttttgccatgttggccaggctggtcttgaactcttgacctcaggtgatccatctgcctcggcctcccaaagtgctggcattacaggcgtgagcaactgcacctggcctatttattgttattattgagacaaggtcttcctctattgcctaggctggtgtgcggtggcatgctcatagctcactgcagtctccaaatcctgggctccagtgatcctcctgcctcagcctcctgagtagctgagactacaggtgcggaccaccatgcctgaccaatttttgtatttttttttttgtggagacagcgttttgccatgttacccaggctggtctcgaactcctgggctcaagcaatctgcccaccttgacctcccaaagtgctgagattataggtgtgagacacagcacctggccatctgcattgttttaaaaatcacaaatggttgcgaggtatacatactgcccagcaccatacttgtttcctttgaatatataaatattataattttataatatttataatatataataacacaaataataataaatatatatggtttggtcatatacaatatataaaataacattcacaaacacttattgtcaaagtgcaattaaatgggaaaaaaagaaaaacatttggccaggtgtggtggctcatgtctgtagtcctagcactttgggaggctgaggtgggaagatcacttgagcccaggagttggaggctgcagtgagctatggcaacgccgctgcactccggcctggatgacagagggagaccttgtctcttaaaaaaccccaaaaaacaaatctgattctctgacgcatatataataagcacaggtcaaagatttatttaagtcatgaatgaaggaaccagctgtttcaaaggagaatttgggccgggtgcagtggctcacgcctgtaatcccagcactttgggaggctgaggtgggtggatcacgaggtcaagagattgagaccatcctggccaacatggtgaaaccccgactctactaaaaatacaaaaattagctgggcgtggtggcgggtgcctgaggtcaggagttcgagaccagcttggctaacaatggtgaaaccttgtctttactaagaatacaaaaaattagctgggtgtggtggctcatgcctgtaatcccagctacttgggaagctgaggcaggagaataacttgaacccaggaggtggagtttgcagcaagccgagattgtgccactgcactccagcctgggcgacagaacaagactccattaaaaaaaaaaaaaaggagaatttgatgaacagaagttgataggtttagtcaggaaagacgggctggagaaaatttgccaggttagatacaaaactggttaaagacctacaggacaatacaactgtaacctttgaggttaccttttctaccagagagaaatcatttgcaaccaaacttcctggggttaccatttaccttgtcgaagtctagactctaatcaataatgaataacagaccgggtgtagtggctgacgcctgtaatcccagcactttgggaagccgaggcaggcggatcacgaggtcaggagttcgagaccagcctggccaacatggtgaaaccccgtctctactaaaaatacaaaaattagccgggcatggtggcgcatgcctgtaatcccagctcctcaggaggctgaggcaggagaatcgcttgaacccaggaggcagaagttgcagtgagccgagatcgcgccactgcactttagcctgggcgacagagcaagactctgtctcaaaaaaaaaaaaaaaaaaaaagaatagtaaatcaaatacaggtacagtcccttagaatagggtccccaacccccggtttgtagtctgttaggcatggggttgcacagctggtgagcaagcattactgcctgagccccgcctcctgtcagatcagcggtggctctagactctcacaggaacgtgaaccctattgtgaactgcacgtgcgagagatctaggttgtacactccttatgaaaatctaaggcactgcccactcccatccatggaaaaattatcttctacgaaaccagtttttggtgccaaaaaggttgaggactgctgccttggaatatgaagcaaactttgggtgggtctgttagacaagactcccagatgacttggaaatggcatgctgtcagctttttttgtcttattgccgagcctagaactttttttaatttttattttttttgagatgaagtcttgctcttgtctcccaggctggagtgcagtggcacgatctgggctcactgcaacctctgcctcccgggctcaagcgattctcctgcctcagcctccagagtagctgggattacaggcgcctgccaccacgcccggataatttttgtattttagttgagacgtttcaccatgttggccaggctggtctcgaactcccgacctcaggtgatccgcctgctttggcctcccaaagtgctgggattgcagatgtgagccaccacacctggcccctagaacaattttttaaaactatataatggagatcttttaaaatcagttcagagagcagccttatgttttttttttttttttttgagacggagtctcgctctgtcgcccaagctggagtgcagtggcttgatcttggctcattgcaacttctgcctcccgggttcaagcgattctcctgcctcagcctcccgagtagctgggattacaggcacgcgccaccatgcccggctaatttttgtattttctgcagagacggggtttcaccatgttggccaggctggtctcgaacttctgacctctggtgatctgcctgccttggcctcccaaagtgctgaaattacaggcatgagccactgcgcccaggcttactttaaaaaaaaaattaattttttgtagagacaggagagtttcgctatgttgccacctgaacataaatgctattttctttttcttttcttttcttttttttgagacggagtccgtagcccaggctggggtgtggtggcaccattttggctcactacagcctccgcctcccaggttcaagcgattctcctgcctcagcctcccaagtagctgggactacaggcgtgcacccctgtgcccagctaatttttgtatttttagtagagacggggtttcaccatgttgaccaggctaatctcaaactcctgacctcaagtgatctgcctgccttggtctcccaaagtgctgggattacaggtgtgagccactgcgcctggcccataaatgcgattttcattcccattttccaacaaggcgactgaggtatacattgaaggtgaattactaggacaaaagaaagatggcattttacttcaataacagtttgttacaacctgtactgctacctatctgccatgggagtgtgcctttccccacactgacaccagtgctggaagttatcaacctccttcatctttgccaacctgataggtcaaaagtgatcatggaagatccacactcgctttttttttttttttttttttgagataggggtctatttctttttcttttttcagagatggggggtctcactatttctttttctttttttcagagatgggggtctcactatgttgcctaggctggttttgaacttctgggctcaagtgattctcctgccttgacctcccaaagtgctgggattacaggtgtgagccgccttgcttagcccttactgtcgtttttttgtttgtttttgtttttgtttttttgttttgttttgttttgtttttgagacagagtctcgctctgtcgcccaggctggagtgcggtggtgcgatcttggctcactgcaacctctgcctcccgggttccagtgattctcctgcctcagcctcccaagtagctgggattacaggcacccgccaccacacctggctaatttttgtatttttaatagagatggggtttcaccatgttggccaggctggtcttgaacttctgaccttaggtgatccatccatctcagcctcccaaagtgctgggattacaggcgtgagccaccttgcctggcccttactgttggtttaatgccactctcccttagggtgaccaaccaatccagtttgcctgggaccattctggctctagcactgaaagtcctgtgttccaagaaacacccacctctcctccaacctgggcaaagagggacggttggtcaacctgcagtcctgggttataagtgaggctgagcgtgtttgcccatggtcaagaaagaagggatcttggatgagggtgtgtaacaggatcagatttgttttgtttttttcttagagtcttgctgtgtcacccaggctggagtgcaatggcctgaacacagctcactgcagccccaaactcctgggctcaagtgatcctcccacctcagcctcctgggtagctgggattacaggcatgcatcaccacacccagttaactttttaaagaacactttttttttttttttaagagacagggtcttgctatgttgctcaggctggtctcaaactcctgggctcaagtgatcctcccgccttggcctcccaaagtgctgggatgacagatgtgagccattgtgcctagccaggacgagatttttagagggtagagtaggaataagagcttgcacttatgaggcacatgatggcttcagctgtctgctttgcagagtctcaagaaagctctgagaaccttaagcagaggccattttacatgtgaggacacagaggtacagagaggtgagataaatggccaaggtcacatacctaagaggagaaggaggcaggatttgaatcgcagcctgcacgtcaccccatggtgagtaactggtaagtgagtgagcatccctcctcttctcttgcaggccccctgacttgggcctcagtgtccccgaagatcatgatggcgtatatgaacccggggccccactattctgtcaacgccttggccctaagtggccccagtgtggatctgatgcaccaggctgtgccctacccaa

SEQ ID NO: 61465 - DNA, 248 bp, Homo sapiens
gtgatcctgctggaagaggcgtggagtgaactctttctcctcggggccatccagtggtctctgcctctggacagctgtcctctgctggcaccgcccgaggcctctgctgccggtggtgcccagggccggctcacgctggccagcatggagacgcgtgtcctgcaggaaactatctctcggttccgggcattggcggtggacccccacggagtttgcctgcatgaaggccttggtcctcttcaagccag

SEQ ID NO: 61466 - DNA, 1086 bp, Homo sapiens
gtgtccaacggatgtgtgagtaaaattctgggcaggtattacgagactggctccatcagacccagggcaatcggtggtagtaaaccgagagtagcgactccagaagttgtaagcaaaatagcccagtataagcgggagtgcccgtccatctttgcttgggaaatccgagacagattactgtccgagggggtctgtaccaacgataacataccaagcgtaagttcattgagaacatctgccctccctgccctaagcccaatgctctctcctctttacctcctcccaccctctctctccactgtctcttagtctgtgtcctctccctgctccacatttgtctcctttgtacctgggggaacagagaggaatgccctgacttttctttgactgtctggaaaatgggagtcaagtgtggggagtcattcacttcatttgcatgctgcaaaacagagggcggaggcaccagggaaaggcacttgaatgaagaaggaaaatgagaaccagattgtaacttcgtcctaatccacctgccagaactttccttcaggtgtcacacatccatttccatcctaatattaaacaatataatgaaagaaagctttacaacaagtctaaatagtttttattttcgggcagtcttttaacaaagcaaagcaaccgtgtgagttaggtcaccagagacaccaagcaatggtgaaggaccccctccgcccaattctctatccaactaaatttccatgcccaaagtgatagctatcattttttccacggtgtatctgcaaatccacccactgtcccggggtggctgggagctttttaacgggttgagagttgctttttaaggttgtgggtgagctgagatgggtgactgtgtcttcaggagacactaccatttggtttgattttggtttgatttgcaggtgtcatcaataaacagagttcttcgcaacctggctagcgaaaagcaacagatgggcgcagacggcatgtatgataaactaaggatgttgaacgggcagaccggaagctggggcacccgccctggttggtatccggggacttcggtgccagggcaacctacgcaag

SEQ ID NO: 61467 - DNA, 352 bp, Homo sapiens
acccatgcagatgcaaaagtccaagtgctggacaatcaaaacgtaagcttgtcattgtttaatgcatacttaaacaattttatttttgtcttgaaattattaataatgtggttttctgtccacttcccctatgcaggtgtccaacggatgtgtgagtaaaattctgggcaggtattacgagactggctccatcagacccagggcaatcggtggtagtaaaccgagagtagcgactccagaagttgtaagcaaaatagcccagtataagcgggagtgcccgtccatctttgcttgggaaatccgagacagattactgtccgagggggtctgtaccaacgataacataccaagc

SEQ ID NO: 61468 - DNA, 682 bp, Homo sapiens
ggtttgagctgatgggcagcgcctcgggccacttcactgactttgaggacaagcagcaggtgtttgagtggaaggacttggtctccagcctggccaggagatacatcggtgggcgagcgcaggccctggggccctggccggggcgggggtactcctgggcaggttgcacccctatcacgcaggctgctgcctggtcaggagatacattggtgggcaggcgcaggcccttgtggggggatgggggtgacaagggataggttggtggtcggcgcaggccctggggccccaggctggggggtactcctgggcttggtgggtgggcgaaggccctgggcccctggggtggggggtactcctgggcaggctgcacccctatcacccaggccgcacccctatcacccaggccgccgcccaggtcttggacccccttgagccagcgcttcctgatgtggggcgggaggctggcctgcatggagatggggttcatcttgagtcagacgcccttcatcaccttgcaccctccctccgtgggagtcactgaggcgagattcacctgtgctggggggacagcaaggctcctctgcaggtaggtacggactggcgcatgtttccaagtggaacttcgagacgtggaatgagccagaccaccacgactttgacaacgtctccatgaccatgcaag

SEQ ID NO: 61469 - DNA, 730 bp, Homo sapiens
gtgtcatcttcaacgatgtctatgcagcttccaagttcgccctggagggattcttcgaaagcctcgctatccagctgctgcagttcaacatcttgtgaggcgggcacgtgggcagagggggcttggagccagtgatggggaggtggcatcgaaagggggagaggagagatgaagacaatgaagctgagtgcagtggctcacacctgtaagtccagcgttttgagaggctgaaatgggaggatcgcttgaggtcaggcatttgagaccagcctgggcaacatagcgagacccccatctcagcccaaaatttaaaaattagccaagggtggtggtgtgtgtacctgcagtcccagctactcaggaggctgaggcggaggattgtttgaacccaggagttggaggctgcagacagctatgatcatgccactgcactccagcctgggcaacagagtgagaccctgtatcttaaaaaaaaaaaaaaatggacaaaataggtcagggagtggttggggcatcagacttacactacccatgcctggtcgccagcatctccctggtggagccaggccccgtggtcaccgagtttgaggggaagcttctggcgcaggtttctatggctgagttcccaggcactgaccctgagaccctgcactacttccgggacctctatctcccagcctccaggaagctgttttgctccgtgggacagaacccacaggacgtggttcag

SEQ ID NO: 61470 - DNA, 3725 bp, Homo sapiens
tattttaaccaatatttctgaagtccatcaaaatatgggctactgtcctcagtttgatgcaattgatgagctgctcacaggacgagaacatctttacctttatgcccggcttcgaggtgtaccagcagaagaaatcgaaaaggtgaaaaatgttttgttgtggccacataggagtctggttaattacaagcctgtttcatgagagtgcattctcttggagatgagaaactgaagcgtgctattcattcattcattccaacaaatgtttactatgtgtctactgtgtgccaagtactgttctagaaaccaggagtatagcagtgaacaagacagacaaaaaaaaatccccactctcatatctaacaaaatgttgtatgcatttatcctctgactcagcaatcacacgtctaagagtttatcctgaagatgcatctcccacagtgcaaaatgaatatgtataaggtgatccattgcatttgtaattgcaaaatgctggaagttacctaaatgtttagtcattgtagattggctgaataatttatggtacagacacacaataaagtcttacgcaactataaaaaagaagaagaaaagtctcagtaaactgatatggagatatttccagtaaatactgttaaatgataaaaagcaaagtggaaaacagaacatagagaacgctactttgtatgtaagaaagaaggaaaaacaagaaagtaaacgtatgtctgcttacctttgcaaatagaacgtagaaaggataaaccagaaaacaatgaatttggtgatcaacaagaagaaaatgggaagaaagaaaaatgggaggaaacagtacttctggggatatatttttgtatagttttaatttttggaagcatgttaatgttccacatattcaaaaaaaatcagtaagaatgggaagtaggcaaaaatgaaaacaaaaagaaaacctaacactgacagcaaactaaataaagtaacccaattttatttcaaataaatatcataatcttgcaaaagggggatagagctaacacaaacaactgctgaacacagtgtttgactctatatcctcattcttgggcagggtggagcgggggagaagaactacaaataatttctgagttctttttagtttgttttttatagtggtataggcaaagtgattctgaaaattttagatgtgttacaggattaaataaattaataaatgttttgatgttattgggacccagaattctcaccgtggaagaagggacttacaaatatggaaaagggaaaagcaagaaagaactgtgaggtcatggataggaaccggaggtagcactgggaattcaggaatatttatatgcttgtgtttgtgggtgcatgcagatgtgttcatgtttcatgcacataggcatgtatatatagacatatatttgcatgtgtgtatctgtcttccgaaaggctcaagaagcaaaaacaccccagtagccatgagcacacttagcactcaggcttttgtcttaataacattccccactaaaagtaaccctgattcctccaataaatgataagttccagggctggaatggcataggtataaaatgaacctggaatatcttatgccagaaagtaaggaagtgcttttaaaaaaaaaataaggggctgggcatggtggctcacacctgtaatcgcagcactttgggaggccaaggtaggaagatcgcttgagcccaggagttccagattagcctgtgcaacatagggagaccctgtctctacaaaaaattagcaaacaaattagctgggcctggtggtgcacgcctatagtcccagctactcaggtggctgaggtgggaggaatgcttgagcccaggaggttgaggctgcagtgagctgtgatcaagccactgctctccagcctgggaaacagagcaagactctgtctcttaaaataataataatataattttaaagaaataaaagtaactctgtacagattgcttattggttacatgggagaaacataataattttacaatggagaaattagacagcaccttaactgggtgatcaaaattaaccataaggggcagatggacatctcatgccccgagatgtgataccctgtgaaggacacaatttcacttatgtagaatccagattggagatatgtaacctgaatcttatcatgaggaaacatctgacaagctccaaagaaggaatattccttaaaaaaaaaaaaaggagactgtattcttcaaaaacataagagtcataaaagacaaagaaagagctatggaaatatctctgatcgcaggaggctaaacaggcataatgactgaatagcagacaatagactacatcttgtgcagaagagaaaaaaaatgatagaaggatattattggaccaactgacaaaactgaactatgaacagtagattaggtaaatgtatcataacattaagtttactgacattgataatgtactgtggttatgtaagagaagatctctattcttaggaaatatgccctgaagtatttaggagtgaagggctgtgatgagtaatttaccctcaaatgggtcacaaaaaattgtgtgtgagagagagaagggttttattagttaataattctatgaactatttttattcctatatgtttgtgtgagtttgaaactatttccaaataaaaagttaaaaatggagattacattctagtgggagggatagacgatctgtagataaataggtaaaatatccagtacattagagagtgaaaagtcctcagggaaaagtaacgcagggaggaactgctggggcagggtttgcattttgaggtagggtggcccagggagagcctgcagaggagagaacctgaatgaagaactagaggtgagagaaggagccacgtgcacacctagggaggaacattccaggcacgggggactagtatagaaggcagaagcatggtgagcttgtctccagtggcttccctagatcccctcctgcgcatgtgcacacacacctggtgtctctgtcatcgttccctcacagcactgtcacgatctgccagtattctgtttattttgactgccacctccccgcagtctgaggatagcagcaatggctgtgttcacattgttctccagtgcctggttcagtgcctggcgtatggtcagtgctccataggtatgtgtcggatgcacaaggctttgggtgtaaccctcttgacgggtgggatcaacaggtctgggactcaccatcttctcaaacagagccttcctcctccactgctagccatggtccaggacgctgggcgagacccactgtcttgctctttgtaaggctgaagtccatttcccaggcggctacacccaacagatgctgagcaggctgggccaccctgggatccaagacacagagagaaagagcccctgtctggcgcctgaagcacatgccagaggacaggagccagcaggagcctgtttcagcctagctggggatttcattctggaggcgtgagatctgggagcccaaggctttgaactgggggaggtttggggtgtttgcttgtcttctccaaatggcatttctttctcttccctaggttgcaaactggagtattaagagcctgggcctgactgtctacgccgactgcctggctggcacgtacagtgggggcaacaagcggaaactctccacagccatcgcactcattggctgcccaccgctggtgctgctg

SEQ ID NO: 61471 - DNA, 2004 bp, Homo sapiens
attatgcaacccgcctccccgcccgcccggtggagcttccactcggctgcgggctggagcggcggcgggcaggcgtgcggaggacactcctgcgaccaggtaggcatctctgcggccatcctggggccgatctccgtccctgagccggaccgctgccacttccaatctgatgggctactttcggcccaggcagagggcacactgtcgtccttaccgctacccaccctctccctgcccccaaggaccgaagtcctcctcgaaatcttgcaccgggagtctgcactcctgacccactcatcttacctccagcttgtccccacctccccgtcccagctttcccggccccacagccgactctcagcgggcatgccccggtcttcttgctcgttactcgaggggccccaggtttgccccggtaccaggaccctattaggctttcagcgctccccgtgtctctgttctccagtccctggccctgcgccgcctgtgatgtcagcccacttcggactagaacatcccgttcccagcgctggttcctgctgttggccacaaccttcccttttcccctggcgctcagaaaatgctcagtagtaggggtgtggttggacggggagtaggggaagaaagatctgttggctgttgtgtgtcttctgcccaaggcttggggttggtgggggggtctggccagaaaagtaggggactgaagagagaggatcctcgggtccttgacgatggcaggttgccggcttcggtccttgtggtggggaagcagcgcaggggctaaagaaggaaaggttgtgttgtcttgaccagaatgactgggatccaggcgagagtcaggttgaggggcttttgcgccgagggcagtggccgttgtgcttcgtcctggggaagccaggaccaaccctgggatcctaataggccgtcccacttcttacggccaccgagccatcctgggactggggatatgtaagggatgcgtgacccccccggccgcgcccaccagtgtgagagtgggccgttcccccacttccgccgggaaatgggggaggggtcgctcctcccgccctcctgtggtccctccagcaaccgctgagctcagcagctgacgtcggtttccctggcgaccgtggcggcggcggaagcgcgtggtggggccgcgcacgtcggcgcgcatgtgcagcgggggtggcaccgcccccggataaaattagcctggaggcctaaatataggaggcgaccagctcacctcctgctccgaggccttggaggcccaggcagagtggacacctaatgggaacttgggaatgggaagtgtccaggtttttgtctacagccgtggttctcattgactgctcaggccatggtggcaggggatgtgaaggaaggccccggagaaccttctcccgctggcagtccccctaagggtacaggagacatcctgactccccattggaagccccaggcctgggttccactcccatcagtcctgcaggaggccaggcagggggaaggtctgagtgaagccagcaggtgctctggagttaaaccagctttctgcaagccctgcttcctggtctccctctccaggtactggctgtgatcgaacttctcaaccctcagagacttagatcttccacctcactccctcagccaagcctccaggccccctcgtgcatccgtggtggcctctctgccttctctgttctgttctccccatggcccagacatgagtggccccctagaaggggctgatgggggaggggaccccaggcctggggaatcattttgtcctgggggcgtcccatcccctgggcccccacagcaccggccttgcccaggccccagcctggccgatgacaccgatgccaacagcaatggttcaagtggcaatgagtccaacgggcatgagtctagaggcgcatctcagcggagctcacacagctcctcctcaggcaacggcaaggactcagccctgctggagaccactgagagcagcaagag

SEQ ID NO: 61472 - DNA, 1453 bp, Homo sapiens
ctctctccggtctcagcctcaataccctgaccatcttctctttctgcaagaccccggagctgcggactccctgccacctactggtgctgagcttggctcttgcggacagtgggatcagcctgaatgccctcgttgcagccacatccagccttctccggtaccagccccctccccagtccacaggctctggggtcctgcctggggcctgacccctgggccctgggcagccaggccaagggcatttttactacttacagaaaattggccaagggcagagggtgggcaggctaaaatgggctgaattccagattgattctgaagaacgacagctgatttctggaagacaggggttgctgaaacctgatgaaagagatggtaggctgtagagatcaatggtgtgggttctgtaaccaagcaacctaggtttgcattctggcttcagcatttctagttctgggcttcttccataaatcggatattatttcctaactcatataggtggttggaagtatttacttctattatgtgtaaataacttaaaataatgcttgatacctaggactctacgtaagtgtttgtgaacacaaatgggggcgttatcaccactactgcacccgtatgtatctgggctcctggagtggagggacaccgatgcagtgtggagaggataagaggcagggaggggcagtcataactagctagtgtctaatacctccttatacaaaaaccagggtcttccatcacagcttcagaaggtgtttataaaattgttttctgaagcagactggacattctcattctggttttggacactacagacggaggctggagcccccccggatgtgcatgctcagtgctgaccagcctggggggtctgcatcagtgagaactcttcctcccacagagaattgaagtttccacctttgcttgcccttttaggctggggaggcctgggatctcccctctgactttgccttcatcttctgtgtgaccttggcttcagtatctttgcctctttgaatgtcagtttccccacctatcaaatacaggcatgagctctcctgtgacagagggatctgatcacgcagagagagcctatggcccaaccatggtgcagtcaaagtcacccagcctggagagtgtgcattgggctccaccccttcagcccagttacttgagctccaacgcctcataggaaagacaccaatattaaggccctcttcagagaagaagggcagcattcaggaacacacactccaagctgtacttggcaggtgtgggaggtggaaaggatcggaggagaggtcactggtgcccagtgtctcccacaggcgctggccctacggctcggacggctgccaggctcacggcttccagggctttgtgacagcgttggccagcatctgcagcagtgcagccatcgcatgggggcgttatcaccactactgcaccc

SEQ ID NO: 61473 - DNA, 800 bp, Homo sapiens
cctaggctgccacctgtaggtcacttgggctccagctatgtggctgcctcttctgctgggtgccttactctgggcagtgctgtggttgctcagggaccggcagagcctgcccgccagcaatgcctttgtcttcatcaccggctgtgactcaggctttgggcgccttctggcactgcagctggaccagagaggcttccgagtcctggccagctgcctgaccccctccggggccgaggacctgcagcgggtggcctcctcccgcctccacaccaccctgttggatatcactgatccccagagcgtccagcaggcagccaagtgggtggagatgcacgttaaggaagcaggtaagtatggtagaccaccaggaatatggtgtggggtgtcctgatccccacagtcaccccaggagtcacctgcaagggctgtggtaagctaaagggacaatttgaggagaagcagttttcagatgctcccaggaagaagagggagctgtgggagtgcctcacctacccccagcatccttttcatctccccacagggctttttggtctggtgaataatgctggtgtggctggtatcatcggacccacaccatggctgacccgggacgatttccagcgggtgctgaatgtgaacacaatgggtcccatcggggtcacccttgccctgctgcctctgctgcagcaagcccggggccgggtgatcaacatcaccagcgtcctgggtcgcctggcagccaatggtgggggctactgtgtctccaaatttggcctggaggccttctctgacagcctgag

SEQ ID NO: 61474 - DNA, 8794 bp, Homo sapiens
gatgaagaaccccatgctggaggtggtgtctttactactggagaagctgctcctcatctccaacttcacgctctttagttcgggcgccgcgggcgaagacaaagggaggaacagtttttatgaaaccagctctttccaccgaggcgacgtgctggaggtgccccggacccacctgacccactatggcatctacctaggagacaaccgtgttgcccacatgatgcccgacatcctgttggccctgacagacgacatggggcgcacgcagaaggtggtctccaacaagcgtctcatcctgggcgttattgtcaaagtggccagcatccgcgtggacacagtggaggacttcgcctacggagctaacatcctggtcaatcacctggacgagtccctccagaaaaaggcactgctcaacgaggaggtggcgcggagggctgaaaagctgctgggctttaccccctacagcctgctgtggaacaactgcgagcacttcgtgacctactgcagatatggcaccccgatcagtccccagtccgacaaggtatgatgtgtgactcccaggggaagtgggctccgcggagatgccccctcccatccctgaccttttctcttccccgcgagtagggatctaattcctggacacctcccctaccacttccataccatcctttttctttttccttttttttttttttttttttttttttttttgagacggagtctcgctctgttgctcaggctggagtgcagtggcgcgatctccactcactgcaaactccgcctccagagttcacgccattctcctgcctcagcctcctgagtagctgggactacaggcacccgccaccacgcccggctaatttatttttgtatttttagtagagatggggtttcaccgtattagcaaggatggtcccgatctcctgacctcgtgatcctcccgcctcagcatcccaaagtgctgggattacaggcgtgagccaccgtgcccggccttccataacattcttaaagttctagattaagtaaggaaagttctggtgttcctaaggtaggctaagtaaataagcaaatggcaacgtgccttgcaggatatctcgaaatgcttagagaaaggatgtggcaatgcaggaccgcttccagagattccagagctgcccagtattgctgcagaagtcatcaggtgtccacccacagtgtagttcaaacgacaaagggcaagtgactgggggtgggggatacaaggaatcagtcaccgctgcttgcaactttaaccaagaatttcacttgaaaggaagaggtccagagtttatatttaatccataacactataaacaaagtgtgtgcctttaaaataaggaaccatgcagttttctccctttgaaagctgcatagagggatttttcattgcttgctataagctatcaaaattcccagtaagagggcccccctggtagttcccttattctttgtgttggtgcttcagagttgtattttccatggtattctgaattctttctgggttggctttgatcctcatctagacttcattgttaagcatcctttacccattagccctgaaggtagattacattgtttatgggttccccagagatcaatacaattagttttcaagaagagatgttaaacattggaaggtaatttttatgagtattttgaaaaaatactcatgattattaaattagccacaaatccaaagggaaaaatggatttttatttccttttaaaacctcttaacttttaaaaatagttaagattttaagcctgaaacttcacttacaattggaaactttctcagccttcattgcacttgttaaagaagtcattgttaatgttcagtctttataatggaaacctgggcaataacatatgagctttagtgttactcttcatgtttagatatttttgggaccagaaaaagctaagtcagtttttttcatgtaaccagtttttaattgctccacatcttggttaatttttttgacccatttgggaacatctttctctatcctctgtgggagagcatggaagtattttgcttttatagatcggtgtatgaaactccttatagattttatagagccacaaaagactcaatctaggaattcttttccaagtaaaataaaaatacagttagagcactgtgcagcgattcaagaatcacagctctagtccaggcctgtttagaaatgaactccaccacatttacaaacacgggctcccaaagtgtacaaaaggaaacatgtcagatttacttaggaaccaagcaaatcatttctctaaggaaaaacagtatttctatcaggtaattaggagttaccctttcatggaacacatatagcgctgcattatatatttctacagaaaaacagtaactagtgcttttgtaaggtagtaaaatatttaatctgcataaataactagttggagtagtttttcatctttggaaactttgttagggtctacagaagtagagaagtgttttaattgctgttgctgcatagcacctcttgtgaaactgagttttgtcttcactttgaatggtctaacaaacaatttggccacagagtagatttcccgggggaaaaaaaaaagttttcatcccaaatttcctaattctacaaactgtttttgaacatgcactgagagaagtaggtcattaatactgaaggaaggactggtttctactttttagaaacataagaaattatttgattctgggtctgattgctgagttctccatatatgcaactaatattaacatgagagttacaaagttgcctcttacttaaatttgagttaataaaaactctcaagaacacactacccctaaggaaaacactgcaattagtttgcaaatgaatgaactggaaaagaacatttactcctttgtggtaacactctattttacaagtttagaagtcataaaataatgggatttttataatactgttgacaatcagtattttgtaaactaaaaattcctttggttaataactattactattccttatgctttttctactatgatttttttttactttgttaatactgctctttcattgccaaaaatgattgcaaatgccccttttaatttgtgtggattgagtgctcacaagagtgttcctacagacttattgaccccttctagaaatttcctactgttgagcaccactaaagatgcctgctggtctgctgaccaagtgaacaggaacagggtattagacatgagttgctttttgagaaaaatctgcttttgtgggaaatacagtcgaaaatgattctgattgacttaattataaattaccaaggaaaaaaataaggataactgtatttacaacttagtcatttacaaaaatatgtcttccatcaacctccttttctccttgtcctgaaaacttcaatttgatctttaccatcttaaaatagtatacttctcaatgccttgctagtttattaaaaaaggacaaatagtatgtctgatagaaaaataggccaacatctagataagtttcacacttgtttaggtaattgtgtaaaagtatggatagagataaccatactgtcaaagtggtgtattaaaacatattgaacttgttcattctatcacttaataatttggaaacctagctgcccagtaccatgtaagccactgtagaaaaccctaaaagaacataaaatgccatgtctagaaacagagcttaaaattagtatgaatagcaaaacccatatagaaatgactgacaatcactgcattctggcatcaacggcaatatggtagagataactgtcaacaaatagagtactaataataatcactgtaataccttatgtttatacagcacgtagaagaatacagaggacttgtgcatcaaacatctcagttaatcctcagaacaatttgagtgttcccatttgactacttgaggtgacatagccaataagagctggagccaggactcagacataggccatcatttctaagtaaaattatttttctaaggaaaacattacacatattagaaggatgcattcctcaggggtaaggacaatatttgtctttttttccagcagccagttatgtgtcacataattgatcctgaatttagcatatttagtcaggaaatgggatttgacaataaaattagactttctatgcctgtagattttgagacttataaaaaagttatcattggtatcattagattttagaatggcagattggaggaattgaatctacttttaattggccaaattctattatttttactcaagattagagacacctctttgctcatctaattttaaaatatgctattgttattgataagcagtttgatgttttaaacctttagtcctgaataaccatgtggttatactttctatagttttctataaatgctgtatttacataggcaactgccattattagttgcctaagggatcatttctgctactatacggtatagaatcagaactggactcttaacattgtaaatttttttgtaagtcataagaaaaagtctagttcttctggtagacagaaaatagctgggaaaactgatttactgtttgatatatgtgattcttcttgggtttagccacctttcctaattttccaatattttattttccagttttgtgagactgtgaagataattattcgtgatcagagaagtgttcttgcttcagcagtcttgggattggcgtctatagtctgtacgggcttggtatcatacactacccttcctgcaatttttattccattcttcctatggatggctggctaacttcatacccccatgtcagtgtgtgtattctgtatgtaaatatgtttatatttatagagcatcaatcaatataagcattattgagaaaaatgtgacccgtaacactgtgttctggataaaaatgtgattaggaatcacgcaaagtgcttactgtgtaagcccaagaacaaaggctttctgaatcttctcaggcagttcagatttaaagcaccatccaaaccttggaaatacgacagggtgtggtagaattcagcaatatgagaaaaccagcccctaaaatgatagccacaagagattaattgtgtttttttttctcctgtaatccttgtactgttcggctgaatttgaagattggaagacttatattgagaccagtaactttactgtaaatttactttgtttcattgaaaaaacaaattgataaacatattaaactggaagaattttctttattcaaatgaaaacatgtttgatgactggtcaaaaaataagctcataatctatttttttcatgtagtatataagtcaagaatgttttattgtcattatgtgaaaccaatattggcaaatagtactttaatgatgaagtaaatgaccagaaattatagaaatctgtgttttcctgtaaaaatagcactatagtatcacttgaacaatttgatttggctttacttactaggaagcctggaattcattatttttttccttttatgtgccactgtggctactttaaatcactctgagaggtaaatggatataggattgaagttatgtgggtatttggcatgtgtgtgtgaaataaatatgtagatagtcacatatacacagactgagagataaattgttcttgattgctttattatcatcatactagtgtgttcattatagagtatctgtagaggtgaatgtaaaagtaagtccaatctattttcttatgtcattgaatttgtagtgttaacttgcatatatgttattggatgggttgtcttttaaagcatttactaatgtactctgaaatttttaaaagccttcagatttgttttctagtcacttttttccatatcatttctaattatagtttatatccttaaaagaaggatgccacagtagtatgtaaaacccaaacaagtagaacccaagcaaataaaattatttaaaataattttaaagtggcttagtactgccagtcatgtaaattgattctgctgagggtcttataagaattgagatataacaatggtaaaacaagcattcaagcacttttacaaaattaccaaattcttaaaatgaagccacagctagacttgcatttcaggtattaaaattgctttcttaactgtcaagaatcacaaaataacaaatcatattatgagtgaatatggggagggcggggccaatcagtcaatgataatctgaacaaattttaagagcagattttagattaataatgttttatcaccactaatttgcccacaacaaactcagtatttaatttttcaaattaaatattaaattatttaagtattttaaataattaaaacattaaatggcaacaccatagaatataggtgttctctggacctattctaaccacttaaaattatcttaagtatgcatacataaaagcaaccactatgagaactaccgtgttagtggtttttcacttactgtatattacccttgtaggaatagtttaaggaaattcatttcttaaaaatatagtgtcctcaaataattaatttttttgcaaactttagttattacaggcagcaaaaaccactgtctgaaactaaatctgtgttcaaagatgaagacccctcattaaaagccaaggacgttcttaagattggaactgacataattagtcttgacttacttcattaaagcaagattcaattccttgttcatttgagtgttcattatatgccaggcattgaccagttgcaattttatggtccagaattaatattattattcgtaaactagctataatagagtatatacagtgctgtgggaatacaggggaagaagcaattaaatctgctagaagggtaagagaaatctgtatgcaggaggcaatgctagcattaagccaagaaatagtgtgaggtgatcttatcacactgatgtgttcaactgtttatgggaaaaggaaactaggatggttttatttgtgaaatgttctacaacgctagaactgttgaacttcttgggagaaaaggagaatctttgttttgttgtgctgagtttgattagttgcttaaccaagtagaaagaaaagcacatcttcctgatcacagttataaaagaaaccctgaggccgggcgcggtggctcaagcctgtaaccccagcactttgggaggccaaggagggaggatcacaaggtcaggagatcgagaccatcctggctaacacggtgaaaccccatctctactaaaaatacaaaattagctgggcgtggtggccggcgcctgtagtcccagctactcatgaggttgaggcaggagaatggcgtgaaccgaggaggcggagcttgcagtgagtggaaattgcgccactgcactccagcctgggcaacaaagtgagactccatctcaaaaaaaaaaaaaaaaaaaaaaaaaaaaaaagaagaagaaaccctgagccattaatgtgtctcgtaacttgaggaagttcatgaattctctgggcttcatccattaagattcatccttatgctcctgcaagtttcttatatttatgtatttctattctgatttctgaaatgataacctagtagtgtctgatgaagttttttcatgcttattttattctttgtcacagatgaaagaagaataggactaattggggctaagatgaattaatgtaagtgtcagatactaggcaggtgttagggatgaaatgatgaatgaggcatggacctgttcctcagagtttatggcccagtagacataattgtattaggactttctgcagttgacatttgcataaagctgactgactgaaggaacagaaagtgagacagacagatatgaccaaatttatacaaaccatgtaccaacacttgaaagatgggtggatattttccaggaaacagattttgggcaggacattccatgcactggaaatagcatgaacaaatgcatgaaaattgcctacaacatgcctggcacatagctgtgaggtaccctatgagttgttgacttgaaaacatggaactgcacagggcattcaggcaagtgcaagtggttcaggggccagcgcagagcagagtgctgagtaaagatgtcagaaaaggaaagcaatggtctggtacaagtcttgtatagaacaagaagtttagacttttgaacaggcaatcgagatttggggttcagaaagataaatcccaaaagtatggagaacaaaggaactcattttaaaggactagctaagatgctcaatctctaaaaaaaaaaggatctgtattcgtgagagtagagagaaaggttgtttaggaagagtcaacagactttagcaaaatccttttatttgattcatgcataactcctgatggagtgtcaaggaagactcattcacttttctttcctgccagaaagttggttcttgcaaaatagattaacttgatgactatgtgtatattggatactcctaattttagctctgttagatatgtttctttctaaggacaagcaactatgtatagacttgttgtttgaattttttttcagtatatatatgtttcttgtttttctatttttctacttcatactgttaatgtcaaatatcaaaaatgttttccagcaatatcaagttatggcaatggcaaaagtccttgttgtagatgagaagcatataagaaatggttgccaatctttgttttgtatgatctatttagagttttaaccaacctagatctgtcagctaagctaattttatatttggtatacatgcatgtcaaataaagttaattttacatact

SEQ ID NO: 61475 - DNA, 7087 bp, Homo sapiens
gcgcccccaggaagcagcggcgggagcgcaccaccttcacccggagccaactggaggagctggaggcactgtttgccaagacccagtacccagacgtctatgcccgtgaggaggtggctctgaagatcaatctgcctgagtccagggttcaggtggggtggtgggtccctggacccctcccgacacttcctgtgatctcaggaggcctgcccggaacaaagagtgatgggaggagggagagatcacagagtgacagccaaagttataaaggggacaataatccctctccccaccatcccactgaccgcctcatggctctcattgcccctcgctcctctccagctgcgctggccctgacctgcctgccaagcaccctcctgccttgggcctttgcactcagtttcctctatctggaatgcttatttccagataaccacacagcaggccccatcgccttgttcgagtctttgcttatccatcagtgagacccacactgaacacagcatttaaaattgcatatgatttacatatggtatctcagagtctgtttatttagactctgtctctcccaactagaatgtcaattccactgacggacactcagagtagtagaaaatggttaatacatgtttattaactgactgaatagacggatggatggatgggtgggtggatgcatagatgaatgtatgtatgtgtgactgtaggtgtgcgtgtgcatgtatgactggaagcatggatgagtgtatgtatgtgtatatatgagtgtctgtgtgtatgatgggatggatacatgtatatatgtgtgtttgcatgaacgcacataggtatgattagatagatgatgaatgtatgcatgcatgatatatgtatacgtggtgtatgtgcacatgtatgtatacatgcttgcatgattggatggatgggtatatttatttatttgaaatggagtctcgctctgtcgcccaggctggagtgcagtggcatgatcttggctcactgcaacctccgcctcctgggttcaagtgattctcctgcctcagcctcctgtgtagctgggattacaggcgtgtgccaccacaccgggctaatttttgtatttttagtagagatggggtttcaccatgttggccaggctggtctcaaactcctgacctcaggcaatcctactgcctcggccttccagagcgctgggattacaggcgtgagccaccgcgcccggccggatgggtgtatttatgtatatatgagtgtatgcatgtatatatgattggactgataaataaaatgtgtgtgttagtatgattgtatataggtatgactggatggattaatgtatatgtatgcatgatgtatgtgtgtatgatgtatgggtgtataattgtatatttgtatgtttgtataatcagatggatggatgaacatgcatatgatgtatgtatgattagatagatccattaatgcatgtatgatgtatgtgtgtatgacctatgtttatataattatatgtataagatggatgaatctatgtatgatgtatgtgtgtacaattgtatgtatcatcagatggataagtctatgtatgatgtatgtatgatcagatggactggtgaatgtgtgtatgacatatatatgtgtgaggtatgtatatatgatcagatggatgtctacataatgtatgtgtgtatggtgtatgtatgtataattgtatgcgtgtatgtttgtatgctgtaggtatgatgttacatatatgtgcatacacacgtgtgtatgattggaaggataaatgaaatatgtatgtttgtgtgattgtatgcacatatgattagatagattagtgtgtagctatgtatgctgtatgtgtgtacaatgtatgtgcctataattgtatgtttgtatgtctgtatgatcagatggatgaatatgtatatgatgtatgtatgatcagatagctggataaatgtatgcatgatgcatgtgtgtatggtgtatgcatgtataattgtatgtatgtttgcattagatggataaatgcctgtaggtatcatgtatgtacgcatacatgcatgattggatgactggatgggtttatttgtgtatatatgagtgtacgcatgtatatataattagatggataaatgaaatgtgtgtctgcatgattgtatgtatggattaatgtgtatatatgtatgatgtatgtgtgtacaatgtatgtatgtataattgtatgtttgtatgatcagatggatggatgaatgtgtatgatgtatatatgtatgatcagatggctccattaatgcatgtatgatgtatgcgtgtatgatgcatgtacacttgcatgtatgatcagatgagccagtgaatgtatgtatgatgtatatgtgtatgatgtatgtatgtatgatcagatagatgggtaaacgtatgcatgatgtatgtgcgtatggtgtatgtatgtataattgtatgtgtgcatgtttgtattagatgggtggatgaatatgtgtatgatgtatgtatgatcatatagatgggtaaatgcaggcatgatgtatgtgtgtatggtgtatgtatgtataattgtatgtgtgcatgtttgtattagatggatggatgaaaatgtgtatgatgtacgtatgatcatatagatgggtaaatgtatgcatgatatatgtgcgtatggtgtatatatgtataactgtacgtgtgcatgtttgtattagatgggtggatgaatatgtgtatgatgtatgtatgatcatatcgatgggtaaatgcaggcatgatgtatgtgcgtatggtgtatgcatgtataattgtacgtgtgcatgtttgcattagacggatgggatgaatgcacatgggtatgatgtatgcatgtgttcatgcacacatgcaggtatgattggatggatagatggatggatgggtgaatagacgccccacagctggatgcaaagtagacagatgtgaacccagcacctctcaccaataagtgtcctcatccccgggcaccctgcggctctcctgggcctcttccccacttacccacccccatctccgctcttatcccccaggtttggttcaagaaccggagggctaaatgcaggcagcagcgacagcagcagaaacagcagcagcagcccccagggggccaggccaaggcccggcctgccaagaggaaggcgggcacgtccccaagaccctccacagatgtgtgtccagaccctctgggcatctcagattcctacagtccccctctgcccggcccctcaggctccccaaccacggcagtggccactgtgtccatctggagcccagcctcagagtcccctttgcctgaggcgcagcgggctgggctggtggcctcagggccgtctctgacctccgccccctatgccatgacctacgccccggcctccgctttctgctcttccccctccgcctatgggtctccgagctcctatttcagcggcctagacccctacctttctcccatggtgccccagctagggggcccggctcttagccccctctctggcccctccgtgggaccttccctggcccagtcccccacctccctatcaggccagagctatggcgcctacagccccgtggatagcttggaattcaaggaccccacgggcacctggaaattcacctacaatcccatggaccctctggactacaaggatcagagtgcctggaagtttcagatcttgtagaggacgcagtctccatctctctccatcgggcctcgggaccctttctcttctgaatctgcttccctgcagtttagatcccgggatggcattcctgagaaagcaacccgaaccagctgtccttctgacagctcggtgttcagcttacagagaccacccctttcctccacagggagaggctcctccctctcctgggacagctcacaggtcctagtgattctctcaaccctaacaccgtctggcacgattgtgaccgctgaagtacaccacgagctccaggcttcagaaagtggtgctgagaacttgctccaagaagaagtcaaaccaaacttgcagttgatttggggtcatgtttaggtcagaatcaccgtgcccttgaacaagcaggtaggggggcttgataacttaactttccacgtggacagaatttttttttttgttttgtttttgttttgcagacacagtctagctctgtcgcccaggctggagtgcagtggcacgatctcagctcactgcaagctctacctcccgggttcacgccattctcctgcctcagcctcccgagtagctgggactacagatgcccaccaccaggcccggctaattttttttgtatttttagtagagacggggtttcaccgtgttagccaggatggtctcgatctcctgacctcgtgatccgcccgcctcggcctcccaaagtgctaggattacaggcgtgagccaccgcgcccggcccttttttttttttttttttttaattgagacggagtctcactcttttgcttaggctggagtgcagtggtgtgatctcagctcactgactgcaacctccacctcccgggttgaagcgttgctcctgcctcaatctcccaattagctgggattacaggtgtgctccatcatgcccggctaatttttctattattagtagagacagggttttaccatgttggccaggctggtctggaacccctgacctcaagtgatccgcctgcctcggcctcccaaagtgctgggattacaggcatgagccattgtgcctggccctacacgtggacacttctttagcatatggttagggacctttctagaaattccaaagacagactttaagaagccccgtcgggaaaccttaggccaatgatgtggttacattaaaaataaattatctgggaatttcacagacttcacaaatgtcaggcttacatggtaggtttaggggaccgtttgagagacaaagatctacattcatatatgtagctatacatatatgtactttttcttcttagtttctttttaaagacattttatcactcattcgctcattagcacattgggaatgtgtgtatttggtagggaaatgaaaggcaccttgcctgttccatctctactccttttttcttttgttttaggattttctaaaggtgagacactggtggaactggggtagctgcttgggacgtaccacctatagttgtggctatttcacagagaagcagcagctagacagactcccatctgtaaataaacaagagataggaagagggggaaatagatttggaggaggcagccctacatttcaaacatacattcccttttttagatttttttttttttttttttggttttcagttttgatggtgggattggaaaatagagcttggcttgaggacattttcctggggtggcaccattatttcttgaaatagaatcttacttatggtgacactggcaagcacttgtgagaacctgaagacggattgaggtcatttgatgctcagaagttgggtgctgggtccctgccttctcagtccgagttctcctttcatttttgggtggggaggcgggttccaagagcccttcattggtggagttcacaaggcaaggtgtaaaaaaaaaagtagggcaggaagacagtggtgtgctggcagaggtctaacaatgggctctccaaggaagaggaaaaggttggttgtggagtgtttgtcagtttccgtggtgtaaatactcccaccacggctgacttcaagctagcaaccggaggtcactgaactaagagttgggaagagatagggcacaatatatgcttacgagttggtacacaccgtcagcagcagccagggtcaggagaaaggcgagatgtgaagagaggccgggaggtatcagatgacgtttccagcactagaccagaagaggtgcacacagcctagaccccctgaggggtacaccctgatctctagagcccacaaagaggtttttattcaacataaaacgtgttcatctctcataggcctgagtcatgctgggttctgggacattaagcccaggagtgggccgggtgcggtggctcacgcctgtaatcccagcactttgggaggccgaggcgggtggatcacctgaggtcaggagttcgagaccagcctggccaacatggtgaaaccctgtctctactaataatacaaaaattagccgggcatggtggcacgcgcctgtaatcccagctactcgggaggctgaggcaggagaattgctggaacccgggaggcggaggttgaagagagcagagattgtgccactgtgctctagcctgggtcacaagagcgaaactccgtctcaataataacaacaacaaaaataacccaggagtggctcaagagtccagtgtgggatgaaaatataaacagaggaagacaacatatgtcactggggaggctgggggagctagacaaaattcacacgggaggggcagggatgagacaatattgtgccctgggtctgtgcaaacgttgggaccagaatccactataagtttcattcttcggagacacggaagctctgcactggaggccgggactcaggcgtggaagagaatcttctccttattcaccggggaggctgtgtcttgtgcaaacaagtcatagaaacttgatgggagttggggagggactgaaggatgcatgcaaggttctgggaaggagtgagaagtagtgaaggccaaggggcccccatcacaggccgatggggtaagacttcgagagagcctgatcctggggtcttctgagactccaccaggagccggagagggcagggagccaaatccagctaggaggttacagattgcttttcctgggctgggctcctgagtgttggttcttccagctgtgcacaggggatttcaaacgttctacgtcctaaagccaggaagagtgacaaggcaggtggggacagaaggaagaagccaggagcctccctgagaaggtgtcaccttatctgtcctcctcttccccacacactggcctctgggtcccccttctctgtccacccacagagtgaaaccaattaaaatgttggatctcatttaa

SEQ ID NO: 61476 - DNA, 1453 bp, Homo sapiens; identical to SEQ ID NO: 61472

SEQ ID NO: 61477 - DNA, 2163 bp, Homo sapiens; identical to SEQ ID NO: 30628

SEQ ID NO: 61478 - DNA, 2175 bp, Homo sapiens; identical to SEQ ID NO: 30652

SEQ ID NO: 61479 - DNA, 1500 bp, Homo sapiens
gagcagtttctcctcaaataccccaacggagtgaaccccgtgaacagcaacgacgtcttcttcagcctgcacgcggttgtcctcacgctgatcatcatcgtgcagtgctgcctgtatgaggtgagaccagccctggccccccacaggccaccccagccaacacccgccaccccacctcacctttgacagaagacacggcagagcctgggaaaggaagggtgtgtgttcattcatccaggtcctgtgctgggcatagaagacacccatgagtccaggccctcagagccccccaagtctggggtgagggactcagggagaggcagtgcctggactcaggctgagagccgtgcacagaggagcacagacagctcatggaggagtgcaaggccctgagccctgccagggaggagggaggagggcacagaagggaggagggaggagggcacagaagggaggagggcagaggaagacgcttggttgggctccaaggatgagtgaagttcctatggaggaggggaggggccagggtgggctcctggaggggtcaggtcacagaggccaaggggcatttgagagggaccctgagcaggcgggtgcagctgggcttcagggtgccaggagggggcccgcgtgcaggcggagacacctgtattcagctttgttgctggaagccatgggtgtcggcagggcagggccccaccaaggctgggtccggggacccctgatatgacagctttgctttcccttctctcagggagttcccttcacactgtaaggccagctgggggctgtctggccccacccgtatgaaccttctaggctttcttagcttttggtgtgaagcgagagtgaaggtggcccacattgggcccgtgttcagggaaaggcaaggcgaggggacagattcctgagatcctcaggctgctgccgggtcgtgggacgagtcagtacctggctgggagaggcaccaggccaccagagttccgaccccacgtctccaagtgagtgctgagaggcgcccagttctgccaagtaggaacaaagcagacagagcttgagagtccaagcagcctgaacaggaggccctggcgatgagaaggtgtggttggtgctggggatgtccagcaccagcccaggtgtgatgctttctgtggtccacatgttcccctgccacaaccccagtgcagcccccaccttgcaggggctccttcaaggccagggtccagcctccgtgcccctctctaagcccgccctatccggggccgtccttgctcagccccggcgtggcctctgtgtgggtccacatctctgccctcctctcgcccccagcgcggtggccagcgcgtgtcctggcctgccatcggcttcctggtgctcgcgtggctcttcgcatttgtcaccatgatcgtggctgcagtgggagtgaccacgtggctgcagtttctcttctgcttctcctacatcaagctcgcagtcacgctggtcaagtattttccacag

SEQ ID NO: 61480 - DNA, 895 bp, Homo sapiens
gtttggcttcatattgctgacaaaaaaaggaaaaagtacctcaataataaatacagaacttctcctttcaacctcttccatcacatcaacacctatgaagacaatgggtttctgattgtggatctctgctgctggaaagggtaagaaaggacactggacaaatgggacacctcccattgttcctggaaattacggggtttttacagagctgctgcactcaatctgaatcacatctaaaacagcaagagttatgtgagagtcaaaaatgtaattggaaaagcagtaggaagtttaggtaatctgaacatcaaaactatgattaatgattgaaaactaatcgggtccatgaaccccacctgaaaacaaaagattctgtgacctgagaggtgaacttaaagttgacaaaatccctggggaaacttgagccccatcttctctgcgaagggagaaaaagacatgcgtttttcagactagccaaatcactaagaagacaacagcacctaaggacacaaacagaatggtgacaggaagacagaacagaaagtatctcaaggctgctgttacttaaacaaatccattaagcaggttgctttattttcatcctgtgtgggcgggaggaaatggctctgatacacctggctcaatagcagtttctgggttgtggaataaagaacaggcaggcacttgtgcttaaaaaggcaagaatcatctctctaaaattatttgtcattgcctgtgctcatgtttgactttttatttttgcagatttgagtttgtttataattacttatatttagccaatttacgtgagaactgggaagaggtgaaaaaaaatgccagaaaggctccccaacctgaagttaggagatatgtacttcctttgaatattgacaag

SEQ ID NO: 61481 - DNA, 1971 bp, Homo sapiens
cgcggtggccagcgcgtgtcctggcctgccatcggcttcctggtgctcgcgtggctcttcgcatttgtcaccatgatcgtggctgcagtgggagtgaccacgtggctgcagtttctcttctgcttctcctacatcaagctcgcagtcacgctggtcaagtattttccacaggtacctccagggccctgttcacatggccggtggcaggagaggtgagagctacatggcccaggccctgctccggtggggcagctcctgccggcgtgaggaaacaggacggaaagccacagggagcccgggagcccagcgggagcggggcggtggggaggccagcctgccgctcttcccccggggctggaatcacaggagatcgctagcggaggccccttggaccccacgctcccctaagcatcaggtgtgcgggtggttccccttctccacaccccagcctttcctgatgcctttggctctgccctcaccactgcctccatttccacagcaggacactctggagaggtgaggtgggaggagggagccccttcccgcgcagagctcagcccgtcctatgagcatagccggtcctcttcagatccggggactcagggtccagcacatcttgccccacagcctgggacagggtcagggctgaagttgctgcacccggggacctagggcctcatttaactcaccccattcccaaagggagaagccttgttccagtgcccccagccctgggagcctcgtgttctgtgagctcaggagggccagcgttctgactgggaggcaggactggactcttaggctgagcaggactaagttctgtggccaaggagcccgggcgttccgggccaggccagcctgcacagaggctggggcgggacacggggcggcagtgaggggatgtggctggttgaacagtgttgagcatgttgaagctgggaagctggggtcaggtcccgggagctggggggggcttccgaggaggggaaggtttggggaagtgggccccagtccctgagggtgggagggattggggccaagaaaccggggatggaggagcccaggttggagacgtttggaactgctggaggggcagcagcaagtacggaagagggtgagccgggacacagacagggactgactagaggctcactgggaggccaccagagaggccaggacctgcctcacggggggaaggaaaggtcacagcagtcagaggacccacagggctctgcagcatgggaggacgtggggcacaggcagtcagactggggcgcatccccgcagacccgcccccccaaccagacccaggaagccccggccaggcctgtggggggcgttaaccccgctctacagacggggaaaccaaggctaggagaactgtcacttgcccaagacagcaggctccggtgatggagccaggattccaaaccagaagtcccactcccaccagtccctaagcacatgaagtccaggctgagtttggggacagccttgcctggaggtgagaagaagaatcatagctacagggaaactagcacagggccttggccccagggatgtggaggagacggggaaggccgcatcggccccgcctctgctggagctgtgaggtgtggggggtgcggggcctttgcttgctgtacatgcagatgagacgcctacccccaggaccacccaaactgttccttggctgaggcctgtcatagcccaaaggtcaccgtgtccttggagccaaggccccagtgggaggaatgagaaccgcttttgtttggaggggcagtcacgaggcgcatgaggcagccgcccagccctcaccgccctccgtctgtctgtccgtctgtctggcccaggcctacatgaacttttactacaaaagcactgagggctggagcattggcaacgtgctcctggacttcaccgggggcagcttcagcctcctgcagatgttcctccagtcctacaacaacg

SEQ ID NO: 61482 - DNA, 2400 bp, Homo sapiens
gccacttcctcctcacctacctgctcctggagcggctaaaggtgtctgcccctgcacgggtggttaatgtgtcctcggtggctcaccacattggcaagattcccttccacgacctccagagcgagaagcgctacagcaggggttttgcctattgccacagcaagctggccaatgtgctttttactcgtgagctggccaagaggctccaaggtaagtctggagaaagaggaatagcaaaaatggtcctcagaccaaattagaggtccacagcaacttgggaagtcaggctgtcaaacatgcacgtgtcagtaatatctctgtggactaaggagaatgaaattatgaatggaataaaaacagagtgcttgcccccagggagcttaaaatcaaataggggttaagaacctcaaaaagttaccttgtatttgtgtcacatcttatctcttatctcatttgattttcacagtagctttttgcaacagacagaggctttttgttttttttgtttttttttttttgagacttgagtttcgctcttgtcgcccaggctggagtgcagtagtgcgatcttggctcactgcgacctctgcctcctgggttcaagtgattctcctgcatcagcctcttgagtagttgggattacaagcacgcaatatcacgcctggctaattttgtatttttagaagagacgagctttcaccatgttgtccaggttggtctcaaactcctgacctcaggtgatctggcagaagaggcctttggtaacaggtattattactcctagtttatagagcagagctgaggtccaaggaaatggccagctaaagagtatatggcaggtgagggcatcagaaccggaatgtgggtgctcagctttaaacctagggtgcttccttctgggtgccatttgctgaggtccacatggtgatctgagctacagagctgccactgcctggactcagggagttagggctggatttcagacccctgggtccaagttcttgctctaccacatgctagccgcatgtggatgtggatgtggatgtgcccctttaacctcccctgacttcatcttctcagctgtaaaatcaggtcaggctggttcttattccttaatgattctgtgctctcctggagcactgggtgagctgctggctctgacatctgcggatctaggggtccatttgttacagtgaataagccagagtttgggaacaatgatcttcacttccagaatgcctacagtagaagaagacggtaatcataaaaataaacaataactattacaataataattgagaggtttatgtgtgccatgtactacacatcttaactcatttaatacttgcaacattcctgtgaggtgggtgctattattttcccccactctaaatatgaaaagacaggcactgacagattaagaaatttgcccaaggaaggttcctagctgagccaggattcaaatgcagacagtccattccatgtttttaactttacatcagagttcagaccttggccctgcaccctgccaggtataaccttaggcaatttacttaaactttctgtgacttagttttctttgttgtaaatgggtatcataacataatattctattttacaagcctctttaagaattaaatgaaataatacatttaaagcatgttgtatggccctggcacataattggtactgaaaaatagtgaccgcaccagggatatcttgtggggggggggtgttaatcccccacaatctgcatcaccatccctcaatctatacctcatgaaatgtgcttgccaggcaaatgcagctcaaaataaagtcctacccaccaccttccaatcagatcgctacccctaaactcctcctttagaaatgataaagataccactgtcaatgattgatactactcactacatgttgtcatgtttattagtagtactaaagccacagtataaaaacgacattgaaatagaaggacctcgaaccaggcactccttttggaacatagaaggctgagaaggctatagatctttctgaaagatcaattcattcctgttcaaattccgcctggccaggagtggtacctgctgaatcctggggttatgtttcctgagtccctccttctcacttgtgtattttgctgcaggagataagctgttttcctgggctcagagtgtgtccctgatctaattgtgccctctttgtcccaggcaccggggtcaccacctacgcagtgcacccaggcgtcgtccgctctgagctggtccggcactcctccctgctctgcctgctctggcggctcttctccccctttgtcaagacggcacgggagggggcgcagaccagcctgcactgcgccctggctgagggcctggagcccctgagtggcaagtacttcag

SEQ ID NO: 61483 - DNA, 3759 bp, Homo sapiens
agccccatattcgagccccgtggaatcccgcggcccccagccagagccagcatgcagaacagtaagtgcctctggtctttctgggacttcgggctcggggtgcgcggacccgagggtcaggggaggacacagggactcgcgacgcccgcgctggcccggccgccgaccgactgaggcccggggacctgcggcggctgctccccgctccgcgcccggcagcccgggaggggagggcgtttgcttggctcttctcgatactggagaagcaggggctgggcccttaagaacagcccgcccgagttttcgaagctgcggtagagaaaccccatcccccccaaatcctgtaactcacaccccctctcgcccctgcccgggctctgaccccggagagaggggctgggctgatcagggcggggcgaagtcttctcctagttgagcgagaaggaggcccctttgggcttagccaagactgaaagtctccaccaacccggcggggttgggggcttctctccccaagtcactctcagggcagctcctcccctcctcaccccactacgggcctagaagggatggggagaggagcccccaggcctgcagcagggtaggggtggtaaactcgctgttacagggcgcgggagagagcacggtttactgggtctggtaaggaggtgcccaggaattggaaaatccctgccctggcaactgcaattgcttgggtcctgatagtcccaggcccagagcgcttttgatacttatggcccttgtacctccctgctttcctctgcccagaccccgtggggtcccacccaccttcctgttcgtggtgggtgctggtacgcggcagggctagtctagagctccgacctgggagcctggaggcccagcgaaaccaggcccggtttgaggttacggttgaggcacacggcgtcggggctcaactgaactcaaagtgtggaaaggcccgggtcttccagcagcctgccctggccgaaccacacaggcttaaggagggtccccagcaccttatccatctgttttggaaacgccggtcgccccctggtgcttccggggctggtaagcgcgtagctgaggaaagggcacaaaggtggcgagctttgcgggagtagttgtgcagaacctgccggaccccagggcttggccggtaggctcgccttcggcggctgggctctccccttggagctcagactccccagccgcaggctgtctctcgggcgggccccagccagggcgcgcagccctgagcgtttgtcgctgcggcccggctggcaggccccgaggggcgcggggtcgcgggccggccggcagggctttgtgccgctcgttcccgggtgtgcgcgaggcgcggagcatccaaattgacaccatatgttttcctattagttgcttcgcggtcgagttctaggcgcataatcatcgccagtgggcgagagcgccagcagtccctagggaagggacacaatgattgaggcttaacctctgaaggggaatttggagctgcgctttctctctgccatttcgatgctgggagtggcgctctggccctggcgtctcctgggcaagcaccagccggcggtatctgcggaggtggctggcacgttgttattttttgaaatgagtgaggagggaggtctagatttaggcggccttacgcgcccgccttggcattagcagactgggaattgccgtggctatgcccgaagtttggaaagtctctctcggtctctttctgggacagcctttctttttccgggaagcttcctgtgcctagaggtggggctctgtagctggaggggtagatggaacttgcgaagcaaaggaaggcaataaaaggaagttaggagaaaccggaaacgtgggccaggccttgctctgttggagaagcggtgtccccgcaaagtccctgcttgcgctggtcccggccggagcccagatcccccaaacgcctgtcacttctcatcgagttgaggctccggcccccacccgcgccttggtgagggccccccctcagccccaagccttcggctaccctgaaaacgcggctcccctcgaaggggaaacaagtgcagttcaatctcgtctgagtgatctacaaataaggacggaaagggtcgttttatcacggtcccgtttgtcgtgacgatgcaatttcccggagcggagcactgtcacaaagtgacaaggctgccacaagcgccccgactgatcttttcaattagccttccatgcatgatccggagcgacttccgcctatttccagaaattaagctcaaacttgacgtgcagctagttttattttaaagacaaatgtcagagaggctcatcatattttcccccctcttctatatttggagcttatttattgctaagaagctcaggctcctggcgtcaatttatcagtaggctccaaggagaagagaggagaggagaggagagctgaacagggagccacgtcttttcctgggagggctgctatctaagtcggggctgcaggttggagatttttaaggaagtggaaattggcaattggctttgtgtgtctgtggtttttggggagggggactacaaagaggggctaactccctctccctattctctaaggttggaccacagggatgaggttgtgagatacaaagataaaggagggatggggaacactatgatgtggtatttttcttttctgttttttctttttgataatatctatccttggctaaggggagggcggagttcagcggcggaaataaagcgagcagtggctggtgcgaaccgactcccggctctaagccttacttgcggtggccggacttgtctgtggctgaagccgagcccgggctctgactctcacgtctgcactggaggtgcggaaacctggactggggttcaccagccacatactggctgctctggttgttctctcctcttccttcttctattctaaccaaacaaaacccaactcgatgcttgtgccaggccttggccagtttggacggtgatggaaacatttctggattttagcgtctaagggagcactcaagggctgtaaggtttgctatcactgtcccaacactgcagagaccttgaaggttcagtgtgggatctgtagaacccatggtttgcggtgacactcagaggggatctttgggagatttatagagccggttcttagcgctttgtgggttcagaggctggctgcagtgtttatgaagaggggcagtgggctggggacactgctggggttatggctgtagtgaggtccatgtgtacttgttccttggcatgtgtctgactctgtgttgctgctgcagtacagtgggcaggggcacggttgcttggactgggctgcccgatgtctggcatggctggtggtcctgttgtcctttatttgatcgatagcagggaactgaccgccgaggttggcacaggttggcagggggatgaggatgcattgtggttgtctcctcctcctctccttcttcctcttccccttcctcctctcctttctgttcttgttctccctcatcttcctcttccttcttctccctcttcttcctcttcactctgctctcttctcttcttttcccctttcctctcctctccctttcctcaggtcacagcggagtgaatcagctcggtggtgtctttgtcaacgggcggccactgccggactccacccggcagaagattgtagagctagctcacagcggggcccggccgtgcgacatttcccgaattctgcag

SEQ ID NO: 61484 - DNA, 1986 bp, Homo sapiens
gccccctgacttgggcctcagtgtccccgaagatcatgatggcgtatatgaacccggggccccactattctgtcaacgccttggccctaagtggccccagtgtggatctgatgcaccaggctgtgccctacccaagtgagtacagtcgtttctcttggcaccccaggctggcctcatctcttggaggacctctggggtccctttgcccccaggaagaaggcaatcacaggggcgacttcagggccatacaccagccctctgggttcatctgaaatgtatgtcacttagaaaaacattagcagtcctagaaattcaggacagaggttccttttggggtgaggaagaggggatgtaatctggaaggggaatcaagaggaattttcatctgttaccaaaactttattatttatttatttttcagagacaaggtctcacactctgtcacccaggctggagtgcagtggtggtggtcacggctcactgcagcctcgaactcctgggctcaagcaatcctcccacctcagcctcctgagtagctgggactgcaggtgtgagccattgtgcctaggcccggggggcactttttttttttaattttatttttgagacagggtctcactctgttgcccactctgaagtgcaatggtgcaatcacagctcactacagcctcgaactcctgggctcaagcgatccttttgccttggcctcccaaatagctaggattacaggtgcacgccaccatgcctggctaacttttttaagtttttgtagattttgcaggatctggattatacaaaacatagaaaaaattattattatttttttttttgtagagattgggtctccctatgttgcccaggctggtctcaaactcttgggtccaaataatccgcctgactcagcctcccaaagtgctgggattacaggcatgagccactgcacctggcctgcaaagccttatttctttttctttttttttctttcgagacacagtttagacggagtttcgctcctgcccaggctggagtgcaatggcgcgatcttggctctttgcaacttttgcctcccaggttcaagtgattctcctgcctcagcctcccaagtagctgggattacaggcgcacaccaccatgcccggccaatttttgtaaagccttatttttaagagaagtgagtactcagttatttgtagcattattctttagctcttgtttttttttttttttttttcaagaccgagccttgttctgttaccaggctggagtgcagtggcataatcttggctcactgcaacctctgccttctgggttcaagcgattctcctccctcagcctcccgagtagctgggactacaggcatgcaccaccacacctggctaattttttgtatttttagtagagacaggggttccccatgttggccaggatagtctcaatttcttgaccttgtgatctgcctgcctcagcctcccaaagtgctgggattataggcgtgagccaccgcacccagcccagacttgctacttttataggctagaaacggttgaatgtcagcaatgtcatgcttcaactgattatgtcttagtgcataagaaagtttagaagagggaaaaacgactcgcacacctccttgttgagctaaagccttggggtcaggcatgagccacagagtgccaggcacacagtgaggtgtagaagggcagggaatgtgtattccatccttagtttaggcagatggcaaccaggatggaattcttggcatcccacccagcctcagggcctcacaccagcccatgtggatgacctgagggtcctgtttcccatcccaccccaggcgcccccaggaagcagcggcgggagcgcaccaccttcacccggagccaactggaggagctggaggcactgtttgccaagacccagtacccagacgtctatgcccgtgaggaggtggctctgaagatcaatctgcctgagtccagggttcag

SEQ ID NO: 61485 - DNA, 3306 bp, Homo sapiens
tttctacgtggaatttggacactttggccttccaggaactgaagtccgagctaactgaagttcctgcttcccgaattttgaaggagagcccatctggctatctcaggagtggagagggagacaccggtatgaagttaagtttcttcccttttgtgcccacgtggtctttattcatgtctagtgctgtgttcagagaatcagtatagggtaaatgcccacccaagggggaaattaacttccctgggagcagagggaggggaggagaagaggaacagaactctctctctctctctgttcccttgtcagagcaggtctgcaggagtcagcctttccctaacaaagccctctatcctatcacccacacttgggaggctgggctgggctgcacagggcaagatgagagatgtgttgatttcatccacttgattgtcatgtagaattagatatacttgagaagttacatttttcagtagcgccttcatatctttattttagggacaggtatacaccaagcaccatctcagccacaatctgttactaacagtatgttttctgaactttggccacttaggaaaagtacagtttggctctctccaaagtgttccctgaaagtccaactttatgactaatactgtgatttccagaaactttgactatccatgttattgacaatgattactagcactgaagggcatgcatgcaagtaggggttatgaaatatttaaaacacggttctctaagatatgagcagcaaagtgtttctaccttctatgagggaaccgaaggtgccattaaaagtagagaaatctggaccaggcatggtggctcatgcctgtaatcccagcactttgggaggctgaggcgggcggatcacttgaggtcaggagttcaagaccagcctggccaacatggtgaaacactgtctctactaaaaatacaaaaattagccaggcatggtggcagtcatctgtaatcccagctacttgggaggctgaggcaggaaaattgcttgaacccaggaggcagaggttgcagtgagccgagatcacaccactgccctccagcctgggcgacagagtgagactctgtctcaaaaaaaaaaaaaatacagacatctgttgtgattctggtaactctaaattttcaaccgtctcttcactacatttaaaaaattattttctaaaccaaattagccaggtgtggtagcaggcacctgtagtcccagcaactcaggaggctgagatgggaggggtgcttgagcctggaaggtcgaggctgcagtgcactgtgattgcaccactgcactccagcctaggtaacagtgcaagaccctgtctcaaaaaataattattttcatgtttattatattaaaatgatgtatgaaatatgtgactcatcagggcttgaaaaactttgttgtatggagattattcttatgagttgatttttctctctcctaccttatagtaatgaaataaaccaggcatgaaagtcacaataagtaatacaatgaacacccatgggtccctgcccagcttaagtagaatattacaaatgcagttgaagccctctgtgcaactttcatccttacaactgatactgagtgaattgtactttaaatattttatagctcccactcccatgcatgcccctcagtgatagcaataattgtcaataacatgaaacacagattgatcatatagcatttaccatatatttactctataccaagcacttaacatatataattacatttaaaatttacaacagccctactacccaaaacactattagtatccccttttacaaatgcgataactgaggcgtagagagctaagtaacttactgaaagtcacacagccagcgggtggtagagcctagctttaaacccagacgatttgtctccagggctgtcacatctactggctctgccaagcttccgcatgatcattgtctgtgtttggaaagattatggattaagtggtgcttcgttttcttttctgaatttaccaggatgtggagaactagtttgggtaggagagcctctcacgctgagaacagcagaaacaattactggcaagtatggtgtgtggatgcgagaccccaagcccacctacccctacacccaggagaccacgtggagaatcgacacagttggcacggatgtccgccaggtttttgagtatgacctcatcagccagtttatgcagggctacccttctaaggttcacatactgcctaggccactggaaagcacgggtgctgtggtgtactcggggagcctctatttccagggcgctgagtccagaactgtcataagatatgagctgaataccgagacagtgaaggctgagaaggaaatccctggagctggctaccacggacagttcccgtattcttggggtggctacacggacattgacttggctgtggatgaagcaggcctctgggtcatttacagcaccgatgaggccaaaggtgccattgtcctctccaaactgaacccagagaatctggaactcgaacaaacctgggagacaaacatccgtaagcagtcagtcgccaatgccttcatcatctgtggcaccttgtacaccgtcagcagctacacctcagcagatgctaccgtcaactttgcttatgacacaggcacaggtatcagcaagaccctgaccatcccattcaagaaccgctataagtacagcagcatgattgactacaaccccctggagaagaagctctttgcctgggacaacttgaacatggtcacttatgacatcaagctctccaagatgtgaaaagcctccaagctgtacaggcaatggcagaaggagatgctcagggctcctggggggagcaggctgaagggagagccagccagccagggcccaggcagctttgactgctttccaagttttcattaatccagaaggatgaacatggtcaccatctaactattcaggaattgtagtctgagggcgtagacaatttcatataataaatatcctttatcttctgtcagcatttatgggatgtttaatgacatagttcaagttttcttgtgatttggggcaaaagctgtaaggcataatagtttcttcctgaaaaccattgctcttgcatgttacatggttaccacaagccacaataaaaagcataacttctaaaggaagcagaatagctcctctggccagcatcgaatataagtaagatgcatttactacagttggcttctaatgcttcagatagaatacagttgggtctcacataaccctttacattgtgaaataaaattttcttacccaa

SEQ ID NO: 61486 - DNA, 683 bp, Homo sapiens
acccatgcagatgcaaaagtccaagtgctggacaatcaaaacgtaagcttgtcattgtttaatgcatacttaaacaattttatttttgtcttgaaattattaataatgtggttttctgtccacttcccctatgcaggtgtccaacggatgtgtgagtaaaattctgggcaggtattacgagactggctccatcagacccagggcaatcggtggtagtaaaccgagagtagcgactccagaagttgtaagcaaaatagcccagtataagcgggagtgcccgtccatctttgcttgggaaatccgagacagattactgtccgagggggtctgtaccaacgataacataccaagcgtaagttcattgagaacatctgccctccctgccctaagcccaatgctctctcctctttacctcctcccaccctctctctccactgtctcttagtctgtgtcctctccctgctccacatttgtctcctttgtacctgggggaacagagaggaatgccctgacttttctttgactgtctggaaaatgggagtcaagtgtggggagtcattcacttcatttgcatgctgcaaaacagagggcggaggcaccagggaaaggcacttgaatgaagaaggaaaatgagaaccagattgtaacttcgtcctaatccacctgccagaactttccttcag

SEQ ID NO: 61487 - DNA, 557 bp, Homo sapiens
ccgtgcagaacgagcgccagccgcgaagcacagcccaggtccacctggacagcatggagtccaacactgagtcccggccggagtccctggtggctcccccggccccggcagggcgcagcccacggggccccacacccatgtctgcagccagagccctgggccaccacttcatggccagccttataacagctgaaacctgtgctaagctggagccagaggatggtgagtgggagagcagctgagggcacagcagggcttggcttcccgggtcacagcagggctgcagcgccttgccttgatcctccctcccccggggctccaagtactccctgccacctcccgagaagcaggcgctaagatcacaacctcctcctccaacagctgatgagaatattgatgtcaccagcaatgaccctgagttcccctcctctccatactcctcttcctccccctgcggcctggacagcatccatgagacctcggctcgcctactcttcatggccgtcaagtgggccaagaacctgcctgtgttctccagcctgcccttccgggatcag

SEQ ID NO: 61488 - DNA, 5492 bp, Homo sapiens; identical to SEQ ID NO: 34811

SEQ ID NO: 61489 - DNA, 414 bp, Homo sapiens
gtaggtacggactggcgcatgtttccaagtggaacttcgagacgtggaatgagccagaccaccacgactttgacaacgtctccatgaccatgcaaggtgtgcaccgcttcctggggtcctgcccggctgaaagggggcagaggaaggcaggagcagaggctaagccgctcatccccagggcaggtgtagacgcagtgctcccccggcccaggcttcctgaactactacgatgcctgctcggagggtctgcgcgccgccagccccgccctgcggctgggaggccccggcgactccttccacaccccaccgcgatccccgctgagctggggcctcctgcgccactgccacgacggtaccaacttcttcactggggaggcgggcgtgcggctggactacatctccctccacaggaag

SEQ ID NO: 61490 - DNA, 1341 bp, Homo sapiens
ccccacggagtttgcctgcatgaaggccttggtcctcttcaagccaggtaactgagtctctgcccaaaccttgagtgggaattctggtgacttccatctgcctctcactctccctccactacccccatgtgtgcagatgtgtgtaggcctctatcctggggggtgggaggagagtggtgaggctggactcccttctccttggggccactcctggttgactgtgaggggacagggcaggctgggagcccctgggagaccctgagccccagccggagcccctggtggctcctctgggcctggcagagcccaccccacagggccccaggtccatgtctgcagccagaaccctgggccaccacttcatggccagccttataacagccgtaaacctgtgctaagctcactggtgctgcttctccccagagacgcggggcctgaaggatcctgagcacgtagaggccttgcaggaccagtcccaagtgatgctgagccagcacagcaaggcccaccaccccagccagcccgtgaggtgacctgagcatgcgcccacccactcatctgtccctgacctctaacctttctctgcctctcccacactctcccagagctcactgattagacagcacaagggtctcagttcaacagcatacagccaacatctatggtgtcccaggcacagtgccaggccccgggagtggggaccaagatgtacataagacaaagctactgccttctagagacaaccggcagtgacctcactgaagacaaaaactgccctagccaggtactgagggttgcatgaatctgcaggagacagagatccccttgcatgggaaacataaagcagaattgggagggactttgtggagacagggctggacttgaaaggaagaagaagtctaaaagaaaacatcatttgcaaagggagagaggggcaagcatgatatgttgttagaacaggagcccactttgaaggtataacaggttcctgccagtgagaaatggggagaataagccagaaaagtaccctaggaccagcccgttcaggactttgaatgccagccaaaggccacgtctgacttgggaggcagagggcagctactgcaggtttccgagcagagggtcatacacagggctggacctcacgcagactggcatggccatgggtccagaggatactactgggaaggggatggcagctactgccaccttccagatggttccatggagttctgatctttgggcatggccaggggaagcagaagggagactctaggagttgaaatgggtcagacccggtgtttgggtgaaggtaaggaatgagggaagaggagctctttg

SEQ ID NO: 61491 - DNA, 1062 bp, Homo sapiens
cccgggagaaatctcctcaagccagagcctgtgctgtgaggggcttcgggaccttggggcagctcctgagttcagacagagttcaggaagggagacaggggcacagagagacagaggttcatggactgaggcaaaggctgggccaggctcagcaacccaggcctcccgcaggcaggcagaggctgccctgtaacccatggagaccagaccaacagctctgatgagctccacagtggctgcagctgcgcctgcagctggggctgcctccaggaaggagtctccaggcagatggggcctgggggaggatcccacaggtatggcttctcctggaggtagggttgggtctgggcccttggggagcagggtaagggccagaggttcgcagggaccatggaaggagccagaacaactcagacccagccccgccggctgtgggcaagggtggggtagcctgtgggtaaacccagaatcctagaaacacggtggggcggggatgggggttgggggcgggcaggctgcagagccaggacaggacagcctagccgatggggaaggaaagaacagagaagcgcccttagggcttaacagcacagaggtccctagtggcgttgacaagaatgtttctgtgggatgatggagcctgaagccacccacagagaagggatgggagctgggaaagtggagctagggctcggactcttgctgaaaattggccattgagggaggagagagggcaaggaatgggggtgggggctggggtgtggatgcacagtgagggagacacttctccagatggaagagtcacgcgtgggttcgttcaaatgcgggtgagcggggcctgaggactgggaaagggacccgagggaaggaggggagcgtgcagccctgccccggcccagccctgccctggcccagccctgccccctgcccctcaggcgtgagcccctcgctccagtgccgcgtgtgcggagacagcagcagcgggaagcactatggcatctatgcctgcaacggctgcagcggcttcttcaagaggagcgtacggcggaggctcatctacag

SEQ ID NO: 61492 - DNA, 440 bp, Homo sapiens
gattggcgagcgtgctattctactgggaggactcatcgttgtatgggttggcttctttatcttgttaccttggggaaatcaatttcccaaaatacagtgggaaggtatagccatacataattctataatgttaacctctgttatttatctaaaatcaacaagtaatgcactgcaatggttttgtttttacagatttgcacaataattcaatccctaataccacatttggggaaattattattggtctttggaagtctccaatggaagatgacaatgaaagaccaactggttgctcgattgaacaagcctggtgcctctacaccccggtgattcatctggcccagttccttacatcagctgtgctaataggattaggctatccagtctgcaatcttatgtcctatactctatattcaaaaattctaggaccaaaacctcag

SEQ ID NO: 61493 - DNA, 1128 bp, Homo sapiens
aatacgcctggcatccaagtccacccactccggactttggccttagcagtagttagtgtgggaggctgggaagactgggagcagtctcttaaacaaaagcaaaagaataagcttcgggcgctgtagtacctgccagctttcgccacaggaggtaagtggatactgggagctgggggaactgagaagactagccagatattacatgtattgccaactcaaaactttcagcttttaacatgcttcctcacacattatcccctttgatcctccacaactctgaggtggacctggtgggtcttagccccacttggtagatgagaaaataggttgagagagacagtgagatgctcagtatcacacagcaaacctcttggccctatacatcattccaaacacaagacccaggttgcatatagaaggttcagtgtccctggtttagaaggagaggtggtgtgaggcaagcaagaagatgcctctgctgcactccagcctgggcgacagagtgagactccatctcaaaaaaaaaaaaaaaaaaaaaaagatgcctctgctccatacagcaggtctgtacacaggatctggctcatgtggttttagttaagttagccacaaatacagggtctgcccacatctttgctttgaacagatgagccatggttggccaattatctgccaaccagataatttctcaatatgctcacaccagatgcttccagctagggagggtattaggggaaagggcttgagggccacagtaaactggacaagtttttctgcccagcctaggctgccacctgtaggtcacttgggctccagctatgtggctgcctcttctgctgggtgccttactctgggcagtgctgtggttgctcagggaccggcagagcctgcccgccagcaatgcctttgtcttcatcaccggctgtgactcaggctttgggcgccttctggcactgcagctggaccagagaggcttccgagtcctggccagctgcctgaccccctccggggccgaggacctgcagcgggtggcctcctcccgcctccacaccaccctgttggatatcactgatccccagagcgtccagcaggcagccaagtgggtggagatgcacgttaaggaagcag

SEQ ID NO: 61494 - DNA, 411 bp, Homo sapiens
gtgccaggtgggggcagggatgtgccccgtggacaaggcccaccgcaaccagtgccaggcctgccggctgaagaagtgcctgcaggcggggatgaaccaggacggtgaggcgggggctggcccggggggaggtgacaagaaatgggcagcgggactggcgtgtcgtcctgacccttcctgcctccccagccgtgcagaacgagcgccagccgcgaagcacagcccaggtccacctggacagcatggagtccaacactgagtcccggccggagtccctggtggctcccccggccccggcagggcgcagcccacggggccccacacccatgtctgcagccagagccctgggccaccacttcatggccagccttataacagctgaaacctgtgctaagctggagccagaggatg

SEQ ID NO: 61495 - DNA, 3429 bp, Homo sapiens
atgggcggtcattcccatgatgtacccagcatccttcctgtttgatgtccccagcacagcctatgtggctttatcttgtgctaatctgttcatcggcatcaacagcagtgctattaccttcatcttggaattatttgagaataaccgggtgagcataactttcttggcttttttgtttgattagtaggatagtagagtatgtgttggtcgagcagagccaggggcaagcatcgtacatgtagcagctgtatgcggatgagtgccactttcttcctccctacccccgaccctgcctcctttccttccttccttcctcccatccttccttcctctttccttcttctcctccctcctccctccttcccccgtccctccttccttcctttttcattgcttccttccttccttcgtccctccttcccttcctctttccttctgccctctctccctttttcctttcatcctccctccatccctccctccatccttccttctttcttccttctttccttcctataagcacctttttcatttctgtgctctgaatgaaatggttttctgtgtttattctgcaagcaaaacttgattcttgcaataaactttaagctttgcttactctttcagaaaggttttctcagggactttgggtgttgggttttacacacacacacatcaatacatttgggtaatttcaaaatctaaaaggaacaaaaaggcatacaatgaaaaaatctccttcctacccctgtttcccactcatgcagttctcttctccagaggcaaactcttacttgagtttcctgtgtgctctggagacacatcagcagatccctatacggtctttctcccgctttcttatggaaattgtaacactctgacatatactattccttgggcaagttaatcttgatgaagagactgggtgttctccatgctgaatgcctcacttttatgagctgccaagcccagttgtcccttccacctgacctccccctgtccagagacagatggccaaactgaatcataaaaagagggggaaaaaaagaaggcagtcgctgcagggctgtctttactccacactccacactcccagtccccaccgctgtgtctgagtcctggctgtggctgtccttggaacatttgcctcaccacgtgcctgtgtccccaggcgcctcaacctttcctctcctcattagctcttcccagttcagagggtgggaccggccagcacatctgcactgctgccctgccacacccacctccacctgcctctgggccccactggggaacacaggacaaatctgtgcggaggccccaccatgaaccgcccagacccgtggacccctgagactgactctttccagatcttgttagggtttcgtggctgctaggcaagtaacgaagcctcatctgtcccatgaatgataagaaattcagcatgtcagagtcagactctggaaaggcggggggataagaacacagccccagcagatggccagagcacccaggtgactgaaagtgctgctttgcagagctgtgtttgccacaggctcacagcccactaagtcttaagacagttttccttcagaataattaaatagccagcttaaagcaactcagaacattttcccctctgaggctgcacccatttagccaacatttgctaagcacccgccttcaaaaacctggtattttcatgtaaattatccgatacacagctgctatggaaacccccagtatcccacaggaagctccccagctcccagcagctgccggcccgtgtgagatcaggaggtctttaccagctgaacaccacgtgccgggtgtgtgctgatataaacaagcgtggcccactcgtcctgccctccagaggctcccgttccagtcggaaaaggacctgcccacgaagtttgcaacgatataagccacagtgtatgatcctccataatacagcgtgtgacagagcagcagaggagcgaggcagataacatgctgcaggccagaggcagcgggaagagccaggctgcaggggctgggggagccgtggtggaggaagttcaatttcagcctgtagatttctattagcccatttaataaataatgaagtgcctactctgagctaatcattgtgcaggtatttaggaaggacaaaaaaataattaggactcagtgcccaccctccaggggcccactgactagtagagaaagtaggcagatttttaaaaaattaatcatgggaatgtgataagtgctgggagagaggaatggatactttctcatgggaatcttggaaggcttgtaagggaaggcactctctgagccagctgtctaaagaagaacaggaatctttaagaaagcagaagggaaaagagcattctttcctgcttggagcaataggtaacagcctgcacatgcccaggcctagaggccaaagagcacagtgattccagaaagagtggggagaaagggtaggcagggaaggatgaggtaatgtgggcgcaggtgtggaggctggagagggaggaggttgtgggactgggaggagccagatggaatggacagcagtggcccagccaggagctatgctggcctcgtacgcctcgatgtcccttctattttctcaggggaggctctgcccaacatgccaagtccgaccacttgaaaacaagtccctggcttaacacagaccccagagagagtctccaaccctcctctccctagacaatggtagttgccctgtgaggggctgaaaagcagagctggagatggctcagggcctggtgttaacaaatgccttgagggctcctgttgtttcaaagtgagtctgcagggagagctccctaagtggacagcaggagggctgcagcttctctgcacattcctgctgtcacccccagagtcacctaggggaggggtaaggacagtaatgcaggttcctcacagttagcctcggtgcccacatggtactgagcatagtaaatgtttagaagatgctgcctggctagacaaaggggaagctcccgcccactagaaacttgcagggagccccagtccttgattggtcatttaattgattagctccttggcctggccttgaggcactgcttgtaagtacttcatgacctccattgcaaacccatgatgctctgctggacaaatccctccagtggccagtctggctgcaaggactctctgtctgcaggccttgccctgtgctgtcctgtgagagcatctgggccccacctgctgaagagagggggggtggggtttgccccgtttccaacagtcctacttctctgtttcagacgctgctcaggttcaacgccgtgctgaggaagctgctcattgtcttcccccacttctgcctgggccggggcctcattgaccttgcactgagccaggctgtgacagatgtctatgcccggtttg

SEQ ID NO: 61496 - DNA, 1534 bp, Homo sapiens
cttttcaattagccttccatgcatgatccggagcgacttccgcctatttccagaaattaagctcaaacttgacgtgcagctagttttattttaaagacaaatgtcagagaggctcatcatattttcccccctcttctatatttggagcttatttattgctaagaagctcaggctcctggcgtcaatttatcagtaggctccaaggagaagagaggagaggagaggagagctgaacagggagccacgtcttttcctgggagggctgctatctaagtcggggctgcaggttggagatttttaaggaagtggaaattggcaattggctttgtgtgtctgtggtttttggggagggggactacaaagaggggctaactccctctccctattctctaaggttggaccacagggatgaggttgtgagatacaaagataaaggagggatggggaacactatgatgtggtatttttcttttctgttttttctttttgataatatctatccttggctaaggggagggcggagttcagcggcggaaataaagcgagcagtggctggtgcgaaccgactcccggctctaagccttacttgcggtggccggacttgtctgtggctgaagccgagcccgggctctgactctcacgtctgcactggaggtgcggaaacctggactggggttcaccagccacatactggctgctctggttgttctctcctcttccttcttctattctaaccaaacaaaacccaactcgatgcttgtgccaggccttggccagtttggacggtgatggaaacatttctggattttagcgtctaagggagcactcaagggctgtaaggtttgctatcactgtcccaacactgcagagaccttgaaggttcagtgtgggatctgtagaacccatggtttgcggtgacactcagaggggatctttgggagatttatagagccggttcttagcgctttgtgggttcagaggctggctgcagtgtttatgaagaggggcagtgggctggggacactgctggggttatggctgtagtgaggtccatgtgtacttgttccttggcatgtgtctgactctgtgttgctgctgcagtacagtgggcaggggcacggttgcttggactgggctgcccgatgtctggcatggctggtggtcctgttgtcctttatttgatcgatagcagggaactgaccgccgaggttggcacaggttggcagggggatgaggatgcattgtggttgtctcctcctcctctccttcttcctcttccccttcctcctctcctttctgttcttgttctccctcatcttcctcttccttcttctccctcttcttcctcttcactctgctctcttctcttcttttcccctttcctctcctctccctttcctcaggtcacagcggagtgaatcagctcggtggtgtctttgtcaacgggcggccactgccggactccacccggcagaagattgtagagctagctcacagcggggcccggccgtgcgacatttcccgaattctgcag

SEQ ID NO: 61497 - DNA, 3967 bp, Homo sapiens
atttgcacaataattcaatccctaataccacatttggggaaattattattggtctttggaagtctccaatggaagatgacaatgaaagaccaactggttgctcgattgaacaagcctggtgcctctacaccccggtgattcatctggcccagttccttacatcagctgtgctaataggattaggctatccagtctgcaatcttatgtcctatactctatattcaaaaattctaggaccaaaacctcaggtaagccaggtaccctgacattgcaattatagaaaatatacttgtaagcactcaacattttttgctgccattctctatttttacacagactgatttgagggatttttatcatattcagcatttaaaatttttaaaaatcccacaacttctataaagttcattcttgggtaggttatgtgggttatagttttggatacagaagttgtaggagtggcattgtggtagagtgtaaagtggcacagtggagtcagccaaatatggcttcaaacctcttgaacaagttacttaaactttctgagtttcagcttctacctttgttaaacaggcataacacctgtcatcgaaacttgtgaacattacaaatgatgtatttaaagcacctacctcagtgactggcatgtagcaggtacaaaataaatgttagctttaaaaggtattttaatcaattttattattcccagggcttcagcagacagtaagtttttccctttacactccttttattttttttaatctgacttaatattaaatgctatatttataggaggcattttatgtttaatttaaaagtaaaagatgcagaaatgattcttgtaagtttgctgtagtttggtaataccatttctttgcttttaaataactaaaccccaatatcaatctgcttgtcctccatttcacccccaacagggtgtatacatgggctggttaacagcatctggaagtggagcccggattcttgggcctatgttcatcagccaagtgtatgctcactggggaccacgatgggcattcagcctggtgtgtggaataatagtgctcaccatcaccctcctgggagtggtttacaaaagactcattgctctttctgtaagatatgggaggattcaggaataaactagctaagactgtgatggaaactacttgctgtgtggcacttcctggtctaaagctctgctagacaattgcggtgagccagtctccaagaatcagactacagatattgcagattttgaagaacaagaacatatgttgaataacagagagaattctacatgtcattgtgaatagtaggttatataaaaacatactagatgataatttccttacctcagaaatgaaatattattcttataatacctttttgtggttgcatgaactaatgagtgaatggacaatgatgaataaatgtgaagctgtattcttaatacccactgcagaagtgtcattaaaataatatacagtggaaccagaaagagggttctgtaagaattagccatagcagaacaaaattatagaattttaaatacctctacccaagtagaggtatttttattcagacacctactttttatttataaaaaaatgcattttctattatcaagttcacttatgaaataaaaattataacacatattttccatttagcgtgcctaacatcctaccttgccttctatgagtctttcttctaatactacacctctgccttattttagttcagggtttcactaagtaacccctacattaataaatgagtatggataatgctaatatttgagcaatacagaggattaagagatcaagatacttcactgcctattagcctaatagggatacctactttctttcaaatgccaaaaattcacattagaaacataatccagatatgtgttattttatatatatatatacaaaacagtaaatggtttcttaaaattattgctatttttcaacccccttaaactggagaaaaacatttaattagtaaaacattaattaatttactttaatttttcccatctctcagtagtggcggggaggaacacaacagttttcaatctatgtctgcatagttgtgtagagctgcagaattttagttggatttttaatttggatgatccctgacagccccaaactagtcaggctaataagtatttgaggcaaaatggctttaatctaacaatttactgagtttacctgaagttggctaaataacactgtatgtttaacttctacctctacataagttgaatgctgataaaaggaactagtagataactatgtatattgataagcactgttaagaaaatgcaaaaatatttctaaacacttttccaaatgttttctactttaagttagaaatagtttcaaatctgagaataaacactatataatctgcactttataggttgggtgcagtgtctcatgcctgtaatcccagcactttggaaggccaaggcaggaggattgcttgaggccaggaattcaagaccagcctgggaaacaaagtgagaccctgtctttacaaaaaataaaaacaaaaatttaaaactgtataatctgcactttatgctaaactagctgtgctcttaaactcaattttttcagctctaataaagggcttaatttgatagaattattctacgattaaattttgaagactgttttcactctcctctgccgcccatagcaagactgcttccatagatttctcagaaccgtagccagttctggctatttggtcaagtctgggatccctcttacctgctattctgcagctgctttctctgtcttacattttttgggccacgtctaatcttaaagagtaaactctacccttggtttgcatagtgtgcatgacaaaaataacaagaataatggtaatgatgaaaatgataagagcaaaatttgtggagtgctttccacattccaggtaatgtgtaacatacaatttaattcttacagcagtcttatggagtgaaaatactattatgattcccgttttacagatgaaagaatggaggcacagaaaagttacttgtctaagtaacagtctatccttaaagtccacagtcttaaccacttgatttttcatagtgaggaaaatatcccagaaagttgcagtttcaattaatcactaattgtagggtaatttaactataccagtgagtcctactagcagaaatatttgggcaacataagcccactgactggagcttttgtcttagcataataacctgtttccagcaagaatataacagaaaaaagtttcccagctttcaaaggtttataatattgattaaaatttagataaacttaaccttacacaaatgactcttactttcctttttattgagagcattttctttggagcattttcttctttggaggattataccttgctcatcttggcacaaaagaaggcgaaaggaagtaacatgggattgggaaaagagcaaggagataaagtttgaggaaaaaaaatcaccatgttgatgtcttcttgagtaggccaagttgcgtataaagagaaaatgacaacaggagattttaaggtatgatatattgttaagagtagtacatatttaagaagagaaaatatgtttttgaaaacaaatttaaacttgaaaggatgattttcatattttgaagggatttataacttcacaaagcatctccattctatcttgttcagctttacatttaaaaataaactcttcttgttcatataaaccttatctcttacataaagtgaaatctgttaattttttgttttgacaaggataaactacttacctgcatctgtttaagaatagattaacttattttgagaagaaattctgggcaccatttttgaccattgaagacttatttgtaatttaatttctactttacattgtgaatgttcattttctaataaacaagattattttgcatatgta

SEQ ID NO: 61498 - DNA, 1128 bp, Homo sapiens; identical to SEQ ID NO: 61493

SEQ ID NO: 61499 - DNA, 409 bp, Homo sapiens
gtgactttccagcagatctgtaaggatgtgcatctggtgaagcaccagggccagcagctttttattgagtctcgggcccggcctcagtcccggccccgcctccctggtgagttgatgatgatgtgtgggtgaagagacagacctggggggtcccctgaccttcacccccaacccatttgctgtttttttccatgtgagcttgagaaggctattttcctctttctctctttgccccagctacaggcacgttcaaggccaaggcccttccctgccaatccccagacccagagctggaggcgggttctgctcccgtccaggccccactagccttggtccctgaggaggccgagaggaaagaagcctccagctgctcctaccagcagatcaactgcctggacagcatcctcag

SEQ ID NO: 61500 - DNA, 2313 bp, Homo sapiens
gaagaagacgaaaaagaaggatgcgatcgtggtggacccgtccagcaacctgtactaccgctggctgaccgccatcgccctgcctgtcttctataactggtatctgcttatttgcaggtaagcgacaggggtggaaggtgcagcggaaagggggaaaccagggcaccaggcccaggagccagagctccacctctccctcgggaggcctgaggcctggacccctcacggccaccacttagttattgtgcctcggtttctccttttaaaaatagaaggttccccaagaggaccatcagagtgctctgaagcatgggtggggaattgagcttcaggtggacagccagggtttcggcactgtggggccccctcaagtgagttgtacgaggaggatgcaggggcggttgcttctctttggagggataagtgggtggttctgaacatgcagcagggtagggaggcaggggcaagctgctactatttttttctttttttttttgagacagagtctcactctgtcacccaggctggagttcagtggcgcgatctcagctaactgcaacctccacctcccgggttaaagcgattctcctgcctcagccacccgagtagctgtgactacatatatgagccaccacgcctggcttttatatatatatatgtattttttttttagtagagacagtgtttcaccatattggctaggctggtcttgaactcctcacctcaaatgatctgcccaccttggcctcccaaagtgctgggattccaggtgtgagccactgctcccggcctctactactcttctaataagcagaagagggattgagggcctctcctaggaaacctgtttgtgaatgcagggacgagatactgctcctcttaggggaagccaggggcctgggcttttctgagcaggcctccagggtggggccaccagagggaacgttcctgagcacgctgtccaccaaggatgcaggacaagctgctgcttgtgggggctggcggggactttggggcatttctgaggaagcctgcaggctgcaagctgcaggacaaggaggagggatgacctgctgctctctctaggtaagcatggggtttgggggcccttcccagcaggcctgctccaggacaccaatgcagggtacactgttggtcttctgagggtacacgggagggcttaggggacttcccaagcaagtgtgcaggacaggtgtgcaaaggcaggtctcttctgagatgtgtgggactgggatgcatgcgagaggagacgatgcctctggggctctccggagccagtatgcaaaatgaggatgcagaggcaagtcctgcctgtccttctgagagtaggcagtaggctttggggcactcctgagcaagcctgcaagacagagagccactgctctgagaggctagttgatgagttttggggcattccagattatgccgcacgtcagggatgccatccacatggaagcagaggctttcgattattcgagcataggctgatctcctgctcttcggagggattgcggggcaggtgaaaactggaagaacttggagcctgtcccagcgagcagacaggatggggtgcttgggcaagctgctgctctctggtgcacgcgggctctggggaggcagggctgggcactgttctccttcaggtgggcaggaggctttggggcgctgagcaagcagcaggtgggcggcaggggcaggctgctgtgcccgtgaggataggaggagagctgggggtgctgcctgtgtgggaaacagcagaaagatggagaaggtagaaaatatttactgtctgttccattgttaatctctcggaaattctcctatttttgttgaactttgaccccagaaagggcaggtctttagcccctttacctgactctgccagtgtggcctggaaaacggtacctcctgggatcttgtagctctctgctgagaggcaatggggccgctctttggggtcaatcccagctcttctcaggagttctgtgactgtgggacagaaaagcttctcagagacatctcatcagaagcgggggtgattacactgaggtagtgacaccgcaggcagggccattcccatattacatgatccagcgtcttccacacagagcccgtgcccacaggtgggtggtccacgctccagaaacacacgcacagccatccatctcccacatggcttctttagggcctgtttcgatgagctgcagtccgagtacctgatgctgtggctggtcctggactactcggcagatgtcctgtatgtcttggatgtgcttgtacgagctcggacag

SEQ ID NO: 61501 - DNA, 529 bp, Homo sapiens
ccccacggagtttgcctgcatgaaggccttggtcctcttcaagccaggtaactgagtctctgcccaaaccttgagtgggaattctggtgacttccatctgcctctcactctccctccactacccccatgtgtgcagatgtgtgtaggcctctatcctggggggtgggaggagagtggtgaggctggactcccttctccttggggccactcctggttgactgtgaggggacagggcaggctgggagcccctgggagaccctgagccccagccggagcccctggtggctcctctgggcctggcagagcccaccccacagggccccaggtccatgtctgcagccagaaccctgggccaccacttcatggccagccttataacagccgtaaacctgtgctaagctcactggtgctgcttctccccagagacgcggggcctgaaggatcctgagcacgtagaggccttgcaggaccagtcccaagtgatgctgagccagcacagcaaggcccaccaccccagccagcccgtgag

SEQ ID NO: 61502 - DNA, 1086 bp, Homo sapiens; identical to SEQ ID NO: 61466

SEQ ID NO: 61503 - DNA, 1726 bp, Homo sapiens
agtttcagattttgaaaagaaaacaagtaatcgttctgagattgaaacccagacagaggggagcacagagaaagagaatgatgaagagaaaggcccggagactgtgagtcctaagattccacggccactaccacacccacacacacgagagtagtccagccactgaattcaaatcttgtgatgggttatttgctttagaaatatagaaatcatgttgatattgaatattatctatctattccttttatatgtccttgtcctgctctgtgtcaattgtagcgagatgtatttcttttttgttgttgttgttggagatggagtctcactctgtcgccaggctggagtgcagtggcacgatctcagctcactgcaacctccgcctcccaggttcaagcagttctcctgcctcagcctcccaagtagctgggattacaggtgcccgtcaccacgcctggctaatttttgtatttttaatacagacagggtttcaccatgttggccaggatggtcttgatctcttgacctcgtgatcctcccacctcggcctcccagagtgctgggattacagatatgagccactgcgcccagctgcaagatgtatttctatcagtattctacaaaacgatttcctatgtctcttcttgactgatttcttctcctcggtccttcaatgaacaagcctactgtaggaaaaggaatgttgtccactttataatgagatcatttgaggatatgacttagaaacttgagggagaattgaaagatttgggttctatcccattactggtttgaataaagtagtttgaaaggaaaaggttcactgttgtcttgttcagtgttgtctggtaattgagagaggtgccttcgagtctgcagagagtcttcagctttcggaagttaatgaagccgtgaaggttgatagccataggggcccacgtgaaaggcatttacataaaatattcactttaggtaattaatttattcaacaaatatgtacattgaatgcctattgtatgtcaggagactgagaccttactgttgaaagaagagagaacatttagaaaacagatgaagagaccaccagtgaataatagttccctgttgactaaaacgaattcaacagccagtagcagggaaatatggtctttcaaggcatcagaaactcatttacaaaaattatagagctgccaggaaaaaggctgcacaacaaaaatagttgagtaaactagaaacatacactgggaagagagtatgggggcaagttgttagctggatagataggactgtgctttgacacctctgtggtctatgatctctgaacctggaatagggttcattttaatagcgataaagtcattatcccagtgcatccaaattgattagttcatgctttattaggaaacagaagttacccaaaacttagcaaacctaagtaccaagtatccaaaacattcttttcctacacaatgtttggggtattgtcaaagttggattgattcaccagccagtcttaattggctactaatggttcagcctgttttctcctaaagaggtttgtttaatgtcagatgataattgtacagatatgtttgggatttcccgtatgataggttggaagcgaagtggaagcactgaacctccaggtgacatctctgtttaaggagcttcaagaggctcatacaaaactcagcaaagctgagctaatgaagaagagacttcaagaaaa

SEQ ID NO: 61504 - DNA, 25302 bp, Homo sapiens
ggagctggcgctgggaggggaggagcgcgcagcccgcgcgccgcagggccgggcggaaagtttttcctgacggagttttggctgcggcagcggcggcggcggccggagcgggccatggacgcgctcaagtcggcggggcgggcgctgatccggagccccagcttggccaagcagagctgggggggcggtggccggcaccgcagtgagtgtgcgcgcgtcagccgggccgggccgggatcgggcagaggcgcgcggggcctccgcgggcgcccggagtgcggccaagttgggcagaggcggggcctcaccggcgctccggtcccggcgtggccctttcccggccctgcggggcagggggtcggccggggtcaagttgtgcacctactcgccggccgctcgatgccgctgcgaggaggggcagcgctgaggaaggagcccgagctcggggtcctcaggtgcagccggcatggggtggggtgcaggttgggagaagaggcccccgccacccgcggcacctcccgccctgctgtcctggccagctagggggaggcaggcgctcgtcgtcggtgcctaggggaggaggagagggcgcaggggcttgggaagacgcccccgtcccgcacccctgcgccccagccagcagctgcggcggtcaggagcccactggcccgttctcccgccccctgcccgacccaccgggccaacttttgactccgggtgcccagacacccatccaggtgtgagcccggggtcgcaggtacgtacttgaaattgggaacgaggccccgcctggggtgcctcgggagagccccacatcaggcgatctagacccttacgtcccttcctctagccgggtccaggtggcaagcctggcgtcccgactatttttgaaacctgttttctctcgcacctttcccctcgggcttccagagtcccttgggtgcccaggcaaacgacagactcgccgccacctctccctggggcgtctgggaggctgggaggggcctccccccctttctctcccccagtctctgattacgctcagggaacttgtcacctggcaccttcccctgaagccagaagacccagcctagcgcaggtctcgttgtttgggagggagaagagagtggcttgcctggggtcacacacaccttcctgctggttttggagccagagcccaggactgctgcacactcccacctccctgccacctacttcgggccacagcttctcccctcatcaggaaacaactgacagtacagcaccccctcatcccatcccctcttggccttacagggctctgccaggggagcccgagctccctggtccaaggagtgccagcgtgtctgggcctagagggcccgcctccctcctcctctggccccactctgttgttcagctgtggccgcctcccagctgagactggcattggcattgggaatgtggggtggtgcctgctggtggggggtggggtcagagacccattagggctgggccactaggccaggggatgtaccgtttatcacactgattgcatcccaaaatagaccctttaaaaactggcaagatttgaccaggacttctgagatggccatctgttccagtgggagaatcctgcgggttttctccaggaatgagggagggagggtggtggggcagcccccagggaagtggttttgaaggaaggggggctggcaagggaagggaggctagaaagaaatatctctgaatctggggacgtggaagaggtagccgctttggatgtggaagagaatttctcttgccatcttcaatcttgagcaagtcacttgtcctttctgatcctcggtttcctcatctgcaacatggggataaaaactcttacctggcaggagtatcaaggagattattggtaataatgctccctcctaactggtggctttcttctcccctgctcctcttccccctgcctatccttgggacgctgccagcatgattagtactgtggtgagatgggttttgggggccccgagcctgtctgcacctttggaggaaaggagaggagcacctctccccctcctccaggccctggtaagcccaaagtgctgtcctggagcctctggatctgaaggagggcaggccgagccccacctgtccctcgtgatgaagtctcaatttcctcacctgtaaattgcaaataacagtagtacctgcctccagctgtttgtggggatcaagtggaattgcgtttgcctggcatagaggaggagtttggtaaatggtaactgctgcttttgtaactgttttacaacctgtttttgcttccattctctcattgactcctgtgaggtgacagagcagacccattttagagacaaaggaactgagactctgagcattggagtcattggctccagacacagagcatctaagaggcagagctccacattcctagcgcaggggtcttaccagtgtgcttggtgaactctgccatgggaggagctgggagcaggccccacctaccccacgctgggctggcagcctctgacagcagtggccacaggttagagcaggggccatggggtatgtgggggtgggggtgctagggtcaccttgctcagggttgtgacccagcctggccttggacctggtccctgtggttgagttttgaggccaaactgaagccagtggagttaaagttagactcgaaccctgctctcagttgtgacctgctcctcctcctcaaggtcctcactaggattagcatgagcattgcttatttgtggagaaagaagcccagagaagggcagcaccttgcctgaggtcacacagcaaagccagcaccccaggcttctttccacccagcttcatgcctgcagtggattcctggttgtcctgaccttgaaagagggctctcttcctctcccacacatggcttttcctatcccctggggagacatcaatattttatctcagtccctggccaggcattttccttccagctgcctggaagaggggctcaccttggcccctcagcactctttccagaggtactgggatcattcaggccctccggttattttgtgggttgtgcttacccagagagaaggggtgaagaaataggaggtgcaggttccagtaaagctagttcatggtggaaggcaagggagggaggatataatcatatttataatatttataataaaggatattgcaaatgaatgtggcccaacacaaattcataaactttcttatgggtttttttgtgatttttttttaagctcatcagctatcattagtattagtatattttatgtgtggcccaagacaattcttccagtgtggcccagggaagccaaaagattggacatctgtggcttacagtctggtgcaccacaacaagggtgtagatcagtggtgtggttgtggacattggtagcaggacaaataaaaataaagcagggtgaggaaatgatgggacagctttgtaagataggatggtgtcttcatttgggttcctctagagacaaggattggagtgcaagtcatttatttgggacaagatggcaggaaatattgttaggacaagtgagaagggaggggagtccacaaagtgggcattataaagcaaattaccagcagggcgcggtggctcatgcctgtaatcccagcactttgggagaccaaggtgggcagatcacctgaggtcaagagttcgagaccagcctggccaacatgatgaaaccccatctctacttaaaatataaaaattagctgggtggggtggtgcaggcctgtaatcccagctacttgggaggctgaggcaggagaatcgcttgaacttgggaggcagaggttgcagtgagccgggatcacgccactgcactccagcctgggggacacagtgagactttgtctcaaataataaataaataaataaataaataaataaataaataaataaagcaaattaccaccagggactcctggagcttaaccccgctgtgggaactgtgggaggcagtgtagaacgtgctcttcagagccgttccactggaggggcagttcccggaagcccggtggagaggactcctggggtcgggagatcttcattccccagtctgcgccagcctcagcatctccagcaggcagagtggcaggtactggcagtcagcacaacatggaaatggtgtgcagggaggataagggcggccactgacagcaccagggaaggtccctctgagaaggtgactcggtacacaccggtgaatcccaggagggaggagtctgggaacagtgttccagctagagggaacagcaagtgcagggaatgttgaactggaggctaggactctgcttctcccgggtctgggggctgtgtgaggggcatgtggcttgaaggagtcagaggtcacccactgcccactgagggtcagatactctttttgagcagccctgcagggctctgcctgaccccagcaaggggcttgggctgcaggaggcaggtatggactgaagtcccagtgctgtcaattatgagccatggtcaaactcctctgagcttctttatctgtgaaatgggaacactgatctatcctggactcttctctcaatatgagaatggtcatggacacgttaaatctctttgcatttgaccactgtaatgacagtagctcacacttgtgatacttggtatgtaccagacaagcttctaagctcacctcgggtgtgaactcagttcatcctcaagacaaccccatggatggatactcttttttttttttttttttttttttttttttaagagggagtctccttctgttgcccaggctggagtgcagcagtgggatcttggctcagtgcaacctccacctccttggtttaagtgattctcctgcctcagcctcccaagtagctgggattacaggcgcctgccaccacacacagctaatttttttgtatttttagtagagacagtgtttcaccatgttggccaggctgttctgaactcctgacctcaagtgatccacctgctttggccacccagagtgctgggattacagacatgagctaccacgcctggctgaggtggatactcctattgtccctgttatttatttatttatttgagacaaggtctcactctattgcccaggctggaatgcagtgatatgatcatagcttactgcagcctcgacctcctgggctcaagggatcctcctgggtagctagaactacaggtgcacactgccacgcccagctaattattttttgtagagacgaggtcttaccatgttgtccaggctggtcttgaactcctggcctcaagcaatccttccttctcagcctcctagcacactggaattacaggcatgagccactgtgcctgtcttgtccctgttttaaagttaggacactgagatccagggaggttcagtgactatgaactccacagcccatagcatatttttctcttactgtgtaagtaggtacttaggaaatggtagctgctgcaatttgtcattttaaaaattattttcttttgataacaatctcaacagctttgacttctgaaattttcctagtacttttcacgtccagaaacttctggtgacgctcctgaggggatgaacccatttgtcagatagaattacagcccagagaagcagctacactccaggtcagggcagagcttgagccctcttctgagatgttgtcactctggcctctgaggccatctccccaccaggctgggggaggctggaggccagagccccggttggaggctcccctggcccctgggtttggctgcagctctgatgttgcagacacaccagccaggcagggtctctgggagcagcagaacgggcacaagggcattcagcccagctctgactcccgggtggttgggggaccttaacaaggaaagaacacgtgttcacagctgtaatttagaccttagaccaggcatatggtctgtccccagctaactccagcagcaggtcatctgtaaaattgcaacgttaaaatagcgcagtcattacccactacagggccaaaaataactaggaccggaacagggctgtgcactcaggcctgtatttgcccaggggcctctgggagcacctcctgaagccgtgggctcctcccggcaataaggcctccggctgtggctggcgagtagggcgggtggcgggtgtggccctgagccctaccaatgggccttcactgagagctcccaggtgctggtttctgtggggagggtgtgggcatgaggggccttacgctctagtgaagacatgagtcatgtgcacagaccacaggagggaagcagcttcctagagagaaaggagcatctcagtggggcctgggaacatggggtacaagggagaaacaggaccagactggacggccacattgggcaggcgcacgcttccatgccaggtcctggggaagcagacatgaatggcaggtactttaaagggaagagacgtgtaggcagtgcttggcagtgggtggtgtggctgcaggaggaagaagagatttacagtcaagaaaggcaccaacagcccgcccacaggagggatgaggccccactggaaggtgtactgagcaactgcgatgggcctgcctctctgctaaattctataaacttatccaagggtcacaacagcccccaggagtcagagctgttgtttcccccattttaaagatgaaaaactgaggttcagggagggtaatgagctcactcaagatgactcagacatgaagcattggagctgatatcttaggattaaggccttgctgttaaccacgaggctatattgcctcaaaggaggcttcctggaagaggttggatgtgtggggtttgatcaagtgaagaaagggcatttaggatagagggaactacttgagcaaaggcaaagaagttagacagtaaatattacattattaggaagaagctctgcatggttggagcttcttggggtagggggtatgtagggatattgtgggagaagagacggggaaacttaaaattccctcacagtcactggtcattgtggggattgtctatagtggactgggtggggtgaggagagtccctctgacttgccatgttaccttgcacaggtcccatccctgtctgggcttcagttgtatcatcaagtgaggggcttgagctgagggcctaaggctgatgagtggcaaccagtctgtaaggacgtggttagaggaggggaagggtcaggccagggaaggaggaatgcagaaaaatgctgaacatttcaggggtcagggaggactagggaatgttttgacagcagagagatcaccagtgaccttggcaggctttggttctttggaatggagggagcggaagtgactttggaaaggggccaggaaagggctgaaccagaggaaatgggagaatggggacatgaaaatgggggctggagagggagagtggagaatgtttgccaggggtagggatggataatgagatgttcaaaccttgatcaattagtattgcttgcctggggccttgtgctgagaaaggatcagagggaagtagagctgcaattgattatcaatgtctgccaagggtgcgggtcataggcacagtagcacttctttccattgctgtccttgcttagatgggtctcaggttgaaattggtggcctgggtatcctagcctgcagaggggaagccttaggtattaggaatacctaattccaggtgagaagaaatgcctccgcctccaaaaacctgatcttttgctagaattaaggtagtttgctgcatgataaagtagtatggtctcatggtcaggagcttgggctttagagtcagtcctttgagtctcagtttcctctctgtaaaatgggaatgagagaatgcctgcttgcaaggtggctgtgagtgttagaggtgatggtaatagctatggctttattattgttgcatctttgttatatgaaagcgctgtttttccctgatgatggtgctgttattctgaacttgagagcagggtctgtgtctgagttgctccagggccccatcactcaacccaggactggggacatctcagggactttcacattcttttggaggatcaaatggaataggcttgtggttgatgggacagaggataaggtcatgttgggctttggggtcatctcagtggagacctggcctcatgttggggtggaggcccagggatgagatctagggctggagggtcactgggcctggggccagggctggggatgggatggggttgtcctcgtcatttcttccttgagcgagtattgagcgctacctgcatgccaggttctagatgacagtcagtaagtccctgctcacctgatctcaagacatgaggggaactgggtacatctgtaagttcctgtataaccctccccagccctgacacccgcaccctctttcagatgaagaaatggcctcagagagggacagtggcttgctcaaggcaaatccagagaaatgtgggtgtacaaggctccttctggctgtggagagggggaccagagcccctggaggcccagggctctaggataggagctgagaggggcagcagggatccagactgggtaggggacctggtgatgccacctggacccagacttctgctcttgacagagccggaactccagaaccaagctgagccttgtagtaggggcccacatccctgccagagcctcagctgccctggaactagcaatacccaaactttcttcctgtggcttttcaatcagagccagtgaggaaggcctcaggaggaggtagggagggcccaggacatctcccagcccctccctgggggatggtctagggaagctggccctggctacctctcgtggcccctggaagctgattcctggctggatcctgctctgtcctcaacaagattgtgtgtgaggctgaagagcagttttctttctcatctgtaaaatggtgcagtcataacaaacacctcctacaagcacagcatctgtgagggtttcctctctgtaaaatgggacagagaggtaggggacaggaaggggctctggcaggtggaagtgtgaggtgttcattcatctttcttcatgtcctccttccgaggagccggggatggtcagaaactgtcagtgcagcctgcttttgccctcatgcccatttgcctccacggggccctcacctacgtggtggggcgctctttccacgtgtccctcctggtccatttgcccacccagtgaggcaggctcatccccttatttcctgacatttgtgtggttggtgcttttagagaactctccttgtggactctgttctgcaccattgtcacagcccagagaggggggaatgttagtcccaaagaggagaggggacttccctaggaccatccagggggtgggaagcagagtgggtctcgaaccttctccgatttgggaaatcgccttctcctctccccacccacccttacccttccctgctctccctgggctactgtctcctgcccagcctcccacatgcccctgttggtctctacggatgcgcacagggaggaaagcagtgcaggctggggccatgggaaccgctcagggttgaagtccgactcattgtatgtggccttcatctcatgactttgcctccctgagcctcagtctcctaatctgtagaatcattgtctcacaggattgcactaaggattcagtaagaaatggtatgatttgccctcagcaagtggtagcattgaagtaaagagggctcagggcttgaaaatagggctcgaaacttggctcttgcacttcctggctctctggacttggttatgtgattgagcctccatggcctccgtgtctttgtctgtcaatgggtttgattaaagcgttgacctcataggttcttaggaggattaatgagaacattttatgtaaagctgcttacatggagccttggtatgtgccggaaagctttagccctttattaaaagtgacagcagacccagcacggtggctcatgcctgtaatcccagcactttgggaggctgaggcgggcagatcacttggggtcaggagttcgagaccagctactcgggaggcagaggcaggagaatcgcttgaacctggggtgcagaggttgcagtaagctgagctcgcaccactgcactccagcctgagtgacagagtgaaactcagtctcaaaaaaaaaaaaaaaaaaagagtggcagtagtggtgggggagacccccatcccccttgctggggtttcctaggaaagaaggctggtgagagctgttgctggtggtgggccctgagccgcagggtctgagggcctaccctgtgctaccccagagctgcctgagaactggacagacacgcgggagacgctgctggaggggatgctgttcagcctcaagtacctgggcatgacgctagtggagcagcccaagggtgaggagctgtcggccgccgccatcaagaggatcgtggctacagtgagcaccccagtcaggaagggtgggggaaccagggaccaaggaccagcttcttcccagggtgccctcgtcccagcttgttactccagttgggtgtgtctgagcctggccctgcccttcattctccttccatccagcttttgggccttggcagaggggaaccattggacttgcaaggtcacggttagtggcttccctccagccattatggcctcttccagcctccccacccccagctcaggctccctaccaatgcattggtgacttatcagcaccaggaagggtggggagtttgctttcccttgactacctgcccaatggcctgagagacagcatagcccatcagagagcagattgccccctccctaactttgagcaagggtgggccttttaaatccacttcccttggtggcctcagacccctcagctcaatggatggagcagagtactcaggagtcatcctgctgggttgtgctagctcattcagtgccgagtctgcaggcccttctagctgtgtgtccttgggtaagtcccttagcctctctgagtccatctctggggagagggaggatgactccaggtccacggtgcctgacagatagctggtgctcagcagatgctgctcctgtttctattgcaagaaggtgctggctgagtggtcttgcccacactgctgccagtcacctgagctgagatgggccccgtgcctggggcttaggaacagtgaagtgtaagccatgagggtgggtctcaagtgaggctggcagactcctctgactcctgtctgctcccaaggctaaggccagtgggaagaagctgcagaaggtgactctgaaggtgtcgccacggggaattatcctgacagacaacctcaccaaccagctcattgagaacgtgtccatatacaggtacgctcagcatggggttggcccatccactctgccacttggggcagtgggtggagtatcccatctgaatccaggctctaccacttcctacctgggtgacattggagcctcagtttcctcatctgtaaaatgggggtgggaacagatcctgctgcacagcgctgttaggaaacgtggagtgcacggcacctggctcatgatgagcatttggttaagtggcagctgctgctgtcatcatcaccagttgcagaagacagctgagcccacccgtgcccttcccccctactccccaccagcatgccgctgagtcgggcttggagcagagaactgcagagtcactgccttttccttctgctgtgaatgcagcagctcagctctgggtatctggccagacattccagggaggcctcagccaaggtctgaagtcagagtatagatggtctctctagtgggtcctctggtcagcccttagagcctcagactatccccacctctctcggctggtcagttgtagtttttcagaactggaagggacagctcaggtccattttacagatggagaagctgaggcccagagagggaattgcctaaggctgcacagtgaggtagtagctaaactggaactaggatatccgggccagagccctgtccagcaggctcccgtctgcctggcatccctccaccctcttgctttgtctctaagcagatggctcagcccgttggtgcacaggccagtagtagggtcagtagatgtgtgttgtgggggtctggctgatgtcttcctctcaccggcctgatcatacctgccttcctttagtcaacagtttcagatacctattctgccaacgtctgtgccagatgaggactccaatcctgctcattgccctcaaggagcttccactctagttgggtatagtcgggaggaaacaggagatagagcatagtgttccaaaaaggcaaggaggagatctgcctggggaaatcccggaaggcctcccaggggaggcggcaccttgctggggcttgaagaataataggatctagtttgttgttaccaaggacccagtaacatttagagcaggaagctggaccccctgggatggagaagaggtaggcagggacctaacaccttcacgctctgcccaccggggtgttgatgcctgtgattgaagctggggccacatggttgaggggtgagtctatggcgctcctgtcccacctctgggttgaggggtgagtctgtggtgctcctgccccacctctgggctaccggcccctccccgattgagactctgaggctgactggaggcaacgaggagggaccagacaagtgagggagggtgggaggccgagggctcgggtggcccctaggttacaggtgcgactgggggcagagagggtgctccatgcagagggagttgctgtgtgtctcctcccgggcccactggggctccttgttgggtcctcgtcacacacgcaccccacccctactcccagctcttcacccctggccacagctccagaacttgcaagtgtcccagtcaccctgagagagatggacctgaatctcaccagacctctgggcaggggcatggatcggagggcaggtggggtgggggaggccaggtgaagggcattggtgagcaggggagtgtcctgctttctgcttccccttctggccagttggcacacagccttaagaggcagcatggcagtcatggcctctggagtcctacaagtgagttcaggtctgggctcaggtctttagcctcagtttacttcatctgaaaaacatggatagtgatagaacccgtctcagagggtagctttgagaatcacatgaggtgaggtctagaaagctcttggcacattgcctggtatgtggtaagggttcagctattactgttttggggtgtggctcagtgtgggatgggagggagagggggaagtgccctgcttccagtctttaccccattccttccttcctgcctggcctgggcccctcctgcacagatggcctaggtacccagcctggaggccaaggctggattcccagagtctgccctggtggagtgggaatagcaggttctctgcaactcaggggagctgccctgcagggcttcccacatgtgctcaggcccctgtgccaggtctggtgatgcttcctccttgcctttcaggatctcctattgcacagcagacaagatgcacgacaaggtgtttgcatacatcgcccagagccagcacaaccagagcctcgagtgccacgccttcctctgcaccaagcggaagatggtcagcggggagggctggggcggggacagggtccagtggccttggcagccttgctctgggtggggggctgtctggtgtgggaggcaggacccaaaggtgaccattacttaagaagagggtgaaatctctgggaaccccaagtgggtgccgagagctaaggggtacagtggtggggctgcaggcaggcaggtgaaccgccggtcagctttgtgtgggcagtagctggcccatgtccccagtgtgtgtctgggcctgttctctctgtaacgggatttgctgggttgagattgttttggatctcctgtctttaatatggtctagggatgcagggccttctggtgattggtcctcggaaatgggagatcaggggggcctagggtggaaggcaaaggcgagagccgtcagagaaccaggcttgctgtgactggagtgtggagggcaatggctgtttcttggtgcctcctgtgagttcattccagctgtgaccagagtgtggaggacagtgaccgtctctcggtgcctcctgtgtgtgcattctagtgctaggcttccaggtcttcactcgtttaattctcacggctctgcaaggtggcaactgttactctctccatttttttttcttcttttttttaaagttttaatgaggaaacagactcccagaggccagctatcttgctgtcagggttagagtgggggtttaaacccacgtttcttcccctccctgcgtgactggggagttcagagctccttgtctcatttccaggacaccccctgaccacatcttagctgggatgagtgggaaccttggtggtcacgggggatttgtcctgaatttgggggcaagaagtggagtgggtcaacctttggcattgcagcttttgtttctgagacccccaggatctgagcattctccctataaggtgcttcctgacatccattgatgtagcattgacacctgttaacctctgttgacagctctgagccccagtccccatgccctatagcccttggaacctaggagacaagatccccttccctcccctgtcatcaaaggacatgtcaggtacatcacagtctttgtggtccccaggcttcctgctgcccatcaggacacactttagatattgtgtaagttgtaacaaatgatcgcaaatttagtggcttaaaacacaaatgtattctcttatggagaagaaaaatgtattctgtgacagaagtagatcaggagtctaaactaggtcggcaggattgtgtttttttctggaggttctggggggaatccatttccttaccttttctacctcccagagactgatcacctgcatttccaggtttgtgggcctgtcctcatcttccgagccagcaatgtagcatcttctggtctcctgatttcatcgtcacattgctgcttttagctctgactctcctaccccgctcagcactccttctgatgacatttggacactctgagtaatctgggataatctccatcgccacatccttaactcacttctgtaaagcccgtttgctgtgtaaggcagcattcacgggtctcagggattaggatgtggacatcttgggggcggacacacgattcagcccaccacaggtgtcatggaagaggcactgtaggaggagacagtctagcggtctcctggctgatttgctgtgttaccttggagaagatcctgcctttctctgggctgcttgcctatcagcagaatgagaaggttgcctcagtgacctccagggttgttctgaaaggccccgggttcttttgaacaccttgtttctttcctgcagactcagtgtcactggccacttgcctcgtgaggtcccagggctccaagttgctgtggcatctcctgtgagttcccacagatgtgactcgtggctttgtcttttaggaggccacacagacttaaaaatacagctccttatgtccccattgttcatctcttcctgcccgctgaccagggcaggccctgggcagggacagctggccctgggtgggaggggccttcgacggtgcagaggcttcctctgggatgaggggtctgggagtaagagagaggtgcaggcccagctcttacaagggagacctggcctgtggtcagagaacttcacacagacttgagtgaaatcagcctaccctcaggccatgaggtcagttacgaggaaaacagagccaggccgctgctcagccactgactgcagagccctgaccaggcagcagaagggcccctgccagacacccaaactcttcatctttcttagtgtattcttctcaggttgggttgatggctggagtggtttatccatctccctaccctttgctacctggcctccctgcttcaggggccctgcggagccctctccaagacagcgcagcccagcatggtgtaaatacatcacctgctacctcaaggtcttagcccaacccaggctgacagtgtgttggtggcctagacatgttggaaatcctagattcttgggctaagtggaagtgttcttgggggaggcaggagatggaatagctgcgtcagcctccgcacctgctggcagctccgccacagaggtttggcaccgtctgtcctggcctgagccatggagaaaacatccaaggcggtagagaacagcccagcatcagtacctggaacccaggggggcttagttctggggtggtagtaaatctcactaacttccctgaagttagagtcagtgagacttccctgagacagacaccttgaatggggctttgaaggctgaggagccaggaggagtttgccaggccgagagaagggggtggggtggtgggtggggagtgcacaccagcatgggattaacacacgtgcaaacgcagaggggcgaagtgaaatggttcccctggggtgggtggtgaggcagcttccgtttgcagtgggccttgaatcaggatgttgagggccttgaatcaggatgttgagggccttgaatcgggatgttgacaaaacgtcagtcattgtggctgggggcctccacatccctactcttcctggctgggctgccggaatgagttcatgacccattgaggttgggggagaaaggctcctttctacatcacccaccagtccgttcaactctggggcagcacagccaccccaggtctcccctccctggtgctgctgggcacagccagcatagggttcctccagggaatcccttccatctgcccaaccgggaggcctctgggctccaaagtgaaggtgtcatgcaggtgctgggcctgggctgatggtaagcaaagtgctacccccatttccacccaggcagcacggggccaggctgctccctcccccatgaccattggcatcttggagtgatccttgtgcaaggtttttgcttctggggcagcagggctgctggggggcatgtggctgtcttggtttgagtttctggccccttttgagccatgagcagcctggttcctgggaacaaggaatgtgaaaaactgggcaaggtagcatccactcaggataataaggcagacccgaaggccagaggcagtcaggaggggtgggcatcccgcctgggcaggcctgagcagtccctccacctaatgctggtcctcggatccctgcagccaccccaggaagcagggcccaccccactcccagtccctgcccagcctgggcttgcagctacctgcacacatccacctcttgggttgtattcagtttaacttacagcttgggacttcagggcaaaaaggtaggaatgtatgcaagtgaacaatcagatttatgcaactacagtctaagcttgtgtctccagatttccagcaggcttaaataatggcgttttcatatccctgccacattgggtgtccagcccttgcttgggtggatagtgatctgacttgggctggtaattagcccatatttttagttcatgggcaattctcaatggtaactgggtctattaaacttgattcagatatgacagcttaaattgtaaacagctgcgaagagtttcatacttaattaccatatttaagttttgccataaagtgcctgtacttccatcaaaaatgtaaatgttggagacattcaaatgaggttttatactttcgtgaagtgtaattggcacggatcagtcagtttgtttaggaattttaaatatttttttaaaaggagttttaaaggcagtggccacaggtccatttctcaattaaattgagttgtctgggggagggcagggagcggggctgaggctggtgaggcctgaacttgtagacttgaaagaggctggtgctttcttctctcagccagggcttcagaaggaagctagatgtttccggctatagctacgaactctgggacttccactcccagaagctgagctgattaaccctggactggaatggctgagagaggaaggtgttgagatgaatatgggctggggataggtcctgggtggaatgaggcctgcacctcaggtgaatgtaattcacccagcattgttgccacctctgggaggctttggcctgctcccgagggcaggggtgttcagattgattcttgcttttagggtgcacaaagctgggggaaacacaggcaggggagccagtgacactttcacatgcatagtgccagagggaggtgggtggggctcgaggagtctgggactggtgacaggagaggtggtgacatctgagttgggtttggaggggtgagggagagttcccctggggtgaagggccgaggtgtggcccttccttacaggtgggttatagcactgaccggttttggtccccgggccttcattgacatcttgctcctatcaggaaattgacaagccttctactctctttgtgggatccagttatggtcccaaccggaacctaactttcacctctctggctgtggctcatttggggcaatggctgggcccttccaattctggcttttctgttctccaattccaagggctaagtccacaggtaattagggagggtttcttggaggaagtaagcctcacagttcattgaattcagggaagcccaaaggggaaggaaaagacctggagaagaacagcctttgcaggcaggggccctagagtgagagtgagaactttggtggggccagagatagtaaagatggggactctactgcctctgcgaggctatggccttatgacaccccaggctgctttggagacctgggaagggccaggaccctgctctgcccagcaggcattccagagcctgggatggagctgcagaagctgcagggagggagccagggggcctggcctggaggccccagccctccagtgcagacttgctctgccctggctgacactgcacccctccccatccccacttcctgttttcaggcacaggctgttaccctcaccgtagcccaggccttcaaagtcgcctttgagttttggcaggtgtccaaggaaggtgagactttgcatctacattgtgggtgtggtgggaggtggggagacacataaaggccctggggtcagacctggaccgacttcctgcctcatcacccacctggcttgtgactgtgagcaggtcccttcaccgctcagagtctcggttttcccatctgaaaaatgggaacagccgtctccctccccaaaggtgcttgtgaggattaactgacatccgaaaggtttctttcctcccggctggaaacctgaaactgccccttgaggttggccaccgctaatcacccctgcccggtgattgctggggacagagtgctggggtctgaggctccaacatgttgtgccttggtcctgcagagaaagagaagagggacaaagccagccaagagggaggggacgtcctgggggcccgccaagactgcaccccctccttgaagagctgtgagtcctgacggggaagggggattggccatgcggtgttggggttgcgcttcacccaggggggtcccactcctgcctgggctgggagagcctcttggtttttcacttgtgttttgttaaataaataatacacgttcattacagatcaattagaaaatgtagataaggggaagaaataactcattttagtacattttcttctagatatgtccctatgcaaatatataaatatgcgtctatctttctatatacttaacatagtattgtgtggttgcttaagaaaacttaactattgtgaatacaaaagtttcagtctaagccattagtcaggttctcactctgtgggcagctgcgcatctgctgtggggaggtgccagggccgggctctgctgggaggcctgggcaaggccacatcagaggggagggtcagggccaggacagcccagggagggggccaggaaggaagaggctgatctcccactgacaacctgaccggatccctcacagtggtcgccactgggaacctgctggacttagaggagacagctaaggccccgctgtccacggtcagcgccaacaccaccaacatggacgaggtgccgcggccacaagccttgagtggcagcagtgttgtctgggtgagtggttgtgtggccagcagatcggtgatcctcagcctgacctctgggtgagcctggggctgctccagggaccaggccctgggacccgtgacttgtgggcctctgggaggaccagacccagcccggtagtgcccaggcgcaggataggggatgaacaatgtcccttttgaacctgaggctgcatccccaacaggcttggctcccagcacagctgtctcctcacaatgcttggcctcttggcctgagcgtccacggctctgcccaccacaagaccagccaaaggcgcccttgttcttggtgtggcagagctcgctcctaccacccctccccctcagccgcctgaatgaggacccagagacttgggcagtcaccagcttggtccctgactccctcagggactcagggcaagccccctgacctctctgtctcagctttttcatctcagtaagggtgatgacctctgccaacggaatctccccgaggaacctgaaatttaattttaatttttcatttggaaataatttcagactgtgttacaaaattagtacagagaattcctgttcacccgtcatccagattccccaattgttaacatcttgcatgaccacattacactggtcagaatcaggaaacaaacacgatactgtgctgttatataatctatagaacttacacatttctccaggtgccccttcagtgtcctgtttctggcccaggatccattgcagaatcacatgttaacttgtcgtctctttaatttttaaaaatctgggtactgggggctcccctggtgtccctcgagcctgttctctgctgtttgggaaccacccttgccacttgcccatcctcaccagaaggccatggagggacctcacctgtcgcttttctgctgaggctgtgggactcctggcatcagttatccctcatgaacttggaattttggcttggcttttggaagtaaatgaaggcaagaaaactcccttccccaccctcttccttttggaatttgaaagccatagaagtcatcaggtccaatgccctcctcttattgaaggaaaagctgagtttcaacgtggagcagtgacttgcccaaggtctcacgggcaggtagcatggaccagggcactgaacccacctgggtctccagacaccctgggacatggcctttctcctctcccacgtctccagctttgggtccttgggctgagatgctggcgatgcacccaggcaggaggcctgcctgaggccgtgcctccaggcgcccaccctgagcttgtgtcctgagtccctgtagcttacccagggctgggacaagccccagctgtgagcatgggctcccccaaacatagttcttatctcctgctttgttttccccaaggagctggatgatggcctggatgaagcgttttcgaggtaatgctagcttcctgtgctgggtagggggcctggtgtgcgtgggctggccctgctgccctttctcctggggacctttcccctgattaagaacacaagccactcagaccccctccagagcaacagtcccatccctccactcaaatgcttccaggggcagggagctcactggggaggaaaccccttccagcgttgtccagagctgttagaaagttcttactgttgagtcaaaaactattcctggtggctgctctgccgcagtctgaggtgagcgaaacacactgcagctcaagttgatttcctccgacttgaggaggcgtggccttcaaaaatgggcttttttttttttttacaggctttgctccctccacaggtctgtgtttatgaacaggggaagggagaaagtgtttaatgaagctcgtgaagcgttccatagcagggaaggtcaggcacagtgaggaggtgttttggtatagcctttggtggcatttccccgttttcccaggggccatccttgtggccccctgcagcttggggacatgccactgagaaggctgtggctgaggagaggcctgggcaggtcagggttccgagccctgggtccccgtctgtcaggcctccctttctcacttgagaccctcagcagcctcctacagccctcccacatcaggggctttgtttggggttggagtcagcgatttttggtccagcgggtggggacagagtcagggtctttgccctcctgcctcctccttcctcttccttgcctccttcttgccagggactagtggaaaccccttggtccagcctggggcgagggcgacagtgacaccttccctgcctcactggctgacgacacctgccctctgaagaaaatcttttgtttgctttctccacattattttgagcatcatgtgccctttattaacaattttgaaaatcagcaaagcattaaacagaaagtaacaccatcctgtaatcccacagcccagagttttgggcttaattcatgctaatcctatacatatacattattttgcattgatcagctcatcgtatttgcattttgggatcctgatttttcacttaacagcgatgtgtcagaagcattgctccaggctgttaaaagctcctcgtaaacacctcttccattgactgcctaacattctcttaagggaagctgctataatttacttgactctcccctattcttttggacatgtaggttgtctccctttgtaaatttatttttcgaacagcacggtgttgacacagttatagccaaagaatcttccgtgttccctcccacagcttgttccccaccccacccccacccccgctgctccctttaccagccccttctcctctttcctgggcatgtcctgactgagctggggcacagagtgggtgctctggcctctcccgggggtgggtgcaccgctggctgcccctgacttttctgagctgtttgactctcaaggggaggtgctttgatctgaggttactccacctcccctgcaccgggggcttccttcttgggccatgtgccctgctgttccccactggtgccccctcgcgtctgaccctggggcgcgccagccctcacccaggctctcggctcacacagctctgccttccaggcttgcccagtctcggacaaaccctcaggtcctggacactggcctgacagcccaggacatgcattacgcccagtgcctctcgcctgtcgactgggacaagcctgacagcagcggcacagagcaggatgacctcttcagcttctgagggcccggggccagccggacacaagcggccctgacacgtgatggaccaaagccacctgctgcgggggagccagttctggggcccgcctgccacctctcccagccctcagcattgtcagcctgaagatcagagctgcagccagtcaggcaggggagagatttttcttttaagccctgctctttctctgagaaccaaaagatgccttgaatatttattcagtgacttctggcttatgctcagaagccagtctgcgtcaggcacgtctcctgctgcgtgacatgtgcagtgctgtaatcggctcccgcttgctctcctggagcaagctctgccctggctgtgggtatcaggactgtgaccaaagcatttctagtcccttctctctttctaaggacccaaatttccctgggggcatcctgcttcctgaaagctgttggatttcagtgatttttccccccaccccccagcacaggagagcacccacagccgcagaaggggaatgtgtcctcctgctctgcttcctcagggcccagcaggcgggggtttgagccctggaccccaggctcttagagactaaggggcagctcctgaccaaagacgatacagcttggcactttaaagcattaacagcaggtgtgaccctgagggctcctccatggtgctgcattgagtccagctttccttctgcccttcctccaggagaaggggcccaaggtccccgtggatggtctccacctgtgcttggaaccagtgtaactggctgctccctgctcccagggactgacacggggatcatctctgtgaccgccctccgtcgggcccctgcctgccttctcccctccacgcaaggctgtgctcttcctctggtttctgtgtgtccgtttgagtgtctgcgccccgcctccccatacttcctgggatgatgtgtgaaacctgacacctagatttatttggaaatattctatgaccactttacagatgaggaaacaggcctcaagcgtggaggggtagagtgaagagtagaacccaggtctgatgccaaagctgctttcttctctgcctcctcctcacgcaactcacacctccttttcttctagctttgttgtcctcccaggaaccaaaaaaccccagctattttctgaccaaaatgtgtttcataacaaaccatctggtgcctttccacacagaactggcaggagcctcgtgtcctgctagctgtctctcttgttgatttccgtgaaaatgcaagtgtttgaagtctgctcattccgagggtgaaacaaaatccaaccctgtcagaatcatgctgttctctttgctgacactgtgaccctgggtcgggacagaccagcagcaatctgtctttagaatcgctttccttcctccccttttgcccccgtggggctcccggcatcctgaaagccagcaaagcctccagcatcttttccatcctgaggtgcctcccagtggcctggcttgtcggagcaagtttcatcagccctagggaaaacacggccctcctgggaacctccttacctggagtaaccggacaccttagacggaggtgcctgagggtggggtgggatttgcagggtcattatcagaacatgaggataacttccttgcccctgctctgtagccacctccttggcaccggcctctatttgtcataaggcggcgtgggcgaggcctgacacaggccagccttggcacgaggggggccaggggttctgagaagcgctgccctgtgagagccacgctggccttcgtctccatctctggttgacgggctgtccgtgtgcctcctgtgtgtctgcagacaagtcttgctgtgctttatttgtgaaactttaatgaggaaaaaacaaataataaatgttctcgttttgaaactcaa

SEQ ID NO: 61505 - DNA, 3537 bp, Homo sapiens
ggagtccgatcatgtgatcttcaacatggcgacgctcttggttccctacagaaaggggcggagcctggactggggggcaggctcagattcaggttaaattgtggattgagctcgcagttacagacagctgaccatggaagcgaatgggttggggtgagttctccagagcacgcggtgtggctagccgggcttctaatttgagtcttccaactcaggactctatccctctactcccctttccccaccctggagacctcccaacctgaactccgttagctgggatcctgaatcctaaaaccatggatttttgagatgttcatcccagggccttaattcaagggatgcctcaggatttccaaccaggatctctattctgggaccatcaactctgatccctctttatcccccagcctgggtatttctcagcccctgaaccagcccagtgacattcccgtttctgaggctcactagttcgaagacccccaaactatccttagtgggccttcattccctccccccagtccctctggttgcttcgagcttggaagagtagagactaagtggagggaagaggccccagggcgggcccttctggagtttgtgcaccacctgataggcagagaggaggcggaacgggcggaaagccagggtttgggagctggcctggaggaggtagatagcggtcctggactgaatcggccttatgaacccgcgctttccccagcctccagcgtagcatactgacacctacccccacccccacctgatcgccagacctcagggttttccggagctgaagaatgacacattcctgcgagcagcctggggagaggaaacagactacactcccgtttggtgcatgcgccaggcaggccgttacttaccaggtaagagtcagggtctggaaatctagataaaactccggagggagaaaagttttcgaggggcaggggagggctctggagggcctcaaggctgagccctgtcttccctctgtatgcagagtttagggaaacccgggctgcccaggactttttcagcacgtgtcgctctcctgaggcctgctgtgaactgactctgcaggtgaggggtccacaaaagagggaaagatttatgccttcagtctgccacctagcaacctgtctcctgtttcctacagccactgcgtcgcttccctctggatgctgccatcattttctccgacatccttgttgtaccccaggtacccactcaaacctgatcctagaatataatccaaggacgccttgaaaatccttctatcagtccagtcaaggtttacaataagcacttatcctaactggatcgagggaaaaactaaggttgaaagaaatggagtttggcagagttttattctccttttccttcctcctggaatgagctgaacagaacctttcctcctggattccattttgggaacccagatgttttctccccctccaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccagtaatgtgggacagggcagggactcggggcgcggggagatcactctggaaggtctggggtagacaaaaggaagggtcagtctggcttctgtgacaccatctttctatccttctctagtggaccctgatgacatacatggttgagggtggtggctcaagcaccatggctcaggccaagcgctggctctatcagagacctcaggctagtcaccagctgcttcgcatcctcactgatgctctggtcccatatctggtaggacaagtggtggctggtgcccaggtgagtcctgagagagagagaaataggctgggatttggtctgtaaggaccagaagcaagagtgtcctaaacctgagagggcaggggtcttaatgccagggatgaaagaaccttggcctccagtgatctagcggagcagccaagcccatcctgacactgacagtggggcttaatgctctaagtattcagacaccaaagttagtgctgggatctgaggaaagtaaatttttttttttttaattactgggtttttagggtcaggcagtatcagggattgaagtcatttggggaaaattgaggtggattttgtatgtgggggaaacttcctctttgtgtgttacatatttttcttcaccataccctaactaggcattgcagctgtttgagtcccatgcagggcatcttggcccacagctcttcaacaagtttgcactgccttacatccgtgatgtggccaagcaagtgaaggccaggttgcgggaggcaggcctggcaccagtgcccatggtgaggattgggatgggttgagtgaaggtggtcctgtggagctttcaggctaagtcctgcatggactggagtgaccactggagggcagcagaagtacagtcaagaaagattagtggttgtagcaaggccctctgtagcctgagatctgcttttttctagatcatctttgctaaggatgggcattttgccctggaggagctggcccaagctggctatgaggtggttgggcttgactggacagtggccccaaagaaagcccggtaagccatggaagggtgaggccttgaggttgaggtgggggtgttggctgggggagctgccatgtatgcagttaccagaacgtggcgctggctttgcttccagggagtgtgtggggaagacggtgacattgcagggcaacctggacccctgtgccttgtatgcatctgaggtaacagccagggcccctctgtgtgtctgttactgtgcactcctgtggctgtggctgtattattctgtgtgcacttgtttttaatgtctgtctgtccttttcttctactctgtacaacataagccctagaaagaccggactttttgttgctgttgttcatttgtgtttatgcttcatgcctgggtccatactagggatctgataaattttattgaatgactgaataacactgagtagaagcatgcctacatatgcgtttgtcactagtatatatagggaggacaaaggcttgctggtcctcctgtagccagtgccctgttggtcccccaggaggagatcgggcagttggtgaagcagatgctggatgactttggaccacatcgctacattgccaacctgggccatgggctttatcctgacatggacccagaacatgtgggcgcctttgtggatgctgtgcataaacactcacgtctgcttcgacagaactgagtgtatacctttaccctcaagtaccactaacacagatgattgatcgtttccaggacaataaaagtttcggagttgaactattgtgtagttttgtttgtgaaagattgtgcccatatcctcagttcttcttagcctctgctccttccctgggaaccctctctatatcctctt

SEQ ID NO: 61506 - DNA, 9831 bp, Homo sapiens
agcgcaaggtgacgggcgtggacgcggctgtggggccgggagcggagggttggggtctggcctcccgcgccggggcgaaggggcagccgcagcgcagaggcccgccccgccctcccctcccgtcacgcccagcctcccggcccttgggctgctcgcggcctttttttcccggctgggctcgggctcagctcgactgggctcggcgggcggcggcggcggcgccggcggctggcggaggagggagggcgagggcgggcgcgggccggcgggcgggcggaagagggaggagaggcgcggggagccaggcctcggggcctcggagcaaccacccgagcagacggagtacacggagcagcggccccggccccgccaacgctgccgccgggtgagtcggggcccccgcccggcgcccgagccccgcgcgggggtgggaaggggctgcggaaaagttgggagccccgggtgccgctttgtcgcggggccgcggaggggtcgggctgggaaggccgcggggccggggcgaggagggaggcggcgctggcggggggcgctgcgggcgctcatggcggcggccgccgggtaaggcgggcgcagcgcctcaagggagcggccggggccggcgggcctggcgccgcggtgtccgcggcagcgccgccctgagccggagaagctttcccgggcaacaggtagggcggaaggtggggacgcgggggctgcgggcgacggggccgagccgtgggcttccctttgttggggagtggaggagcttggtgaccattggcgcgagagcctccaccctggcagcggcccgcggggttgccctggcctggacgcgtcctgtggcttgggtgggaggagaggggagggccctgccccgttttcttcctaccggcccaccgtgcccacctcgcaggcgaggtcagagcttccatgtgcttaacgggaaacaggaaggagcggcccggagcgcctgccccggcccggtagggctaaggcataccgttatgaggtgtggatggctggcaagggagctcctggtggaactggctttctgggccgtagcttgttaatcactagaggcccgtggcaagtgggttgactgcaggtgtagagcactcatctttagcctgcagttggagtctctccctccctaagcctagctcctggcatcaaaacctggtttcagtcacctgagttgccaggcccaggttcagggggttctgaggatcgtggcgaatgcagtgagcccctgttcctggagaagtgagtccgagcaggcctccagcaggcagtcacccccatatctgtgctggggcaggggtgggtggcggttgctgccgcataccggagtcgggatgaccgcaccggggtgtgagtggctgcacatgtaaaggggctcctaagggtaaggacttgcctgcagtcctgtccctgaggacctggcgctgaccataccgtgatctgcacagtctgttccagagagggatccttttctcccctggtcccccacttccctcactggggcctctggccagattttcccctgggaggaagggcctccttttacccctgtcactggccataggctggctgatccctcactgtgtccttcaacaccgccccagctgtctctcaaacccaccggcgtctccctgcccctggggccatagtctcatgcagtgttttggtccgtggaggcctttggtgggactttgcagacaagctgtaggccagatgaggctgaggactactgttctgactgcctctcacccacctcttttttacaatctggcttattttgaggcccatcctgcagcctggagggataacacacctctcattggctccatccatggcttgtagacttctagtacatgacctgcttctgttgcctgaaagttttcaacaaggaagactattcaggacttcttcagtggaagcagggagccggtgggacctttgtcactcctcccttgtcaacaactcctttctattttcctcagttattcttccaaactatgagagccagtcagactgaccacctggagtctgagagaattccttcctctcaggccgaaacttctgccttctcagccgtttggatctacaaactcccatggggatcctctgctcctttcatccacctagaggggtcttgtgggggtgtcagtcagagttggggcaaaggttggggctggacagagtcctgctcaagttcctgctaatctaatgccagttaaatccctgctcttctggcccctctccagcctgtgcctcagaaagtggcatctgtgcctccaaggcaggtgtgtgtgagagagagcgtagacagataccatgtctcttcatgtgtatgggggagtgaagtctgggtggaaaagtgtttctagatgtgattttctccataagaagtcaagtaactgccctgaaggcccagggggcctggaaaaacagggttgtctccttaccgtgtgtacacttcagcttttcttgccccagcctcttgtttatggggtcttgcttggatctgtgtgctggtgctaagaggcctccccagtactgccacagggacccaactctttggttctgtggggatgtgtaagtgaggccggccaggccccagctgtcctcccctctcttcatgttgagtcagaggtcctgaccctgctgaatctggggcctccctgctggggagatgggggtagtgcctctctgctaatggaggtgcaggaccaccagggagggctgtggtcatgggaagcctgcaacctcagtgtaaaagcccccattaatctgcatttcccaagtcttccactctccctgcttggagtggaagaggacaggcgctatctcatcttggggatgaggaagttgcactgcccaggtgtctgtccttgaccatgctctagtgcctactttgcctgccccccaccccctgttttgcaggcatgagacattcctgggccccaggagtccagcaggggctccaccctccctctgcgactccagcctgccgcctgactagagaaacatccctgccagttttcacagacctggttggggatgggatctgaagtctaggactgccagggcaacatggtacctttggctttacatttccctggagaagttgggctccaagagacagcagtcaggtgactgggtcaggctgatttctcgcttccaatcaggctgagcaaaaaagtgggaagagggggccatgtgcacacatcaaagtgttccgcattgtcccttctctgtgcattttctacccttgtcccttctttattcaattttctacaacttttctctaggaaaaaagtgtgtgtttgtgtggggaaagttccactgtggataattacatttaattttgttcagttcagaaggcttccatctgtttaattaaatatttattctggctgaggtggagggggcaggggcagtgtctggaatgtgtgtgtgtgatttgggggaggaggaggggagaaggtggagctgaagctcctttactggcagtgctgacctctgatttcatccgagagagcagtgaccaggagtggggacaagggggtaaagtccttgagctggaatactgacccgtgacaggctgagggatttcgcaagggctacagtggtgggtgggggtggagcgggagctgtcagagcagcagcaggaccagcccagcccagctgtggtctcaggctctgtcttcagtcagtggcaccaactagtctccaggtcactgtggataacaatttcaccactctcttttcttcctgtctctgctttcactttctgggccagcctaaatcccaccgcctcatctccttcccaggagaacaaggggtggggagcctggaaaagactgtcatggtcatcctgctgcggcttcttgctgagtcctaggattgccaggtgtttgctggacccagcatccctggctctcctggaccatcttgccattcctctcagcttcaagcagctgctcttccctcatgagccacacacgtctgaccgttccctccctcctctgggtatccaagtggtcactcccaccatgttgttcgtctttcagttgggggaggaggtttacatagcggctctttcctagactgagagggtatgggtgttcccctgcagactaggattctgttttctggatgagcatttatacgaaatagctctgaccaggcaccgtggctcatgcctgtaatcccagcactttgggaggccaaggctggcaggttgcttgagcccaggagttcaagaccagtctgggcaacatggcaaaaccctgtttctaccaaaaaaaaaattcaaaaattagccagatgtggtgtgtgctacttggtagtgcatgctactcatagccccaggcactcgggaggctgaggcaggaggggaggatggcttgaacctgggaggtggaggttgcagtgagctgtgattgtaccactgcactccagcttgggtgacagaggaagaccctgtctcaaaagaaaataaaagaatagctcttaattccatcagatgtattggtccgctctcttggttccctgccccacaatccctgactctttgcagccctaccttcacttttctttctgaagagttatacatagggtccttctgccttgtgtgtagggactagatggcttggcatggagtgtcaaccttgtgtgcagtagttcgatgtccagtgattgtggagctcagtgtcatttggggacataattttgctttaccttggcttttttttttttttttttttttttgagacagagtctcactgtgttacccaggctggagtgcagtggcaagagcatggctcactgcaaccttcacctcccaggctcaagtgatcctcccacctcagcctcctgagtagctgggattacaggcatgtgccaccacatccagctaatttttgtattttttgtagagatggggtttcaccgtgttgcccaggctggtctcaaactcctgagctcaagtgatcagcctgccttggtctcccaaagtgctgggatttcaggcgtgagctactgcccagcctaccctgtctcttaatttttctttagggacttgctactcagatgggttgtaggttgtagggaaggggaagaagggtttgcctcagccctgcaatgttttggggcaccccctggaagctttcagctgagttggcttggaggctcgaggaagtggccagagtgtagggggataagggagggactttactcagattgttggctacagcttctagggccaggtcctgcctgtcttgcaggttaagatagcaaaatgacaagacccccaaggttcttcccccactccccgaaatcagaggttgtaaggaccccaagtttcttaattccagggaatcacgtctgcaggttgctgtagacaataaatgctttttttttttttttgagacagtctcgctgtcacctaggctagagtgcaatggcgtgattccggctcactgcaacctctgcctcctgggttcaagcgattctcctgcctcagcctcctgagtagctgggactataggcgcccgccaccacacccagctagttttttgtatttttagtagagatgaggtttcgccatgttggccaggctggtctcgaactcctgacctcgtgatctgccagcctcggcctcccaaagtgctgggaccacaggcatgagccatcacggccggcctaacagtaaatgttaaaactggaaagccaccgtattacagatgaggaaactgatttgcccaaggctacatagccaggatagggatctagagttcgactctctgcccccttctccttttgatacatcctgaaaacttttattcatctatctcttcctccatagctactccctcttgatgccctcccctttgcccctcactcaggatgctccagaccttgtatgattacttctggtgggaacgtctgtggctgcctgtgaacttgacctgggccgatctagaagaccgagatggacgtgtctacgccaaagcctcagatctctatatcacgctgcccctggccttgctcttcctcatcgttcgatacttctttgagctgtaagcatgccagcctaccctcatgccttcccctgttgccagttgcagtttcttggacttcaagtttgttccttgctgtttaattagcccttgaccctgatgttctggctactcaggttcctgcccactgtgcaccccctcccctgaaggcaccattgtcttcctgaaggctcagcacccccaggccctttccatcaatggttatttgttctcaccctctacccgccgcccgcctggccactagtgaacacacaggcagctttgtcagctgtgggcagccctggaggctagagaaaagggggttgccaggaagctggggaaactgaggccagggtaaagttgccttagcttgcagccctttcccttcccagcaagctagataccttactcatatcccttccccaggtacgtggctacaccactggctgccctcttgaacataaaggagaaaactcggctgcgggcacctcccaacgccaccttggaacatttctacctgaccagtggcaagcagcccaagcaggtatgagccgcatgctgctctggctctgggaatcactgagtttggtggtggggggacagggtttgaatgttagctctggcaggtgaagagatggggaagcagtggtgctgactgaggttgttactgggagaggctggggatgctgctgagttccgaaggtaaacataacaatgggcttcttcactgtgcccaggtggaagtagagcttttgtcccggcagagcgggctctctggccgccaggtagagcgttggttccgtcgccgccgcaaccaggaccggcccagtctcctcaagaagttccgagaagccaggtgggggaggctggggcagaagctgggtgacaaggaatatcctgatgtgtcttgctgggagggataggcggtggctatacgcagggagatgtgaggaggtgaattcagttattaatggtatcttgtgagggtatctgcaggtatttgggggctgctgggggactgtgctatcctctgacctagccatttctgcttcctctgccagctggagattcacattttacctgattgccttcattgccggcatggccgtcattgtggatgtgagtggggattactgggaggtgggagtaggttctctggcaaggtcaggtgaggccatggaatttgggttcctcctcttttaacttctcaccatctctctgcagaaaccctggttctatgacatgaagaaagtttgggagggatatcccatacaggtatgagttctgcttcctcatgtgggggtggactaagacacaccctagtgaagagacggtttgtggaatccatggcagagggattagagtgatggaatgaagaacctcaggggctagggggtttgtggagtggggacacccttgcggctggttgctcttacctctctctcctctcccagagcactatcccttcccagtattggtactacatgattgaactttccttctactggtccctgctcttcagcattgcctctgatgtcaagcgaaaggtgggtgaaggggttgtgcaattaagcctcagagccaaaatgaggccctgggatgaacaccctctcctttgacttctgggtactctgaatggagctgttggtatatggggaaccaaaggcaaggggtaagaaggcatagtgagagctggggaataaaaaaaggccctggggcctgcatcatctctgcaggatttcaaggaacagatcatccaccatgtggccaccatcattctcatcagcttttcctggtttgccaattacatccgagctgggactctaatcatggctctgcatgactcttccgattacctgctggaggtcaggcttcctcaaatctagagaccctggtgcaggttcttctgtccctttggttttctttgggagggaggtgcggggtgggaatttggaggatgacattcctgggaccaaggaggagggcacagagtcagtgctcctaactggagtgtacatatgaatgtactcgagggagtcaggagcccatgatgatggatgggggctctctatgcagtcagccaagatgtttaactacgcgggatggaagaacacctgcaacaacatcttcatcgtcttcgccattgtttttatcatcacccgactggtcatcctgcccttctggtgagtaggcagctaggctacactcctgttctgaagaaatcaggagccttgcctttcttcccctcctgtatctccccggtgtctgacctgctcttgtccacgttctctctctccttgaatcctcaggatcctgcattgcaccctggtgtacccactggagctctatcctgccttctttggctattacttcttcaattccatgatgggagttctacagctgctgcatatcttctgggcctacctcattttgcgcatggcccacaagttcataactggaaaggtgaagccctgttcccattgtgtaggccttactactctctacaacttcctgaactcccatcttgccagtaactctctaaaaaactagtgtggagccctgggtataacaggaacaagccctcagagagaagcagtacttaggggtttgaggatctcatgtaataacccttcttgtcccttttccacagctggtagaagatgaacgcagtgaccgggaagaaacagagagctcagagggggaggaggctgcagctgggggaggagcaaagagccggcccctagccaatggccaccccatcctcaataacaaccatcgtaagaatgactgaaccattactccagctgcctcccagattaatgcataaagccaaggaactaccccgctccctgcgctatagggtcactttaagctctggggaaaaaggagaaagtgagaggagagttctctgcatcctccctccttgcttgtcacccagttgcctttaaaccaaattctaaccagcctatccccaggtagggggacgttggttatattctgttagagggggacggtcgtattttcctccctacccgccaagtcatcctttctactgcttttgaggccctccctcagctctctgtgggtaggggttacaattcacattccttattctgagaatttggccccagctgtttgcctttgactccctgacctccagagccagggttgtgccttattgtcccatctgtgggcctcattctgccaaagctggaccaaggctaacctttctaagctccctaacttgggccagaaaccaaagctgagcttttaactttctccctctatgacacaaatgaattgagggtaggaggagggtgcacataacccttaccctacctctgccaaaaagtgggggctgtactggggactgctcggatgatctttcttagtgctacttctttcagctgtccctgtagcgacaggtctaagatctgactgcctcctcctttctctggcctcttcccccttccctcttctcttcagctaggctagctggtttggagtagaatggcaactaattctaatttttatttattaaatatttggggttttggttttaaagccagaattacggctagcacctagcatttcagcagagggaccattttagaccaaaatgtactgttaatgggttttttttaaaaattaaaagattaaataaaaaatattaaataaaacatggcaataagtgtcagactattaggaattgagaagggggatcaactaaataaacgaagagagtctttcttatgccttccttgca

SEQ ID NO: 61507 - DNA, 4830 bp, Homo sapiens
gaggtagggttaggcgcgtgccgcgagaacagagtggacggagcgtaggagagaccgaaaaggctgggggtgggagtagcggatttgaagcacttgttggcctacagaggtgtggcaagcagagcacctcagaactcaggcgtactgcccgccgcccgagccctgcgagggccgatagcgagggtgtggcccttatctgcacccagcagagcgccggcggggtacggtcttaggacctcgatctccttctccctcattttctctcatccctacctattgtgggtgagtcctggcccctggacggggacctcgctgttccaccagcccatccgtgcacacttagtttcccctaaagcagtgagtggccgggatagaactcaaaaccggcggggcttctggagcgcaggttgtccccggtctgcctgtccatatcgccccctttcccccaggtttccgcatgggccggaccgtggtcgtgctgggcggaggcatcagcggcttggccgccagttaccacctgagccgggccccctgcccccctaaggtgagtgctccacttgtgccagagggagcttcatttaatgctcttcccatttccatcaaaagctagatggatcctggccctctgaatatgcctcttcccctcccctcctgacctctcgccggcggctacaggcggtgctgcagtgtctctccctcttgtcgccaggtggtcctagtggagagcagtgagcgtctgggaggctggattcgctccgttcgaggccctaatggtgctatctttgagcttggacctcggggaattaggccagcgggagccctaggggcccggaccttgctcctggtgagaggcttgtgggatgtctaggagaggttgtggagggggcttccattggggaatagagtttaggggaggaagtatgtttggtgggtcagatcttcccttagtttctcctcttctgagggcatgtggagagcaggtttctgagcttggcttggattcagaagtgctgcctgtccggggagaccacccagctgcccagaacaggttcctctacgtgggcggtgccctgcatgccctacccactggcctcaggtaacaccagcacctccgctccttttactgtgccctcatcctcatatgccttccatttctttcttcttttctttttttttttttttttttttttttttgagacggagtatcgctctcgcccaggatggagtgcaatggcgcgatcttggctcactgcaacttccgcctttcgggttcaagcgattctcctgcctcagcctcccgagtagctgggactacaggtgcctaccaccacgtctggctagtttttgtatttttagtagagatggggtttcaccatattggccaggctggtcttgaactcctgaccttgtgatccgcccgcctcggcctgccaaagtgctgggattacaggcgtgagccaccacgcccgacctgccttccatttcttcatctccctgtcagccttcccagcaaaaggaagccaaatgagtggaaatgaccccagcgcctggagctggggaggtatgtcaggagcttccccctcactatgcctttctccatgcagggggctactccgcccttcaccccccttctccaaacctctgttttgggctgggctgagggagctgaccaagccccggggcaaagagcctgatgagactgtgcacagttttgcccagcgccgccttggacctgaggtgacacttgcccagaggccccaaacctcttccctcctaaaccagctgcagagctccctgttcaaatctaccacctaggggctcttctgtatcatttggggatgccctcttctcttcataccccaccccctcataattcccaaaactcattattgggagtgaaggccttcatttccatccgtcacagtgggaatgtcccccaacccaaaccctatcccaccctcattccctaccaaataggggctgtggaaatcagtcagtgtagattattttttcgctccttagtcctagtctcacccttaaggtggcgtctctagccatggacagtctctgccgtggagtgtttgcaggcaacagccgtgagctcagcatcaggtcctgctttcccagtctcttccaagctgagcaaacccatcgttccatattactgggcctgctgctgggggcaggtgaggggggattgattcagagggtgaaaatattaagtactgccaaagtgagggagtggggacaaggggtgctattcaatgattctttttttcttttttgagacggagtcttgctctgctgcctaggctggagtgcagtggtgcaatctcagatcggctcgctgcaacctccgcctcccagattcaagcaattctcctgcctcagcctcttaagtagctgggattacaaacatgtgccaccactcccagctaatctttgtatttttttgtagagatgcagtttcactatgttggccaggctggtctcaaactcctgacctcaagtgatccacccgcctcggcctcctaaagtgctgggattacaggtgtgagccactgcatccagcctcaatgattcttctttgcttcctctgcagggcggaccccacagccagactcagcactcattcgccaggccttggctgagcgctggagccagtggtcacttcgtggaggtctagagatgttgcctcaggcccttgaaacccacctgactagtaggggggtcagtgttctcagaggccagccggtctgtgggctcagcctccaggcagaagggcgctggaaggtaggggaacccctggagtgtaatgaacctgtcagtgtttccatctttatccaagtggcttaactaggccagggccgataggactggagttcctcattgtttttgtgccttagaagctacttagacatgggctaccccagaatcctaggccctatttgtgaaccttcctcaaagagcctatgcaagtctgtggatagaagtagtacttataagtggcttagagataggggaaagaacccagcttcactgaacatttcagaacagccacactggcctgtctggtccacttcctggagtacacagaggaatgattttttgtgaagtctacatagtcacccaatctcttcatcctgggtcagtacacagtctccccggccacatgggtgcctgggaaactgagagtgaggcaccagaagtctcttttcactcatcaaattctcattttctgggtctctcaaatgttttcatgctctcaggtatctctaagggacagcagtctggaggctgaccacgttattagtgccattccagcttcaggtaatggaatagccaccttccccttccccaacccctaccagtgagaagcaaaagctataccttcctgggtcagcaggaccacaccatgcccctgaactggtcatctctatgggagtctaatcccaaagaggactgacaactgtaatgggaatgccttctgagtcaggcctctgcctgatctctagtgctcagtgagctgctccctgctgaggctgcccctctggctcgtgccctgagtgccatcactgcagtgtctgtagctgtggtgaatctgcagtaccaaggagcccatctgcctgtccaggtatgataaagggacggagaggctgggcatggtggctcacacctgtaatcccagcattttgggaggccgaggtgggcagataacaaggtcaggagttcgagaccagcctggccaacatggtgaaaccccatctctacgaaaaatacaaaaattagccaggtgtggtggcttgcacctgtaatctcagctactcgggaggctaaggcaggagaatcgcttgaacccaggaggtggaggttgcagtgagctgagatctcgccattacactccagcctgggtgacagagtgagactctgtcccccccacccccccaaaaaaatgggaaggagagacagcctcagctagagccctttccttctgacgcatgaatgtccttctctccagggatttggacatttggtgccatcttcagaagatccaggagtcctgggaatcgtgtatgactcagttgctttccctgagcaggacgggagcccccctggcctcagagtgactgtgaggaggaggaaactttgcctagtggcatttccagagggctcctctgtgctccattgtaggcaaggccagactgatcagtgctatattccctccttaggtgatgctgggaggttcctggttacagacactggaggctagtggctgtgtcttatctcaggagctgtttcaacagcgggcccaggaagcagctgctacacaattaggactgaaggagatgccgagccactgcttggtccatctacacaaggtaagttgggataaacttccctcagctctccactgaaggccttgaagacagagactggaacatttgtcactgtatgtcagccaaggcctaggacatcaataataaacttttccctgcatcctctcctctcttctcagaactgcattccccagtatacactaggtcactggcaaaaactaggtaagttgggaaaacagctgggctgaggagggccaaggacatcagacccccagctaaaacattcctttcatcctttccttccagagtcagctaggcaattcctgactgctcacaggttgcccctgactctggctggagcctcctatgagggagttgctgttaatgactgtatagagagtgggcgccaggcagcagtcagtgtcctgggcacagaacctaacagctgatccccaactctcattcatgaaaataaaaattgctggagcttggc

SEQ ID NO: 61508 - DNA, 224161 bp, Homo sapiens
aggcgggcggcactgcgcctaagctgggccacaaccgccagtcagggctctccccttcccctccctccccccctcctcctcctcctctgccgcccagagcgagacaccaacatggagcccgaggatctgccatggccgggcgagctggaggaggaggaggaggaggaggaggaggaggaggaggaagaggaggaggctgcagcggcggcggcggcgaacgtggacgacgtagtggtcgtggaggaggtggaggaagaggcggggcgggagttggactccgactctcactacgggccccagcatctggaaagtatagacgacgaggaggacgaggaggccaaggcctggctgcaggcgcaccccggcaggattttgcctccgctgtcgcccccgcagcaccgctactcggagggcgagcggacctccctggagaaggtgaggcgggccggggaggggtgtggagccgcggcgagttgggggtggaggctgggccccgagcgctccgcccgcccgcaggtcacgccgcctgacggagaaaacgcgcgcagctgaggctagtaggcggcccagactccagcccaggtgccggccggctgctccgcgtctcccaggctttgtggcaaagacttctcgtttcctccccctcggtgggtcctgggccttttgaactcccgtagacgttcaggggagcctgcattccccgtgagaaacgctgagagaggaccacgggtgtgtcgagccttgaaggagggaaaaggcggtgtaggaccggagcgagtggttgcctggggagcatcttgttggggagacagtgaacagatgagcttgactgaattgcaggactcccctgagggagtaatgtggataatgtacaccgcgcgatcacttagtctggagaggctccccgcgggttttcctcccctggaccatcatttgtagcaataaaggggttccccagccgataggaggggcttggaatgcaggaggcttgtgatgcggctccaaacagtctgcaaaactacaaagcacagataatacacaatggagaaagccgatttcatggtagacccccgaagatcattttgaaaataactctccatttaatttgctgcccttacccccctttttttaacttactgcttttcgaggagcaagacctgccctgctcagtacagtagccactggccacgtgtggctttttacatcttaaagagaaaactattatagttttgagtaagagttaaaaataaattaaatgaaaaattccatgcgtctgttcttaccggttttcaagtgctcagcagccacactaggctagtggctaccatgttggacagagcagataatggaacagttccatcatcacagacagtgaaggtgtagagttttgtcactaatgagcagtagttgttgttttgtctggtgaatattccagggggtacttaattcattgaacatgtattattagaattcaccatgtgccacacattgtgctgggtgctaaggaaagcttggtgaacccaaacatttttggtctctgccttccttgtgttcatggtctagacagggaggcagacagatttcagatgatcacataaagtgaaactaatatatgtgctaatattctatgaaagcataaagtaagataatctggccttgtcagtgaagttgggaaagccttcttgaggaggttatgatagagctgatatctgaagacagtttaaggttaatcaggcaaaggggagggaaagagccgtctagctgagggaaaaacacatgaaaaggtactgttgatgagagagagcatggcattttccaggacccagaagccaacgtggtttgagcacagactgcaaggctttgtgtgctatgccaaggatttaggggctttatctctggagctttggggagttgaagaaaatatttgaaacgaggggatgtatgataagttaggtgtttcagaaaggtcaggtgtatagcagagtgtggaacagctgtgatagcaaggtgggatggggagcagtagccataggtcaagggcataaattaggagaccattgcagcattgcccggcaaaagatgatgaaagtttggaatagggaagtgttggtggatacagggaaaagtggactgatttgagagatatttaagaggcaaaatcatcatacttaataacggatgggatgtgaaaggtgaagtagccaggtgttaggttattgtttgaatggttgtgccaatattaagatatggccagatttatggtggaggtggtggctgtgagtgggtggtggaattggttgggtgagtcttaagattatgagtttggttttgaagattgaaggagaaggctgggctagagatttcaagttgtaagtcatttacatagagaccataattaaagccacacttgttgactaggtcttctaacttttattttgtcctgtgacttcttgcttgaataactattaatattcaaactttatcttgaagcctagaggaggagttttttaaacaaaattttaatttaattttagatttgggggtacatatgcacgtaattaacatggatatattgcataatggtgaggtttgggcttctagtgaacctctcacccaaataatatacctttgtacgtgatagtgtaacattgtacttgataggtaatttttcagcccttctctcctccttctggagcccccagtgtctgtttatttccatctttatgtctgtgggtacttattgtacccatttatctttatgcctctgtgtacccattgtacccacttgtcttaccagtgagagcatgtggtatttgattttctgtttctgaattgtttcacttgataaatagcctccaggctccatccatgttgctgcaaaggacaggatttcattctgtttatagctgcataatattccacaatgtatattaatacatactacattttctttacccattcagttgttgatggacacttaggttgatttcatgactttgctattgtgaacggtgctgtgataaacatatgagcacagatttttttctttttttttaatggcgtctagctggtgtagaacacctgggctcaagtgatactccgccttggcttcccaaagtgctgggattacaggtgtgagccagtgtgcctggctcagatgtctttttgatgaaatgatttaatttcctttggagagatacccagtagtaggattgctgggtcaaatggtagttctgttttgagttcttcaagaaatctccatactgctttccataggagttgaacaatttacattcccaacaacagtgtatacgtgttcccttttcttctcatccttgccaacatctgttttttgactttttaataatagccattctgactggtgtgagatggtatctcattgtgattttaatttgcatttctctgatgcttagtgatgttgagcattttttcatgttttttggccgctcgtatgtcttcttttgagaagtgtctgttcagtcttttgcccgctttttagtggggttatttgttttttcttcctgttgatttgtttgagttccttatagatgctggatattagtcctttgtcagatgcatagtttgcagatattttctcccatcctgtaggttgtctgtttactctgttggtagtttattttgctgtgcaggagctcttctagtttaattaagttccatttgtctgtttttatttttgttgcatttgcttttgaggtcttaatcataaacttttttcctaagtattctttaggattattataatttcgggccttacatttaaatctttaatctatcttgagttaatctttgcatatggtgagagatagggacccagaggaggaatttttaagctaaccctcttttactacagccaatgtgagaaaattattttcctgtttaataatgaactatcttttttttcccccgccgagatgaagtcttgctctgttgcccaggctggagtgcagtgtcacgatcttggttcactgcaacctctgcctcctgggttcaagcaattctcctgcctcagcctcccgagtagctgggattacaggtatccaccaccacgcctggctaatttttgtagttttagtagagatggggtttcaccatgttggccaggctggtcttgaactcctgacctgtgatctgcctgcctcagcctcccaaagtgttgggattagaggcatgagccaccgcgcccggcctctaatcgtgaactatctatgggtaatagaaaatcttacttctgagagcccagagtattttttcctccccacagttttttctttcccctgagaaaaattagatattttcttatttacctgagagaatatatgataatatatagaatatatagatgattttctgtattaaaggtagatttacaatgatacaaggagtgttcagataatttttcctttagttcactggcatattgaaacttactggcataggttggaaagtgtttaaggaaaaaatgcttagtatgtttcttgctagaaatttatgaactatgaaattcttagatgtgttgtataacatctaatgctgcgtatttagaggatgagatcaaataataggaaacattaatttcatccagtttactctcaagttaaatgacaaaattgtgttattcaatttactctcatatctcactagataataagggagttatagtggtgttatataaggcagtgattaagtttgtagtcctgttactaaggctgagttaaactatgatactgtttaaatttgaagcaaaatatgaccagtcttataactaagtctttttaagagggaagtgagtgattcagagccttatgttgtttttatgctggtcctacagaccattcaggcacttcttgtaattccttaacctgaatttctgagttgtgctggggaagataattcagttctctgggttggcatcactagaaattcttggtctccaacttttaattgggtcatcaacagtgcttggaaatcttttttttttttctttttaagatggagtctctcgcttttgtcaccaggctggagtggcagtggcccgatcttggctaactgcaacctccgcctcccgggttcaagtgattctcctgcctcagcctccgcagtagctgggactacagatgcgcgccaccatgcccagctaatttttgtatttttagtagagatggggtttcaccatgttggccaggatggtcttgatctcttgacctcaggttatccacccgcctcggcctcccaaagtgctggcattacagatgtgatgagccactgcgcccggcccaacagtgtttggaaatctttagtttcctctctgtcagcttctttccccatcttccctcttaacttctgtctcccacccagagttcaacatccccccataagcaggttacagtttcaaagaagagaacacaggctgaacctctcccgtttctgctccccatctccaaatttatctacagtgcacaatttatttttttaacctattcatatacgttttattctttttttttttttttttgagacggagtctcgctctgtcacccaggctggagtgcagtggcgcaatctcggctcactgcaaactcagcctcccgagttcatgccattctcctgcctcagcctcccgagtagctgcgactacaggcgcccgccaccacgcccggctattattttgtatttttagtagagacggggtttcaccgtgttagccaggatggtctccatctcctgacctcgtgatacacccgcctcggcctcccaaagtgctgggattacaggcttgagccaccgtgcctggccttgtatacgttttattcttaatattaatcctgttttgtgttcctagggtaaaaactatttagtcgtagtgtgcttttctcttgaggaactgctagattttatttgcagatatttgataatggttttaaatgtttttctgtttgttttttgttttcttggccagtatttatcaaacttgacatcaatattatgccattttcataaaaggtacttggatgatttttgtttttctggaacagtgtaagtacaaaggaatttttctttcttgtatgtttgaaagatatcaccatttaaactatctctgtattcctttcagggttgtagtctatatatgttctcctttcttgggttaattttggtggttttcctaggaaatcattcttttcagtaagggtttctagttaattttaatggagtgctacacagtattctttattttttcatttgcctctgtggttattttcacttctcattcccaattttgtgtaattatgctttatttttctcctgatttgactaggtaggggtttatttaatttatttttcattcaaggacacagctcttgatttaagtttctgttgctgtttattttttaattattaaaaattattaattttaataataagttcagttttcatcttttactatttccttaggtttactttgatgtgtgtgtgtgtgtgtgtgtgtgtgtgtgtgtgtgtatttccttgtgttgagtgcttaattgacttacttaaaaacattttaatagcttttttgagatatcattcatatactgtacaattcacctttaatttaaagtgcacaattcagtcattttctgtatattcatagatatgtgccatcatgatcacggtcaattttagaacattttatcacttctaaaagaaaccccatacactttagctgatatcccccgtcttccattccccatatgcaactattaatctaccttctgtctatagatttacctattttgggcatttcatataaatggaatgatatgtgtttttgtgactgggcttctttcacttagcttaatggtttcaggattcacctgtgatgtggcatgtatcagtacttcattactttatatggctgaataatattttattatatggatatgtgatattttgtatatccattcatcagttgatggacatgttttttttcctcctttttggctattatgtataatgctaccgtagacattcttatataagtgtatgtgtggacatatggattcatttctcttggatgtatatctaggagtagaatttttgggacatatggaattctgttaaccttttaagtttctgccagattgttttccaaagtggccttcctattagcagtgtatgagagttccagtttctccacatccttatcagcacttgttattacctgacttttttgtagttttgatttgcatttcccttatggttcatgcatctattcatgtgcttcttggccatttgtgtgtcttctttggagaaatatctattcaggtcaaacttttgcccattctttaattgggttatttgtctatttactattggattgtaagaattctttatatatatgcatattacatatataatcccttatcaatcaagggattgacaagatacagtcccttgacaaatgtgaggtcatgaggacctactatgttttctttgagattttatagtattgctattacatgtaggtctttgatccattttgagttaatttttgtatacgatatgaagaaagggttcaaactttattctttcgtatgtgactatccagcactgtttttttttttaaattttattgatttgtgtaaatttatagagttcaagtataattttgttacattgatatattgcatagcggtaaagtcagggcttttagtgtatccatcactggagtagcctacgttgtactcattaagtaatttctcttcatccaccccactctcacactccccacccttccaagattccactctctgtcattccatactctgcttccacatgtacttgttgtttagctcccacttggaagaataggcagtttgtctttctgcagcaccatttgttaaagaggctgttcttttccccattgattggtcttagtacccttgtagaaaatcagttagccatagatatatgggtttatttctggattcccaattctatttcattgatctatatgcccaccttattccaggaaacacttttttttttttttttctgagataggtgtctctttgttgcccaggctggagtgcatgcagtggtgcaatctcggctcactgcaacctccacctcctgggctcaagtggacctcctatctcagcctaccaagtagctggaactacaggcacatgccaccatgcctggctaatttttgtaggttttgtagggatggaatctcaccatgttgcccaggctggtctcaaactcttgggctaaagccatctgcccacctcggcctctcaatgtgctgggattacaggcgtgagccaccatgcctgactaggagacactcttttgattaatattgctttatagtaagttttgaaatgggggagttctccaactttgctttcctttttcaagatattttagccattctggagccccttgcaattccatatgaattttagattagcttgtcagtttctgcaaagaagccagctagtattttgatagagattgtgatgaatctgtagatcaatttgggagtatggtcatcttgatattaaatcatctggtccttttttttgttgttgttgagatggtgtcttgcccaggctggagtgcagtggtgcaatctcagctcactgaaacctctgcctcctgggttcaagcagttctcctgcctcagcctccagtaactgggattacagatgcacaccaccatccctggtttatttttgtatttttagtggagacggggtttcaccatgttgaccaggctggtctcgaactcctgacttcaagtgatccacctgccttggcctctcaaagtgctgggattgcaggcgtgagccaccgtgcctggcctaatcatctggttcatgaacatgggatatcctttcatttatagttgtgtcaattaatgatgaggatacattctgagaaatgtttcattacagtatttcattgttgtgcaaacatcatatagtgtacgtacacaaacctagatggcatagcctactacacacctaggctatatagtctaactgtttgctcctaggctacaaacctgtacagcatgttacagtactgaatactgtaggcagttgtaacactgtggtaagtatttgtgttggatacgtttgtgtatctaacacaaatacttagaaaaggtatagtaaaaatatggtattttacatatatatgtgtatatatatatgtgtatatatatgtgtatatatatgtgtatatatatgtgtgtgtatatatatatatgtgtatatatatatatatatatttttttttttttttttttttgagacagagtctcgctctgtcaccgaggctggagtgcagtgacacaatctccgcccactgcaaccaccgcttcccaggctcaagtgattctcatgtcagcctcctgagtagctgggattacaggtgtgtgccaccatgcctggctaatttttgtatttttagtagagatggggttttgtcatgttgcctaggctggtcccgaactcctgactcaagtgatctgcccaccttggcctcccaaagtgctgggattagaggtgtgagccaccatgctgggccggtattataatcttataggaccaccattatgtatgtggtctgtagttgatggaaatgttctgatgtggcatacaactgtaattagatcttctttaaatttcaataatgttttatagttttcagaattgcactttttttcttaaattcttcaaaatactgtttttaatggtattgtcagtggaattatttttcttaattgaatgtttgggttattcgttgtagatgtttaaaaacacttgatttttatatatattaatattgtttctgaatctcttctgaacttgtttattcatcctagtagattatttgtgggttctctatgattttcttgtaaagatcatgtcaagggcaaatatatatagctttattttttctttccaatctggatgccttttatgtatttatttatggctaattgccctggctagaacctttagtaaaatattcaataggaggggtaagagtgtatatgcttttttattcctgatcttagggcaggggtgtccaatcttttggcttctctgggctacattggaagaattgtcttgggccacacataaaatacactaacaatagctgatgagctaaaaaaaattgcaaaaatataatgttttaagaaggtttacgaatttgtgttgggccacattcatggtcctcggctgtgggttggacaaacttgtcttagggagaaagcatcctgtcttttacccccgagtatgatgttagttgtgggtttttaatagatgcccttatcatattgatgaagtttctatccctaatttcttaagtgtttttaataataattttgtcaaattattaatcgatgtattacattaattgatattaggttattaaaccagccttgtgaaaataactcactttgtcacagtgtataaacattttatgtgttgcctgtcatagaaatacacacacacacacacacacacacacacacacacacgcttgtattttgtttagagttattccatctatatttgtaagatatattggtctgtagttttcttttgatgcttttgtctggtttggtatcagggtaatattgacctcataaagtgaattgaaagtattcctattggttttggaagagtttgtgaaggactggcattaattctttgaaagttcgataggttacatcaaatgggtctgagctctttttttttttttttttttttgcaggatggggcatagtattttaattactaaatcactcttttttcttcttatgggtctattcagattgtccattctttttttttttttttgagacggagtcttgctctgtcgcacaggctgggggtgcagtggcgcgatctcagctcactgcaagctccgcctcccaggttcatgccattcttctgcctcagcctcccaagtagctgggactacaggcgcctgccaccacgcctggctaattttttgtatttttagtagagacggggtttaaccgtgttagacgggatggtctcgatctcctgacctcgtgatccaccctcctcggcctcccaaagtgctaggattacaggcttgagctaccgcgcccagcctggttaggctctggtaaaatagtttgagggcaagttttctaagaagaacaaaatactctgggaatattcaaaatggttatccccaaccccctccccctaactggggggtaggtatttttctctcatcttaactgtggtaacatgctaggggttgtggagataaaacttacagaagcatggaggcccttcataagactggtttccctgcggcttttaattctcaaagttgtcgcattgcacctccagcaatttgtcaattacactagatttttcttccctagtactagttagttcccacagtggtttctgttcttgggattctgctctggtaagttgtgattctctgtgtatgtacctctccaatttttggaacaatagtttgcccttcatctcagttctctgatggatataagaagagttttgattttttagtttgttcagctttttttttttatgatggggatgggagtgattacttccaagctctttatatgcttcaccagacctctgttttggggtttttttgttttgttttgtttttgagatggtgtttcgctcttgttgcctaggctggaatgcaatggcattatcttggctcactgcaacctctgcctcccggattcaagtgattctcctgcctcagcctcctgagtagctgggtttacaggcatatgccaccacgctcagctaattatttttcttgtattcagtagagatgggatttcaccatgttaggctggtctcgatctcctgacttcaggtgatccacctgcctcggcctcccagagtgctgggattacaggcgtgcggttttgcttttaaacagactttatcttttagggcagttttaggttcacagccacattgaatgggcaatacagagttcccatctgtgccctgcccctctccatagcctccctcactgttaacatcctgaatcagagatgtgtcttttgcaaatattttcttccagtctatagcttgtctttttattcttttgacagtgtttttcacaaagcagaataagtttttaattaaatccagcttatcaattatttctttcatagattatatgcctttagtattgtatccaaaaagccatcaccaaacccaaggacatctagattttctcctatgttatcttctaggagttttatacttttgcactttgcatttaggtctttttatacttttgcactttgaattaatttttgtgtgtgaaggatgtcagatctgtttctgggttcattgttttgcatgtaaatgtccagttgttccagcaccatttgttgagaagactttctccattgtattgccttcgttttttggtcaaaaaatcaattgaatacatttatatgggtctatttctgggccttcaattctgttttattgatcaatgtgtctatttcgttgatacatgctgtctttattactgtagctttatggtaagtcttgaagttaggtagtgtcagtcctccaattcggagtcttttgcccctccatataaactttagattgaattcattgatgtgtattaaaaattgctgggattttgattgggattgcgttgatcttaatagatcaagttgggaagaactgacatcttgacaatattgagtatttcatgaagttgaaataccttctcatttatttagttctttgatttcattcatcgagttttatagttttcctcatatagatcttacatgtattaagttagatttatacctaaatattttatttcttgggttgttaatgtaaatggtattattgtacttttaacttcaaattccacttgattgctggtatacaggaagtgattgacttttatatattaacctatattctgcagttttgctagttttacttattaattccaggaaagttttgtcagttcttttggattttctttttttttgagatggagtctggcactgtcacccgggctggagtgcagtggtgtgatctcagcttactgcaacctctgcctcccgggttcaagcgattctcctgcctcagccttctgagtagctgggattacaggcgcctgccaccatgcctggctaatttttgttttttttgtatttttagtagagatggagtttcactatgttggccaggctggtctcaaactcctgaccttgtgatctgcccttctcagcctcccaaagtgctgggattacaggcgtgagccactgcgcctggcctggattttctgtatagacagacagtcatgtcatctgcaaacagagttttatttcctccttcccagactgtgtaccttttatttccttttcttgtcttattgcattagctatgacctccaatacactgttggacagtggtgagagggtgtattatgtcgtcattgtgttgctatgaagaaacacctgaggctgggtaagttacaatgaaaagaagtttaattggctcatggttctgcagagtatgagaagcttggtgccagcatctgcttctggtgagcttacaatcatggtggaaggtgaagtgggggcaggcgtctcacatggcgagagcagaagccagagagcaagggaggaggtgccactcttttaaacaaccaggtcttgtgtgaacttagagtgagcgctcacttatcactaagggaatggtgttaaactaatcatgaaggatctgcccccatgatccagtcaccttgtaccagaccccacctccaacactggggattacatttcaatatgagatttgaaagggacagatatccaaatcatatcagagagggaatccttgccttgttcttgatcttagaggcaaagcttcgagtttcattaggtatgatattagttgtaggattttttgtagatactctatgtcaagttgagaatattcccctctattcctattttaatgagaatatcgtgaagaggttgtcaaatgttttttctgcatctgttatatgatcatgtggtttttcttctaaagcttgtcaacatgatggattatattaattgtttttttttttttttttttgagacagggtctggcgttgtcacccaggctagagtgcagtgttgccatcttggctcactgcaacctctgcctccaaggctcaagccgtcctcctacttcaccctcctgagtaactgggaccacaggcatgtgccaccataccaggctaatttttgtattttttttagaggtggcagaggggggtctcactttgttgcccaggctggtctcgaactcctgagctcaagtgatctgctcaccttggcctctcaaagtgctggaattacaggtgggagccactgtgtccagccttaactgacttttgaatgttgaatcaagtttgcgtacgtgggataaacccacttgtcatgatgtacaatacttttgtacattgttaaatttgatttgctaatattttgctgagaatttttacattgatattcatgggagataatggtctgttgttttcttttttggtaatatgtttgtctggtattggcagtagggtaatacagacttcatagaatgattaagaagtattctctctgattctgtcttctgagagattttagagaactggtacaatttcctccttcagggtttggtagcattaccagtgaacctgtctgggtctggtgctttctgttttagaaggctattaatttatgattcagtgtttcgaatagatataggcctcttcattttgtctatttttgtgtcagatttgacagattatcttttttaagaaatcgttcattttatctaggctatcaaatttgtgggcatagagttgtttatagtgttcctttattatccttttaatgtccatgagatctgttgtgatgtcctctctttcttttttcttttttttgagacagagtcttgctgtgtcaccgaggcaggagtgcaatggcgcagtctccctcactgcaacctctgcctcctgggttcaagcgattcttgtgcctcagccacctgagtagctgggattataggtgtgtgccactatgcccggctaatttttgcatttttagtagatttagggtttcgccactttggccaggctggtctcaaactcctggcctcaagtgatctgcccaccctggccttccaaagtgctgggataacaagagtgagctaccatacctggcctcatttttgatgttcataatttgcatcctttatcttattttattagcctggccagaggtttattgattttattgatcttttcaaaagaaccagcatttaagcttttactgattttctctctttatttgctattctcaatttcattgatttctgctctactttttatttattttcttctcctcactttaaatatgatttattcttctttttctagtttcctaagttggaagctttgataattgatttcagatttttttcctaatatatacattcggtgttataaatttcccagtaagcactacttttgctgcatcacaaattttgataagttgtattcttactttcatttagttgaaatatttttaaatttcttttgagagtttttatttgacccacatgctatttagaaatacactgtttaacctcttaagtatgttgggattttccagctatttttctgttattgatttctagtttattttttcctttattgtatatatttatacatcatgatgttttgatatacatatacctagtgaaatggttgccatagtcaagcaaattaacatattcgtgatctcacatagttactgcctttttttttttgtggcaagagcttctaaaatccttttagcaagaatcctaaatataatacaatattattaactatagtacttatattttacgttgaattgctaaacttgctgatccatcatacctgcaactttgaatcctctgacctgcatctccccatttcctcccctgttcctcacttctacttctttgtacttgactttaaaaaatagatttcatatgtaagtgagatcatgcagtatttttctatcttccaggtttattcatgtgacaaatggcaggatcaccttcctttttaaggttgaataatattcctcccccttcccctcctcgtgtgtatgtgtgtgtgtgttatgtgtgtgtgtgtgtgagtgtgagtgtatgtgtgtgtgtcttgtagtttattcattcatcaatggatgctgtagttgtgttcgtggctattgtgataatgctgcagtgaacatgggagtgcaggtatctgtatgaggtggtggtttcattttctttaggtttttacccagaaatggaattgctaggtcatacaagaaaagtagtccttttctttcttttctttctttctctctctctttttttttttttttttttttaagacagaatctcgctctgttgctcaggctggagtacagcggtgtgttctcaactcactgcaacctccgcctcccgagttcaagcgattcttgtgtctcagcctcctgagtagctggggttacaggtgtgcactaccctgcctggttaatttttgtatttttaatagaggcggggtttcgtcatgttggccaagctggtctcaaactcctaacctcagtgatcctcccaccgtgtttggattacaggcacgagccaccgcgcccagtcgtagttctatttttaattactttagaaaactttatactgttttccgcaattgctgcactggtttacattgccaccagcagtgtacaagggttctcttttttccacacccttgccaacacttatctcttgaatctttttgttttttaaataatagccatcctaacaagtgtgagatgatatttcattttggttttaatttgcatttccctgatgatagtaatattgaatatcttttcatatgctgattggccatttttcttttctttttttctgttttggagaaatgtttgttcaggtccgttgcccattctaaaattaggttgtttgtttttcttctactgagttgcacaagttctttatatattgtggaaactgactccttatcagatatatggtttgcagatattttctcatctgtagtagactgtcttctcattttgttgattgtttacttagatgtgaaactctttagcttgatttagttctatttatttatttttgcttttgtagcctgagcttttgttgtgatatccaaaacaacattgccaagacaagtgtcaaggagtttttcccatatattttcttctaggtttatggttttaagtcttcatgttgagttctttaatcaactttgagttgatttttgctggtggtgtaagataaaggtccaatttcattcttttgcatgaggaaatttaattttctcagcaccattatttgaagagatcttctattccctattgtgtcttcttggtgcccttgtcaaaaattagcgaatcatatatgcttgggtttatttttctctctctattctgttccattggtttacatgtctactttttatgccagtaccacactgtttgggttactataactttgtaatataatttgaaaccaggaagtgtgcttcctccaactttgtttttgtcttacagaattactttggctctttagagtcttttgtggttctatatgaattttagatttttttttctatttttgtgaaaaatgccattggcattttcataaggattgtgttgactttgtattgctttggatagtacatacattttaacaatattaattatttcagtctgtgaacatggaatatctttctatttatttgtgtccttaatttctttcattagtattgtagttttcagtagacagatcttttgccttcttggttacatttatttctaagtctttttattttgttttttgatgctatcataagtgggatggttttcttgatttctttttcatataagtagttatttgtgtacagaagtgcaactgattttcatatattgattttgtatcctgcggctttactgggtttattcttttttctttttgagacagagtctcactctgttgcccagggtggagtgcagtggctcgatccctgctcactgcaacctccacctcctgggttcaagtgattctcctgcctcagcttcgcaaatagctaggactacaggcgcgctgccacacctggctaatgtttacatttttagcagagatggggtttcaccattgctggtcagggtggtctcaaactcctgacctcaagtgatccacccgccttggcctcccaaagtgctgggattacaggtgtgagccactgtgcctggcctattcattctaacagtgtcgattttagtctttgggggttttcagtatataggactttttcctttcaatttatatttctttttcttgcctaatcgctttagtaggatttccagtgctatgttgagtagaagggtgagagcaagcatctttgtcttgcttctgatcttagaggaaatgttttcagtttttcaccattgagtatgatatgagctgtgggacatacagcttttattatgttgaggtagttttcttctgtttatagtctgttgactttttttttttttaaataatgaaagggtgttgaattttgtgaagtgctatttcggtttcatttgagatgatcatgtggtttttgtccttccattaatgtggtgtattacattgatcaatttttgtatgttgaaccatccttgtattccacgaattccacttggtcatggtgtgtaatccttttaacgtactgctgaattcttattggtaatattttgttgaggatttttacatcaatagtcgtcggggatactggtttatagtcttctaatgtctttgtctgactttggtatcaggataatgctggcctcatagaatgatttggaatgttccctcctgtgcaattttttgggattgtttcaggaggattggtgttaattcttctttaaatgtatggtagaattctccagtgaagctttcttgtcctggaccttttttttttttttttttttttttttttttgagacagggtcttactttgtcacccaggctggagtgcagtggtgcaatctcagctcactgcaacctctgccctccaggctcaagcagtcctcctacctcagcctcccaagtaactgttaccacaggcaagcaccaccatgtccagctattttcgttgtatttttagtagagacaggatctcaccatgttgcccaggctggtctctaactcctgagctcaagcatttctcctgccttggcctcccaaagtactgggattacaggtgtgagccactgcgcctggccatgggcttttcttttgtgggaggttttggattattgattcaatttccttgttgttggtctgttgagattttcttattttttcatgttactcagtcttggtaggctgtgtgtttctaggaattgatctgtttcttctaggctgtccaattagttggagtacagttgttcatagtattctcctatgatcctttttatttctatggcattggttgtcatgtcccctctttcatttctgaatttagttatttgaggcctttttttttctcagtcagtctagctaaaggtttgtcagttttgtttatattttcaaataactattggttttcttgatttttttcctactgtttttctattctcttttctttatctttgctctaatcttattttttccttctgatcactttgggtttagtttctttttctagttcttcaaggtgtaatgttagattattgacatgaatttttttttttaaatataggcatttacgactgtagattaccttcttagtcctacttttgctacattcaataagctttggtattttgtgctttaatttttgtcttaatgtattatttcctttgttacttctgtcgtgacccattgtctttttaagagtttgttgtttaatttctataaatttcttgattttccacttttctttctgcagctaccttctagtttcattctgttgtgatcagaaaagatacctaatactttgtggccaacatgtggtgtatcctggggaatgtttcacgtgcacttgagaagaatgtatattgtgctgttgttgggtggagtgttctgtatatgtatgttaggtccaattggtctgtagtgctgttcaggtcttttctttccttattgatctcattctatccatcatggaaagttggttattgaagtctctcactgtttttggagagctcccttcaattttatcaatgtttgctttaagtatttaggagctccaatgtctgacacatatataattattatatcttatttgtgcattgaccccatagtgttctcctttgtctatggtatcagttttgtttaaaaatgtattttctctgatattagtgttgccgctattgctctcttttggttaccatttgcatggaatatctttttgaatctttttacttagagcctgtgtgtgtccttagttccaaagtgtcttttaaacagcatatagttgggtcctgttttttaatcctatgggtttttttttttttttttggtaatttctttgtcctttcatagcttgtttttcatttcctccccttctttctttgtgtttagtcaatttttttggtagggatatattttgattctcttatttccttttgtgtatattctgtagctattttcattgtagttaccatgagaatatcataaaactccttaggaggataacaacctgtttaaactagtaacaacttcacttcaatcacatataaaaactctagtcctttatagctttgccccccaacctccacctcccgggttcaagtggttctcctgtcttagtctcccaagtagctgggactacaggcacaggccaccatgcctgactaatgtttacatttttagcagagatggggtttcgccattgttggccaggctggtctcaaactcctgacctcaagtgatccacttgccttgcctcccaaagtgctggattacaggcatgagccaccgcacctggccaaagttattagtaccctgttaacaacattttactggtgtcacaagtaacatgtttatatattgtttaaccattaacatactttcttagtttgttttctcttgcttataacaatacttgaaactgggtagtttattttaaaaagttatggaggctgagaaatccaaggtcaagggtgagggcctgatgagggccttcttgctgatggggactctgcagaatcctgaggtggtgcagggcacatggtgagggggttgggcatgctagctcaggtctctcttcctcttcttataaagctaccagtccactctcatgataagccattaatccattaatccatcaagtcattaagccgttcagatctgccctcatgattaattcattcatgagagcccagatccctgatgacccagtcacctctgaaaggttctacctctcagtactgccacattgcggattaagttttaacatgagttttagaggggacagatactcaaatcatagcatgtagatttatagttaatttttatgcttttgtcttttaaatcctataaaagaattaaggtggagttactcaccagaattaaaataatgtttttatatttgtccatatatttacctttaccagagaactttatattttcctatggcttaaagttactatctagcatcctttaatttcagcttgaaggactgccattagcatttcttccaggtgaggtctagtggtaatgaactctctcagcttttgtgaatgttttaattttcccttttacaggtgcatgccatcatgcccagctaattcttgtatttttagtagagacggggttttgctatgttggccaggctggtctggaactcctgacctcaggtaatcctcctgccttggcctcccaaagtgctgggattacaggtgtgagccactgtgcaccttgtatctttctttgtctgttcgaggatctgagatactattttaaagtcctttggaagtatagtttgtaatcggatttttagtaagagggttattttttttttctctttgtgtgcattcttctctacctgctctttttgtggttgtttctgctttgtcctttatggcatcttctttagaaggaaatcttatattggaagctctgggttcttattcttcagggttattgggaaaaatctcaagaaccagtccctgaaccagtgggtggcttgaccaggtcatttttgttttattgcctgtaatctgtccatttgtgttccttcagcctttggctatggtcacaacgtttattgccttctttcactagtaggagagcgctgctccaaccccttacttcacaaaatgattctgacttttgttcccacttcttgtgctatgagttgatttcagtccctattattggggttgatttttaactgtctcaaccagtaagatttaaaaatagacaacttgcttgtttctgtttgctgcttttacctctatgggtaaaggaggttaaggaactgctgtggtttatgcaaaagtatgctgtgtcctaactgagtaaccttaaggataatagcttgtataatggttgtgaaatcaaaatgtcgtatatgtgaaagggctttataaactgggaagtatggtctaaatattagtttatttttgttgtataatcatagtgattgtgttattactctatttaagcctgcttttgattttcagattgttccattgacctgtcatgtatggcaacagatagtatatcaaggcaatagtagaacacaaatttctgatactaatgtggtctgtttggaaacaacagctcagcggggttctggggatgatcaggtatgtcttctgtaactggctaactttttttttttgataagcagcacaagaaattctgatttagctatgaagaatggaaaaataaattaatattcattaatattatgttttcttgtcttttttttttttttttttttttttttaagacagggtctcactctgtcacccaggctggagggcagtggcatgatcatagcttactgcaccctccaacttctaggatcaagtgatcctcctgcctgagcctcttgagtagctgggactacagacatataccatcaaacccacctaattatttttaaaaaattttttatagatggagtctcgctttgttgcccaggctggtcttgagctcttggcctcaaatgatccttcgccttggcctcccaaagtgctaggattacaggagtgagccaccactcttggccaaatattctatttttctaatagattgttgtaaactttatgtatatgtagaagagcagttcactttttttgaaggcgggtctcaggactcttatttttatttttagtttaaaaattttttatagagatgggagtctctgtgtttactgggctggtctctcattcctggccttaagtgatcctcttgcctcggcctcctaaaactatgagattacaggcatgagccactgtgcctgtcctcaggactctttatattcttcacaagtattcttaagagcttttgtttatgtggattatctatatagatatttagcatacaagaaattaaaacatttaaaactattttaaaatttattttgaaagaacaaacctattacatattaccataaatagtatattttaaagtaaaaaatgactgttttccaaaacaaaaaaattagttggaagaatagcattgtttaaattccggcttactagaactcagttggtatattattcagggttctccagagaaacagaaccaataggttggagatagatacatctatctatttatacacatctgtgtgtatgtgtatatatatatctttattgatatttattatatagaattggcttatgtgatcatgaagactgagaagtcccaagatctgcaagctggagccccaggagggctgatggtatagttccaattcaagtccaaaggcttgagaaccaggagcaccagtgatgtaagttttgatctgaatctgcaggtagaataccctccagctggaagaccatcaggcagagagaacacattctctcttgctcagccttttgttgtatttaggccttcaaggtactggatcaggcctacccacattggagagggtaacctgctttacttagtttccagattcaaatgttaatctcattcatacacacctcacaggccaggaacagtggctaacgcctgtaatcccagcactttgggaggctgaggtgggtggatcacctgaggtcaggagttcaagaccagcctggccaacatagtgaaacactgtctctactaaaaatacaaaaattagccaggcgtggtggtgcacacctgtaattgcagctacttgggaggctgaggcaagagaatcgcttgaacccaggaggtggaggttgcagtgagctgaggttgcgccactgcactccatcctgggcgatggagcaagacttgtctcaaaaaaaagcaaaaaaacccaagaaaacaaaacaaaaaataccacacacatacacacacctcacagacgtatccaaaattgtgtttaaccaagtatctggacactccatgatccagtcattttgatacataaattacctatcatagctggattctcagtctgctctgcatttcatttgttgggatgtattgttttggttgaagtatatgaagacaatcttgccttacatagatgaaaaaggagttagggaaaggaggctgtcattcagtccctgaaagggtgtcagtgaccctcagggatttttggactacactttgagaaccacttttctagaacatagttataaactttgaagaaatgaaacgatcatgagcagataggaaaaaagctcatgtagagttattggaggaaaaatgttattagtgttactaataatggttaaatatttaaggttgattaataacttgagtatcagatttctcctattaccttcagttttctttaaattgcagtgattacctgttagatgcaagatatggaggaagggagatacactatcactgaggcaaagtagttaagacaatccctgaccataaaaaacatagtacctggggccattaaatggaagaggattgttttgggtcgaattgtgccctcccaaattatatgttgcagtcctaatccccaatacctcagaatgtgaccttattggtgattgcaggtgtaattatttaagctcacactggagtagggtttgctcttaatccaatctaactggtgtccttatgaaagaggaaagcaccatgtgaggagaaaaacatacaaggagaagatggccgtgtgaagatggaggcagaaattggaattatgctgccacatccagggaatgcctggggcttccagaaggtagaagtagcaaggaaggaccctcccctaggggcttcagagggagcatgaccctgccaacaccttgatttcagacttctggcctccagaactgcgagataataaatttctgttgttttaagccacttagtttgtgtcactttgttatagcagccctaggaaactaataccgggtcatatttctaaataatattctctgagggcatatttttggtagagcacagtccaaaaattgatgtcttcctttttttcctgtttcacacaatacgaaccatgatggaccctaaagcacttcatttcatcctttacgcctgggttcgtcagaatagctggaatattatgccgctttctagttcacttccttcttattctttcgtcgttcatctttgttactgtcatctgagttacctttatttattcatggaaaactagctcttgctacattgtcttcctctcttttattggtttctttcacttcagcatacatttcccattcagtgcctgaagttctcatatatttcatctaatctccagtgatctttacttccgtacctccttccagtcttctcctacctgtatgtagttactcatcccatgatcacagtctatctagactttgtcatcaccagctactttactacaaatgtctcgtcctctcttcccttccggctactgcttcggtcaatattctgctccctgttacagtgaaattttcaagagttgtctatacattttctgtttctgtttcctgatatcctatgctcatttttaaaaagtcaggtttattgtaggtataggttaaacatatcaaaatttactctcttaggtgtacagtttgtcaagtgagctttgacatacgtatacagtcatgcagtcaccaccacatttgagatagacagcactgccttcacaaaaaggaacgtcacaaaaagttcctgtgtgcccctttgtagtcagtcacttccccaactcctagtccctggcaactacttatccaatttctttctctttagttttaccttttcagaataatacggtgtgtagacttttgaatttgacttctttcacttggcttagcttttgagatttatccatgttgttgcatgtatcaataatttgtccactttaatttttattactgagtagtattccatttgtgtgtaggtttttcggtagacatactgcttcatttctcttggcaaatacctaggaatggctggacgtggtggctcacgcctgtaatcccagcactttgggaggccgaagtgggtggatcacttgaggtcaggagtttgagaccagcctggccaatatggtgtagtagaaaccccgtctctactaaaaatataaaaattagccaggtgtggtggcacatgtctgtaatcccagctactcgggaggctgaggcaggagaatcgcttgaacctgggaggcagaggttgcagtgagtcaggatggcgccagtgcactctggcctgggtgacagaatgagactctgtctcaaaaacaaaaaacaaaaaacaaaaccctaggaatgggtttgttgagtgataaggtaattgtatgtttaactttataagaaagtaccaaactgtttttccaaagtggctgtaccattttgtatcccagtagtatatgagagttctgattgccctgcattcttggcagctgttggtatcatcagttttttctttttttcttttttttttttaattttagacaccctaggagatgtattattggtgtctcactgtgattttaacattcatttctctaatgactaatgatatatagcatctttttgtgtgcttatttgccctccatgtttcttcttcagtgagagatctgttaaaatctctgcctgattttttgtggctggtttgtttcattttttgagctttgggagttcttcatagctctagatgcaagtcctttatcagttgtttcttttgcagagacagtctgtggcatgtttttgtattctcctgtctttgaaaggcagaagttttaattttgatgaaacttgtttattgattttttttccttttttggtttatatttcttgtgtactatctgagaaatcttggcctaatcctatgtcactgagatttttcttctatgttttcttctagaccagggtttctcagccttggcactattgacattttgggttgaataattcttcatagtgggggtctgtcctgtgtgtcctaaaatgtttaacagcattcctggcctcttcccactagataccagtaatagtcccccaatttgtaaccatccggaatgctttctgacattgccaaatgttccatggttgaagggagaggcgtgtcaaaatctctcccaactgagaaccgctttttcagaagttttgtagttttacgttttacatttatgtctaagatccattttgagttggtttttgtatatggtgtgaaggaagcatccaagctgtattttcttacatatgaatatgtaattgttattctagcaccatttgctatctttttttccagtggatttcatgacatctttgtaaaaaaattaattgaccttgtatatgtgggtctatttctgcacactattccattgatttacatatgtatcctcatgccaatattacactcttaataactgtactgtcttaaaatcaggttgtgtgatttttcccactttgttcctctttttaaaaattgattatttcagattcttggaatttctatataaattttagaattagctcgcccaatttatattttaaaagcctgctggaattttttattaagatttcattgagtctataaatcaatttgaaaataattttgacatcttaacaatattgagttttctaatccataaacatgacagttctcttagtttattatttctctttaatgtcttcatcaatgttttgctgtcttcagtgtgccaatcttacacgttttgttagacttactggtatttttagaaatttctatttcctattattcattataagtgtatagaaatataattgactttttatattgaccttgtgtcctattaccttgctaatctcacttactagttttagtagcttttttaaaaaaatatttcctttaggactttatatgcagagttatattaactatgctttgttttttacttttaaatagatatgtcatttctttttttccgtttttttttttttttgttttttttttgctttattacactggctaggatctgcctattcttctacttgatctactttgtgttctgaccccaattctttgaaaggaagtatcaccagcaatatttatgtagctgaatacagtgaatacttttctgtcctcctcttaggtacgataaatagcatttgacactattattaatcattacataacttctttaaattatttcctttcttgggttcttctggttttttttctactcatctggctgttctctctcagtatcctttgctgctttatcttcctttgttaaaccttagaatcagaatttgtaagctgtggacccaagtatgactcaaatgtggttttcaaaaaccattttttttggcataatgttttaacacttttgaaatagaatactttaaagtgaacatgcatagttagccacaaatcccattactctccaattccaggttggattacttcatttgtcttacccccatacccctatacacatttagttttcaacctctgcttgaaacgctggaatgttcgcggtctcatccagatccaggactttaaatacatctgtatactgataaatcccaaagatgtatctcaaactttttttctccctcaaaatttgtttgtatttgtcagaatgcttatatgttgtccctccccacatctgtcaaaaatatttagagatttgttggcctttttatattgatttaaaaggtataacacaaagaatatttgatgattgaaatgtatcaagaaaatacataatgcagaaagttaaaaaaggttgaacagaggttgttttaaaaattcagtttataatgggaaattataagaatatgtttgcataggagaggaatgattcagtaatgagagaaaaatgggtgaaggaaagtgggagaatcacataggaaggaaatcactgaaaaaaatttgaatgagataggaaggcctttgagaggcagagtgacttttttttattttcaagtcataagatagaaatctggtaatggggattgtagatctggtggttgaagacaagggagttcctctctcctgctctacaattattgaaggtcatcagttgaaaattaggagcgttcaatagttctgaggagggaaggtatgaaatctcaactcaccaggaaaatgtagtaggatttccaggcaatattgagtgcccttcaggtttagtgacatcaatttaaagaaaagccagtcagtttgggagtgtgatttctccagcaacgtgctgctgattggattcatgcaaggagacggttccatcagtgttagcttttgctgagcaaataggataatgggagaaaaacgcaagaaagttaagggtgtttgcaaggcagtgattataaggatggctctgaactctcagaggggcaaagaaggaaatacagataagaaaggaataaagaaaagtataaatgtgataggatagttgtctccgtgaagttaaaaaattattgcagtagaggaactagagagtaagtgatctgtggaggtcagaggatggacagaaagactaatggatacatctgtcactattagagaggagtgaactatgggatacaggctcaaaccatggtcagagaggctaagagatgactcgggaccagtgatttttgctttagtgagtcacaagatgattggaattctgctttaaaaccttttgttggctcactaacctgtcccctatagaaaggagtgccctctaaagaaaaaatgtaaaattaatcattctcatattccttttattttcaagtatcagaaaggtgaaaagcatgtttccagtagcaatttgatgttatagatctgattaatttattcagtgtagaagggattgaggtattttggaatgtcaaaagtctgctattccataaatgtagcattaatattctagaatatttctctccacatttttttctttgcatgtatttgtataactgatattatgtagtggatagtgggtatcttttttcttaaacttactatatgaacattttgttaatgaattttaaatattagaaatgtctcttcaaagacaaaagtcttgctggaaaatgtttgcgaaaatatttgtaaattgtaatacatcttctttttatggattctgtaccacccgggaattaaaagatacctatattctcttagaaacatttgagttgatcaaggaagaagagtccagtagtggaatacttacaaaataatgaaaatacattatatgtctaaagttgctgtcaatataatgccactttctcatgtttttatttaaataaataaagcaaattgaatgaattatttaaccaaagattttacataaagactcaaaaacttgtaatcccagcactttgggaggccaagacaggggaatcgcttgagtctaggaggtccagaccagcctgggcaacatagtgagacccctgtctctacaaaaatttttaaaaaattaactgagtgcctgccagtagtcccagctactcaggatactgaggatgacaggatcacttgagcctggaggcagaggttgcagtgagctgagattgtgccactgtattctggcctggttaacagagcaaaagcctgtctcacacacacaaaaaaagaaaaactgcaaatagaggaaacgtggtaaagagaaaaacaagttataaaatataatacagttgttaaattcaagaaatagagaaaaaatagatatattcctagtaaatagagttgcgaaaaaaatctcaatgaaatagactttctacaaaactatgagtatttcatagaggtagactaggattactgaggaggaaattgagaaagttatgttagtaccagctatcaaaaagatttttggaactaatagatttgctgataaatcttttacatttttaaagaaaattgaagttgcttaaataaatacagaacaacgttatgaaacaagaaaatgagggcattctaaaatactgattaatcttagttgtgaccatatatgtgtgaaaatgttaaagaatatgctagcaaacatttaaacgtctgatctaccactactgtgtaagaaatgtgaacatgtttcaatataaagaaattttgtgacttgggaggctgaggtgggaggattaagcgctttagcccagagtttgagtccatcctgggcaacatagcaagaacctgtctaaaaaaaaaaaaattattgctatcctttatcaggtttaattggggaaaatgatgctataacatagtttgagctaatttagtgttcatttctaatcaaattatttgaaaatgaaaatactttcatatcatgatagactatacttaattattaactaatattaaattcaaaaggaaaataccttttaaacttgtcaccattagtatttaatacgactttaattcagcattgttatttagtgtgatctgtagattggtgccagtccatgatttgcttgttactggtctgtcaagaggtaagtatagaaattgagaggaagtgtttagaaacttttatagtagttggatagagtaattttatctttttttagacctagaaatcaaacatttgggcttgtgttttatatcttgggcttatagtaagacttttaatttcatttttctagttatttttactggttttaaaaattagcttatttctcattaatttttgttagcattttagtaaagtgtcagtatgtgatgacttggaagtaggaaaaactggttcttccctataggtagtttgagaagcagttctctggatcttgccactaatttaagagtaaatatttgaaggagacaagtgtatcacattcatgggtgatatgataatgttatatatactgagaagagccagggatcgtttagaaactagtagagctaataaaaattcagtcaagtgaattcccaagctaaagctgaagtgaatgcttcagtaggtcccatgaatcggcccagcccttgcgtgcaccaagtttggcccctctagcatcgccgccacgaagaaagtggctcaacagctttggctgaaggcccggctcaactgtgtaaaaatttcccaggcagctgcagacttgaaacaattctgtctgcagattgcttaacatgactctctgctgactggagtatcttcaagtacaaattccttcataccccagaaagtctgttcctttttgtagtaaaatgaatctttcagaggtttcccaagccacttctcatgatacagtgaatattcaaaagagagctacatttgaagcctgtacaaaagcttatccccggaacacatgtgccataatatacaaacttctacttttgtcagtccttaatatctacctctctgaattttcatgaatttctatttcacaagggtaattgttttatatacactggcagcggcgtacaatacaacttagtataaaaggtttttttgtgttaaaaaaagatgtgtagtaatgggaagaggtctaaaatgtagttaatattgtgagaacaacagctttacattttctatactttgatgagaatgtcattaaataggaagctatataatacatgagtggacattttcatctaaatattaatatgtatggtaactcagttaatgacttagcatgttttcctttaacatttttctagaaaacagaatcttggcattgtcttcctcaagaaatggactcttcccaaaccttggatacatcccagactaggtttaatgtgagaacggaagatactgaagtgacagacttcccctctctggaggagggcatattgacgcaatcagaaaatcaagtaaaggaacccaacagagatctcttctgttctccactgctaggtaatgcctgtttattttaactagtagtaatacctcacatttgtaagttttgcggggactgcaagtcttgtaactttcccctttttgagttaaggagctctgtagagacctactcagagggattagcttatttctgttttgtttgtttgtttgttttttactggctagctgatctaattatattaagtgtgcagttgcctctcattttatcacttcccgttgctcacagaaggcagaaaggtgataactgtctactgtgtgtgcctcctcagtcttgaatttgcagagtttttgggatgaatagtatactttggttatctcagcaatggagactccatgatcccccacaaaaaacaaaaaacaaatgttcatatttacctttttgatttttagaattaattaaggcatatgttattatccttagctttcaaaccaaaaattgagataaagaggttgagtggcttgtctgaggtagatcttgctgctttcctctgtttagtatggaactgatttattagctctttataaaagataaactttaagtacttttaaaatcattaagggattcaattatgaagatggttttatagttttgtagagaagcatgaatagaacttaattcagcaagttctttgccaacataaactaatgctatccaaatcaaggtattagtgccaacgttttctatgatgtggattattaaagtcaattttaggtccacattttaagaaaggttgacaaaattagagtacctttgtgggaggagaggactatcttttgatagacaaaagagaagactttgctatggtcaaatatttgaagggctgttatgctaaaaaggaagcaacttattttttattcattcatgtaacaaatatctaagtgcctcctatgtgtttgatgctaggggtatatagatgaaagctacctcctcttctgggaaggcaatccagtaaacagaaaataacagtaccatgggatttgtattataatggtgtagagcaggagtctgcaaactatagcttacaggccaagtcttgattttgtactgtccatctgctgagaatgatttttgcatttttaaaggattgtaaaaacaaacaacagtagtatgtatgaccaacaaaaccgaaaatatttaccatctgaccctttattaaaaaaggtttgctaactcctagagtttaaaatggatacataacttaaagggaagctatttttcaaattgatgtaaaaaagagctttctaatagagccatttaatactaaaaaaggctatataacaacaacaaaaagtgagcttcatgtcactgcaaaatgtctagcaaaattctgtattaggattttagcactggggaggagattgtacttcgtgacctaaaatgttttctaatgtaaagttttataactctggcttctcatttactatagttagggcagaacattttaaattattggagtagattcctggatctcataggcagaggaaattttatcattgctgttttgttacgcataagtactaacattgtgataaataggctctcgccaatggcaaatgtaattgatgatggctggtgccagaatggttagatacctcaaaaaagagggatgcaagccagtaacagatatccacacttgaggaaacaagaagcagttgaaagctgtaagaaaaaggcatggcaagtaaaatacaccaccttcccatcacacacacacagataatgttgtacacttgagaatcattaactcttcagctttggcctgctcctttagcaaatacatttgcctatttatgtgatttaactgtccaactccaccctgagatattcttaaatatttaaggagatgctgaaatgctgcttgtaacttacttgttacttactattccttacttatacttaaatagctattttaggtactgaggatttctgtaggttctgaaacctagttagggttaactctaattttttttgagaaaagactgtcagattctttaaatactcagcctgcagttaactggaaatagtaaatttgctttacttgcccaaaggtcccccttgtagcatcagctctagtgtatttggggactttgttaaaaactcttcatgagttttagaggggtgaaggactgttacggaggtttaagactgcttctctgtgccaagaccaaagaggaactgtaccaattgttccttggtggcaaaggttattgttacatatcagtttttcatttttaattaattcattcagtaaataaataactctcttttgagtaccttttaagtgtagcaggtactttgctaggcactgaggatatagctatggataaagtagacacagttgacaatttagatgggaagtggatagactgaagattaaaacaagagggtgatgaattatatggaaggtatgcagggtatataagcagtgacagtatgtgttttgactaagtaaaggacagatgacaacatggtgagctctgtgaactctagatttgcagtaatttcagggggaacagtaatgtgagagaggagtcctcactttgtacacagtgttgcaggcattctgaaatcaagaaagtatactgattaaaataagaatgatttaagtcaacattcaggaaatcacaagaatttttttttcattaaagcagcagttcaaactttttgggtaacaggattcttttacacttttaaaaattactgacaactccaaagagcttttgtttatttgggttattgatatttcccacattagaaattaaaactgaaacatttaaaatgtatttattaattcattgaaaaagtacatattttataaaaaataacttttccaatacaaaaatgtttagaagtatggccatgttttacttaaacaattctataatgtctgacataatagaaaacatcaagactctcatgtctgtttctgtattcaatctgttgctgtatcatatattctgtagcttctggaaaatgtcactgtatctttttgagagaatgggagtgaataaggcatatgatatcttaatattattttgaataaaattttgacattaggtaccccctaagagtgtcttagggcccaggagctcctgtgctatgctttgacataacgggtgtagtctatattatgtaagatgggaagaaacactcataatagttaagagcgtttgctaaaagttgaaatgcttgggttcaaatctcactctggcatttcagctacttgaatgtggacaagttacttaatgctttgtaagttttgtaatcatgtttcctcacctataagatatatataataatacctatctttcaaggttgtcatgaggattaaatgaaatattgtgtgttaagcacctggaccttgtcagactctcaataaatggtagctgctactgctgttgcttttatattattattctaatgcttgtagaattctccatatggcagcatatgtaggtgctttaaagtattatatacgtaagtaaataatcaattttcagcattacccagcatttaatatttgaaactttacagtcatacaagatagctttgcttctcctgatttgcctttgctgacctgtttgacacaagaccaagaatttgcgcctgattctttatttcatcaaagtgaactaagttttgcacctctgaggtaggatgatttatttgcatgtaacctttctcacttcttgttctatgtttttactaatattagtgacttcaggctaaggtgggactttgaggtggggcttagatactcttaggacacgccctgaaggtaacaaagtcctgtactaagacttgatgcatattaatttggcagagtaacgtatgtgtagagatgaaccagatgacagtagtttatttaaaaataattcctaatatattcaggcatttcaggcatattttaatttagaagacacactggattttccttcttataaacctccccatctgctgcccatcatctctctcctccctctcacccttattctgcaaaaagcatttatttcttgttcactaacttgtttggcactctcattttgttcagctgttattgaatgagactagttagctctccttaccttataggaggtgtcaatatgaagtaagaagatttttatgaacagacatatccaaatgaacagatactccaaattcatgtcctttagaatagtcataatgggagaaaagtctggaattttcaaaacatatttggaattattcaagaatatgttttcttcttttagaattgaaaacccaccttaaattaaaaactatagatgtttagaaagtaaaaagtaacctctgtccttatactatatatttacctgatatcacttttatgaaaagtgatctatacacattagatcatcaactaatgattaagttactgttgtgttttgggaatagatcacttcttaagtggtttctttctctttctctttttgtttgtttgcttttttttttctttagatggagtcttgctctgttgcccaggctggagtgcagtggtgccatcatggctcactgtgacctctaacttctgggctcaagcaatcctcctgccttagcctccacagcagctagtactacaggcatgtgccaccatgcccagccaatttttaatttttctgtagagatagggtcttgccgtattgccaaggcttgtcttgaactcctggctttaggtgatcctcctgcctcagcctcccagagtgctgggatcataggtgtgagccactgtgcctggccttgcatggtttcaagagcacaataaatgatgactagtaaaaaagttaacgcaggttaaatgaaaaatcatggtaggcgtcattatgaaaatcacattctgtgtctattgttttaggagaagtctgagataatatcagggttatagggtggtagttcaccttttagttaaaaagaatttgctttactcagtcattagccatcttagaagagtctgaaattaggagagctgtgtttttcaatacacttttcaaataaacttgatttcagtgacatatgtatttttgtgttagtacttaaaaattaaatgtttttaatgttatttatttatttatttttaactatatattttcaggggaattcctgataagtctgaagatactgaatggtcttctcgaccatcggaagttagtgaagctttattccaggctactgcagaagtagcttcagacttagcaagcagtcgctttagtgtatctcagcacccgcttataggcagcacagctgttgggtctcagtgcccttttttaccttctgaacaagggaataatgaagagactatttcgtctgttgatgaactgaaaattcccaaagactgtgatcgttatgatgatctttgttcatatatgtcatggaagacacgaaaagatacacagtggcctgaaaacaatttagctgataaagatcaagtttcagttgcaacttcatttgacataactgatgaaaacatagctactaaaagaagtgaccattttgatgctgctcgttcatatgggcagtattggacacaggaagattcatctaagcaggcagaaacatatttaaccagtaagtaccctgattctttttcagattcatctgacacaattgataaaaataaaattcccaagggaagtaacaattttagtgtccccttttcctatgtgccatggaacaaagagggaactttgcaccacccagaaacgtgtgtaatcagtaaggactgtttttcctttccatgtgaagttgctgctcatcatcatcatcataaaatgtcatattctttcttgtgttgtttgttggaaagaagaggaaaaggggttcccttgacttctgatagtcattattttgagaatgtttatttaagggctccagctgagattgaggtgaaacaaaagatggattctttggagggttatgaaagaaatgaagaaggtttacagaaagaatcatctcaatgttttgaactaacggagactagaaataatttagtatcttcagaagtgcaacccagattcttagaaatacagtatattaggaatgttatagctcctgataattctgtaaaagtttcagaagcacatgtactctccaggggacataatacctctaaaatggaggcttctggttggattgttatatccaacttggatgagatatcagaacaactgtattttcaagaggaaagaaaccaaaagggaacttctctttttggtgagaaaaatattgatgctgctgaaaatatagcctttgaggcagttattgcctctattgagccttctaagaaagagagtacagtaaatgaaatccaagctgacatcaataaatatttaacagatgacagccgagagagagccaaaaaatccagatctttctccattaaattataatgatgaaacctctttatttgataggcttaaacatccatgctatcagtctactcctggggtgtttgaaccagcagcttcaaaaccattgttgcataaaaagggtaataatgatagcttcctatactggcatccaaatttaaaattaccccctaatgctcttcagaaaatgttcattaagccactttgtgttattccagagcttaagtcatctgcttctttgagtgaaaaatcttacaaccaggctgttggtcttggcaaaacacagtcagctttatttcagtgtgatataggcaatgaaccatttcttccctttgggaagataaagtctgttccttctcttgaccttgcagagaaggtaggatcttcagatgttatttatcatgtgaaagtattaacttcagaatctttggttttacaagatttaaagcagccaacctttgaagaagttgcagattactcaaactttaatttgggtaaggatgttaactgtagaaatgccattaaaggtccacctgcagctgtaggaagcagcttttcagcaaacttggtggcatgtgatgcaaagtcacaaggtgcttgtaccattgaccagtgatgcatcattaattgcagtcgcccaagagacattgctgaaagctgatataggccaaggtgaaagtccttcgtgtgtgggagctgagcctagttttactatacatacaattatgcaaaatgactcctattttgtagagggcctgcaggggaaggttgagtctgacgtcattactctggatggcctaaatgaaaatgctgttgtatgcagtgaaagagttgctgaactacaaagaaaggtgagacacaataaaatgatagttgtaagaaacgtggcctttttcagtattgtttcaggaaatggtattgtttgtttttattttactttttactgtttcctgggtacatgaccaatgtcatttgactggtgagtacattgagctagcagctttagagaaatttcatggtgatctagagatgcatgacagctccctgcactggcagcctactttacaactaccatctgagaaggaaagcaattttgaaaagcctgtaagtttttctatttgacatttttttctgggcggggagggaatgttttatttgaaaaatttccaaattttatttgaaaatactttatttgaaaaattatatccttcagtaccagcttgtaacttgtacctgttcttcatctgatatccaggaatatgttccattagaggttggtataaaagaaatgtttatgtttcatagactgtaagacttagttctgtggtgtcttggaaaaggcatcccatggggctccaggcctttcatattgaggcagcctaactcttcctagttgtgccagcaagagtctttagacagtgttaagattaggcttattcatgggaacatccaaaagcttgtactttgaatgtttccctctggtcttcaatgcacaagccttgaaacagtccctggaatatttaagtatttctgtttagaagctcttgaaagacttgacttcagaggtgtcttgaaaattgtaagacccatgtttgaccaggaaggataatgaagtgcttaacgtccaaactggccagtgtctcttcaaagggaagtatctccttcccaaatgagcaacatactaatgtatatacatgtctcttccctctctctatttatatcattattaccattgtgtgtgtgtgtactagaaactggcaactctaggatgtcataaaaattttatatcagccttttttttttaaattaagttctggggcacatgtgcagaacgtgcaggtttgttacataggtatacaggtgtcatggtggtttgctgcacctatcaacctgtcatctacattaggtatttctcctaatgctatccctcccctaaccccctaccccgcgacgggccctggtgtgtgatgttcccctccctgtgtcattcttttatagaaggcttttatttgcttggatccttggatcccttggcattaatgttcctctggtcccgttgaatgaatatcctcttttgttgtctggtactgtaagtcccaaggtgggccctacttccttgtgatatagccttatatcctgttattcattaaatacagttagataaaatagtgatgtacttaatgttacttctcttttcctatgtataagattggtatgtttttgtaaagctctattagtttgggttacaaccacatttagacctttaggttcagattgttggtagaaaatgaacaaagatattatgatgaacttttatttataatttattacatttattaaagtttttttaacacagaatcactaggtttattttcttcagtattccaaactaggcattttttaattttaatctgataactggggatgaaaatgatagttaacactttgtgctcaagtactgtgctaagaggttacatgtatatatcaattcgtttttgtcctctgtcaatcctatcaaatagaattgttagagattattatcatccctattttgcaattgacacttagaggatttaggaacttgctcataattattcagcaattgggggaaccagtatttgaaactaaccatatctgtgtacttaaccaccataccataaactgttccccctccccccaccttttaactattcttggtgaaactaaggttaagattttgcattattttggcaagagtagaggttttgaaggagattgcctaaagttgagttcaataacaatgagaaacaaagtaacaacttttaaagtgttctaaatttttaatactacttttgtgacttacatcaacctttcatgtagataaaatgtattttaaaaataaagatatataggttcagttaatgtgcagagactagctttgaccactgctccaaattttaatctgtccttaaatatagcctgaagtattattctttcaatctaaggaagatgctattattccctgtattgtctttcagttgtagctctatctgtcttagtcttagatctaggagttatttaatgtcaatatcagaaaagcaaggagccagatgtggtagtactttttctgcatggcttagcttgctttcaggggcttgcttactccttggtttttccttatgctcctcatctgtgtcacagaagagtcattcatagttacttggttcacttttatatctactcctcataaatgattatttgggtatccacgtatgtatgatggagcttggaactgtgaaaagaacatagagattttgagtcaaaatccagttcagttactttgttagccttgtgtcttgagcaaatgacttcggaggatcactttcctgatctgcataaggaaataggaatagtaataaccttatacatcgtactattaaatggggtaagttatgtagcatttatatagtgcctggttgttagttctcttcactttgctgaaactagactactagagtctctggtggtttcctactttctatcattattttgtttttctttctcctttttcttggtagcagcacataattaatatgcttttttttttttttttttttgaggcagagttttgctcttgtcatccaggctggagtgcaatggcacaatctcagctcactgcaacctccatctcctgggtttaagcagttgtcctgctgcagcgtcccaagtagctgggattacaggtgcctgccactatgcctggctaattttttgtctttttagtagagacggggtttcaccatgttggacaggctagtctcgaattcctgacctcaggtgatccacctgcctcagcctcccaaagtgctggggttacaggcgtgagccaccgtgcctggcctaatatgctattttagtacctcttgttttggccatttagctctaaaaattatttaaggtttaagccttagatttcttttctctccccttcatatccccccacctttggagacctagttgcctgtctctgtgtggatgattatcacctctgtttttataccctaatatttgtctaatttattttgcatgttttcttgtgaacattgtcatcaccccaaattcaacttgctctatagcaaaataactcatgtttttcctaaaattagactgacttgtagagttcctgagtttttatgaaaggtattagtatttttctggtttcttggtcatctttcattctttcttcattattgattaaacattgggaagataaacgaatcttgatttctgttttctcctggttctttccattttcaattagcaatgaagatctgctggtttcttaaataaatacttctcatatttttcattttacattttcttttgtattacctactttttttttttttttttgagacagagtctcccactgttgcccaggctggaatgcagtggtgcggtctcagctcactgcaagctccgcctcccgggttcacaccattctcctgcctcagcctcctgagtagcttggactacaggtgcccgcccccatgcccggctaattttttgtatttttagtagagacggggtttcaccgtgttagccaggatggtctcgatctcctgacttcgtgatccgcccgcctcggcctcccagagtgctgggattacaggcgtgaaccaacgtgcctggccggtattacctactttaatagttctatattttgaaactttaacataatgaaatttttttgacgtcaagcttgtaataaaaatttttctttctgtgtttgaaagctgtagaagaaaaactgctgtaaactataaacacacactgtctctcacaagtgtctatatattatatatggtcatgccacataatgatatttcagttagtgacagactgcatatatgatggtagtcccataagattaaaatactgtatttttactgtacctttcctatgtttagatacacaaatgccactgtgttacagttgcctacaatatttagaacagtaacatgctgataggtttgtatcctggaagcagtaggctagaccatatagcctaggtgtgtagtaggctacacagttgtaggtttgtgtaagtcactctgtgatgtttgcacaacaacaaaattgcctgacagcacatttctcagaacatacccacatcattaagtgatctatgactgcatattatatatatgcatatatatttatatatatttatgtgtatgtatatatgtgtatatatatagcctgtacttcagagaagtttcctgtaggagtgaggtaattgaaaactatgaactttgtgctatgtggagagcagggcttcttagcagccttatcattttgagttggataattctttgttatggtgggaggcgtgtttcctgagtattgtaggatgttttgcatcatccatccctggcctctattcactagatactagtaacatcccctcccctcacaagttatgacagcaaaaaatgtttccaggcattgtcaaatgtcccttgatgggtacaaaatcttcacaagttgaaaagtagagaaacctgtatgggcagtagatgtagatatagaaatagatatggaatgttcatttccacacttcacatggcttcctaagaatgttcattactacacaatgaaaaattgatgaaagaggatagaaaaattcatgcttatgtacatttttagacttcatcctgagaagatgtgactgaaataatctttttagggaaataaagacaatctaaaaatgatatatatttttatgtgagggtgcactgtgaatttggtgaaaagttgtacatgtttaggtattaatgtcaccaatattggtttctaatttcttttctagcaagaacttgtgacttgatgaaacattaggaacttctttttgagcagttaccctttacttcactaccaatttatagtttccactacttttgttttaagaagtttgaggacttatgcttgttggtaaccgatcacagttatagttctttgatactctcatttttcttctaaacatttgtgagtttctagaaaatattcctgttttctttttccttcttactgtttcttgtccacagtgcacctctctaccttaaaaagaaatacctgagcttgtccagaataatcccatggttcaaattctgcgatgatcataaggagcaaacttctgagtaacagaacacttctaagcatactatctataatattttatctagacagatttctaagccctcaggatgatttagtcttctagagttgacccaataaaatatgacctatatatgaattcagaaggtttgagattatgatcttaagtaactagtataacttcttagtgttcctctttgtaaaaatgaaggattatttttagcagatgaggtttgaaattaatatcttattttcttcatttcttcgtaggtgggtcattctaatctgggcattaatgagtctttttcatttttattgccttcatttgttccacataagccaacaagagagtcggaatatcactcttcagatctcagaatgttgaggatgtctcctgacactgtgccaaaggctcctaaacatttaaaagcaggtacgtagaaaaaggagatagtaaatgtcctacttacggataccttgtgaaaaaatatcttgttaggtctatctaattttgtattttttaatatctataataattatacttcagattagatgtgtttataaatcctgtcttagtctctttagactgctattacaaaaatatcttagtactttaagtatggcttataaacaacagaaatttgtttcttgcagttctagaggctggttccaagatcaagtgctgggagattcagtgtcttgtgagggcctgtttgtcatagatgacatgttcctctgtgccctcccatggtggaaggggcagggggtctctctggagtcgttttttgtaatgggcactaatcccaaacatgtggcctgtgtcctcatgatctaattgctttccaaaagccttacctccttaatttcatcaccttggggattaggatttcaacctatacttttcaggggggacacaaacattcagaccatcacaagtcccctgatgttttattagaggaatcatttggtttttcatcgcattctacatggcagtgtttagaactgaattatatggaggagtctgatgttagaatctgtttattcctttgtgtgacttgaagggaaaaaggaattgattgagcccaagatgacaagagtggatgcagataagtttgtagagaggaaattgagagaaatcagttttgaggtaaaagcaagattatctgctgagggaggtgagtagtggtggaattaggttagaggcattgaggagagtggtttggtgaagacttacagtttatgttgaagtgaatttgagatggagctgaccaagggaaagtaaaaggattggagggcagttctgagaagtcagctcaggttagtgataatgattttataatattgtcagcctgtatagaatctctgatttgtttttcctgctaacactcaggaatggagatgatgaattacagtattgatccttggttcaggaatacattgaatgggtatggtagaaggatagcagtcaaagagagaagagttgatcacctattggtttcagcctacatagggaaagagaagccagaagagttgttattctaggagaaaatagaaggaccagagatttctttatgaagttgattagatgaggtgggaataagttactgagagcactagaagaataggtaattttggtcagattgaataagtagatttaaatgaggatcagtttgaagggtgatgaaatccattaaatagccctgggattggatggtagaaattgaataaaaattactggagtaaataaaattttgggtcaggtacagtgtcttatgcttgtaatctcagtactttgggaggctgaggtgggaggatcacttggaagagtctggaaaggattggtattaattgtttttgaatagaatttactgtgaaactacctgggctgttctttgtaggaagtttttaaattgctaatttcatctctttccttgccataagtctatttagattttatatttttcatgaatcagcttttgcaatttgtgtcttaaatagaatttgtccatttagctaggctatctgtttacatatatctgttcataatattcccatgtaatctctttcatttcagtaaggttagttacaatgccctctctttcattcctgattttagtaacttaagttttcccttcttttgttctccctttggtgaatctagttaaattttgtcaattttgctgattttttcaaataaactggtttctttatttttttctaatctttatttttcttttctgatttttgtttcatttattttcattctagtcattatttttccttccttccatttgctttgggtttagtttgtgcttttattctgttttttaaggtggacagttaggttattgatttaagctctttcttcttcttattacaaatatgtatacaaattgataaattcctaagcactgtgttagctgcatgtcctaagttttggtttattatatttttgttttagttcatctaaacttattttctagtttacattgtgatttttctacatttaccctttggttatttaggaatgtgttgtttaatttccttctgttattatgtttcatctggttcaatttttgttggaaaacatactttgtatgatttctgtctttaagttttattgaggctcgttttatgttttagcatgtagtttattctgtagaatgtacagtttgtacttgagaagaatgtgtattctgctgttgttaggtggtgtgttctatagatgtctttcagctctagtgggtttagctgttcaaattttctgtttccttgttggtcttctgactagctgttttctccattttcaaaagaagggtactgaagtcttcaactctttttgtttaattgtctatttctccccttttttctctcagatttgcttcacatattttgacattatgatgttagatccatatatgtttataattgttatatattcctgatgaattgacctttttttggagacagagtcttgttctgttgcccaggctgaaatgcagtgcgtggctcactgcaacctctaccttctgggttccagcgactctcgtgcctcagcctcctgagtagctgggactataggcgtgtgcccaccatgcccaattaattagaattgaccttttaattgttataaattgttcctccatattttgagtaactttttgttttaaagtctgttttgtcttaggttagaatagacacttcagctcttatggttgctgtttgtatggtttatcttttaaaatccctctactttcaacctatttgtattatcaaaaatgatgtatctgctgtaaagagcatatagttaaatcttgagtttttaattttaaaattctatctgtttttgccttgtgatgtgattatttaatctgtttgcatttaatgtcattattgatgtgattggattcacattttctggcttacgtttggtttttcatgtgtcttgtgtcctttttctgttccccttttattattgcatgaagtgaatattttctagtatgacactttcagtttaatttttaaaatgattttctaggtagttttttttaaagttatattcttagtgattactctggggcttataatatttatcttatcagaatatacttctgattcaatttatactaacttaattctagtatggtacagaaactttactcccgtatagctctattccctctttttttttggtgctattattgttatacatactactcacacacgtatataaatgcctttaagtttttgtttttttttttagtcggggacttgctctgttgcccaggttggattgcagtggcatgatcatagctcactctaacctgagctcaagtgatcctcctgcctcagcctcctctgttgtgaggcccacaggtgtgtaccactacactgagctaatttttcaaaaaatttttttggtagagatgggatctcactatgttattagtcttgaactcctgggctcaagcagtcctcccaccttggcctcctaaagtgctgggattacacgtgtgagccaccatgccagcctgctttatatattttcaaattgctctttaaatcagttaacagaatacaggaaatgaagtatgtctttttgtagttaccgatgtagttatttttactagcactatttgttttgttatgaaaatgttactactatctggtgttacttgtttttcagcctttggaacttcctatgttatttcttgtaagatggatctgcaagttccctgttttatgtatctggcgtgtttttatttcatctttttgaaagatagttttgctgggcttggaattcttggttgacagtctttttcttttcagcactttgaatatgtctcttcactatcttctggccttcatagttttggatgagaagtcagctgttatcttattcatgttctcttgtatgtaatttgttttctcttgttgcttccaagatatgctctttgtctttcactttcagtatcttgattatgatatgtctctatgtgaatctctgtgtttattctactttgagctcactgaacttgtcagatgtatagttaatatcttttgtctaatttgggaagttttcagccatcatttctttgaggattttttctgcttctttctcttttttgcccagttatcatctcttgcatcacagtccacatatatcagcacccctaatcttgtctcactggtctctaagcctttgtttgtttttgtttcttctttctttgcttcagtttgcatagtctctattcatttatcttgatgtttgctgatttttttcttctgtcttgtccatatctactgttgagcctctagtgaatttttcacttcagttactgtacttttcagccttagaatttccattttgttattttctaagttctgtctttcattctgtatttgatgtgactttgccatcatacctatctttaattctttaagcatccttttcttccctttgaatatgtttataatagctgcttttaattgttactggctaagcccaatgtgtgtgccctctgaaaggtaaatttgcctattttgttccccctgtgaaggggtcacactttcttttgcacatcttacttttctgttattgttctaaactggacgttttggataatatcttgttgcagctctggatattgatcccttctctgggctggtaacgtttgatatttttgttgtttcgttatttagtgtctggtttggattagttcttaattgctcaccaccaagatctccattgtttttgtcagtgtccttaggcttgagctttttatgctctgtttcaaacaaagtcattctccttatggagatgtgtggagctctctgttcttatggcttgcctctgctgggcagaagctttgtggcactgctctgtatctgggggcaggttcattggtctacttctcttggaataacacaccccttctctatgattgtgatgctgaaaggggtagtagttagtccctgttcttggattgcctctcctggagtggaccctcactccacctacaagtgagctgggggtagggatgattagagcttggtattctcaggttgggataaatcttccactctataagtggggactgggtgaaggtaggttgcttcttgtgttgtttctttttcacttattagctaacatcaacagccagtgttctttctttacagcctttctcccatgacatcccttccattctgccttgttactttatggatcgtatctactgatgtacccagttgtaccattttaattatttggttaaaatggtacatctcatttctaccagtaagatcctgagctcctcacttatctctcagagtagtattgtgctgtatgggctgacattaaagatttaatattatgcacagtcttgacatctgaaactgcgaggtcctcaaagggcctaaccacaagtttacctgccagatatgccctctactcagtggagaggcttcctacacagccagttcttctatcaacgagaccaactgtattctacctggtactcaacctcagatttccatcccatgctaacctgtgaaattattcaaacaagccaatcacaccctcctacagaaataaaaaaaatcacgctcttttcttgctactacaagcctgcctcctatggttcctgtttactcgttctgttcccatgtacaatccctgtgtggccctgcatgtcctgtgtcttccccagctgtgagtatatgtgactaataaactaccgtcagtctcctctgtgcagtgttgtatttagccaatccagatctatcaggcagcaatccctccctcatcaatagggtgaagaggaggcaaaagaaagaaatatttgtgtccatgtttgattcatattgtattgaaatggtcccttgatattagttgccctgatttcttatttttttattggcaaacctctgggtcctattttataacaagcagaaagtaactgccaagcttcatttcaaattggctccaaagtatgagtcaagataatttacatatcaggtaaagtagacacacttaacataatttgaatagtttagattacaagataaattggaaacaagtttggatctggattattgaaaaagaatcggtgacaccattagaaagtagggtagtgaatttagttttggacatactgagtttgatttgtcgggagatcatttggtttgaagtgtcttcaaagccagttgaacaaatgggaaataggaaatacaaatttggaagatcttaaataatttgtgattaaaattatgccgtaagagtagttaagctttctgaaggagcatgggtagagagaaaagcaaaatgtcaaggatggtacctcatggaatacaatagcagaaagaggccaatagaaaatatcaaaaaagacagatattttgtttaaattcttactctgatttagttcttacctcttcagtttccattccaatttcttagtgcctttactatatcacactggattttgttgcacgaacatttaggattgctttgtcttcttggtggattgatcctttacaattatgtaagaattctctttgtccctcgtaattttctttgttctgaagattatcttatatagccactcctatagaatagttcttttctttcttcttcttcctcttcttcctctcctcctcctcctttttttcttcttttttcttcttcttcttcctcctgctcctcctctttcttcctcttttttcttctttcttctttctttttctcctcctcctcctctttttttttttttttaaataaagataaagtctcactctgttgcccaggctggagtgcagtgatatgatcatagctccacagccttgaattcctgggctcaagcagtccttctgcctcactctctgagtagctaggactataaatgcacactaatatgcccagctaatctttttttttttgtagagacaaggtcttgctatgttgcctaggctggttttcagctcctggcctttcaaagcctgatcctcccatcttgacttcacaaagtgctgagattacaggcatgagccaccgtacccggcctttttatctgtcttttagtttcaaccttactatgtcattatgtttgaagtgaattttttgtagacatcatataattgggtcatttaaaaaaaatcctgtctgctaatatctgtattttagtttgtttgtttatttattttgagatggagtcttgctctgtcaccaggctggagtacggtggtgtgatctcggctcactgcaacctccacctcccaggttcaagcgattctcctgcctcagcctcctgagtagctgggactataggtgcacaccaccataccaggctaatttttgtatttttagtggagacagggtgtcaccatgttggccaggatggtctgcatctcttgaccttgtgatccacccgccttggcctcccaaagtgctgggattacaggtgtagtttgtttatttatacaatttatacctaaagttaatattggtctattatgccttaagtctgcaattttattatttattttcactttattcctgtttctcttgtcttgccttactatgggtttcatgaacatactttagaatttcactttaatttttaaaaattatttatttatttttgagacagagtctcgctctgtcgcccaggctggagtgcagtggtgctatctcggctcactgcaagctccgcctcccgggttcacgccattctcctgcctcagcctcctaagtagctgggattacaggtgtgtgccatcacgcctggctaattgttttatatttttagtaaagacggggtttcaccatgttggccaggctggcttcgaactcctgacctcaagtgatccacctgcctcagtctcccaaagtgctcgtattacaggcgtgagccaatgcacccggcccttggtgtggatttctttgggttttcctgtttggagctgacttactttctttaatctgtaagtttatgtctcatcaaatttgggatgttttcagactttgtttctttgaatttgactcatcttatttgcatcatttgatcgtcttctccctctctctcgcgttcgctgtctttctctctctctctctcttgctgtctctttctctctctcggctcactgaaacctctgcttccggggttcaggcaattctcgtgtctcagcctcctgagtagctggaatcatgggcgtgtgctaccacgcccagctaattttttgtatttttagtagagacggggtttcatcatgttggccaggctggtcttgaactcctgaccttaagtgatccacccacctcagcctcccaaagtgctgggattataggcgtgagcaaccacagccagccttgattgtcttttctcagtttgtgattttcctggttcttagtggtaaaaatgaattttgattatatcctggacattttggatattatgttaggagactttgattcctatttataatcttctgtttagcaggcagttgctctatttaggttttccatataggctctggcctatttatgtggctgtgatcccaaagataatttagttttcaggggagttgcattctggtctacttcagtggtaccattgaggctcccactcagtccctgttggtgatgcttatgtgggtggaatggtcttcctcaaggcctgctggtgctgtgtgggaagggggagatgctaacccacagagtagagaacatttccctgggcctgcccctggaccaactggtgtcagtgggtcacccacttgattcttgttgatggcattcatgggggtagaaaatgcttttctaggcctcctgatgcatctaggtaggatgctgggcccctgcgatggagaacatttccttgaacctactctctgggtttctcaatgctggtggacttcccattcaatttttgccagtgccactggggaaggaaagtgcctacctgagctgtcttttaccacaggagagttaggagatggtggacctaggtcttcttttgttactggctagaggacagggagatgccaaacctgttgggactctctgcctggtttttgctggcactacagttctggtggtgcaagcctacctgttgctgctgggttggagtagggtgtggggagatgggactgtctgctaagtctgctgggctgcccgtttcttggtccatggcccacagacagcaggcttttcttggacttctttctgccctcctttgttccctttctccttcccactattcctattcctattcctatttctggtcttagttccacactgcaggcctctccagggtccagcctcagatataagagagttaaaaagaaaactaaggaagtcattgccatgttgttctccagtctggaggtccttagctagtctgcgtttcactttctacctttcagttttttttttgtcttttggtttctagggaagtggagggaaaagcaaatttatatcattttgtcagggaccagaagacaactggagttttgaaaacttgacttagatgtgctattgtctttggttgttggtagaaataatcatatgggggaagtgaggtaaagatctttctcaggcaatattgaataaactcagggatctcaagccacagaagatggggacacctatgccatgaaactttcctaacttttctaaaatctgcagcccgtgtcctgaactattaataatagctgacatttattgcttgttcacattgctaagcattttatgtattattattataatgtatattatataatacaggttgagcatccctaatctgaaaaaccacaatccagaatggtccaaaatctggaactttttgactgctgacatgatattcaaaggaaatactcattagagcattttggatttcagatttttggattaggtatgcacaatatgttcttttatcatattattattatgccatattgttttatatttttaatctgacctatgatgatgggcactgctattattctatttgctatctgagcaaaatgaaacttagagtgacttgcccaaagtcccactttctctaagaggattttgatagcttcattccatattgttctctctgtttctcaagttttaaatgcctttataaccttaccataaacatatcacaccatcagtttttccaaattctttctcagagagggcaccaatttaatttctattatatacttaacactaatcttggcatatgataaaggcatgaaagagtctcgatgattgtttgctaactgaagagttcatcagttagtggtacagtactggctgcctcagcttgtttacagcatcaggtagtgacatagtaggaaacaatgctttgtgcaagaaaggattttaacttcttcctaggtaatatcaacacccagggcttcagttatttcctatgactgatgagttccaattgtaggactctatctagatatatctcatactccaaatgtttgtatctgactactatgaaatgtcttcatttggatgtcccataggtatcttaatgtcagaactttaaaaatggagccaatcatctctttaaacctactcttccttctctatttcttctcagtgaatgagtgtctacttattagccaagctagaaacttgtattcttctttcaccctcatccctgcccaatcacttaatctcgttgattctatcagactcccattctcttttctgaattactgcattagtaatggaaaactgatcatcttctctgccacttattttcagtattaagccaaaatagtctgtttacagggcagacttgataatgtcacttcctagtttggagttcttgctttccattgttaaccttggggtaaattctaaactccttagtacatagtagaaggtccctgcttaccttcttagccttatacttgcctcttttttcatagtgaactactctcatttcttcatgatgctagaccctcttgtctccttgatctcatagatgctattttctctacttggaatgcttccctattttttatatgcccatctttgcctaatttctggtttttatcctttcattctgagctttgctgtctttcaggaaaatgtttctgtttttcactgttcaccatgactctttaagaaagagccagatactccttacatatgttgctatagtatcctgtaaacagcctccctaatcactgcccttacactgaatttagtaattgcttttttttacttgtttctgtctcccacaggactttaagctctttgagggtagagctcgggctttgctaatatatatatttttgcacctggctgtgaaagctactcaataaatatctgttgaatgactttatgaattgatgaatattaaatgaattaacatgcctgggtagactgggggaggggtagaataagatggtaggctttgtattttggcagggatcagttctcaagaaagtggatcaaataaatgtaagtatcatatttcattgactatatgtcagttgtaatgaaggcctatggattagtgtcttatcactattttattgatctctggttaacatgaggctgtctctgtgacttgaatggcctatatgtctttctttatgttttttggtgggtattggggtttatgttccctgcctctaaacctaattgatttatcttttagttttcctgccataatttttattgacgcccagtcttttgtttaaccttactaccttaggttgttatttgttggatatcttctcccttgaagatgcaagttactcagggcagggagggaacctgcgtgtggctcagagtaagggaggactttagtttggggcaggactttgaagggttctcttaaagatgaggagcctggaagcaagatctgaaattacatcttctcctgtcccagagggaatttctttgagtaggggtgcacctatcagggtggtttgatgactgggtattactatgaccaggttataactttcccagggttattctgttaggaaatagtgtttgggatttgatgtttgagtacagagttcatgaacttttcacaacaccagcagttcattagctttttgaaacctctgcccacttaggaatgaggaagagtctataacgcactttacctaacaattcctgctttcgcattgaaaaagaacttagtgatagcaacaacaaaattaggaattaaattacaggctataatgttagctcgtgtatgtgatttttgtgttataaaacagtgccctattatcttttgaaactaagcaattttattacatttaacttgattttgtattgcaagttatttaaatggcatacatttatcaacaggacaacgttaatgaattatcagtatgcaggaactttggaagggttatatttacgtccactgtggtaataagggtatcaaaaatcctgtttgaactgtgatatattgtgttaagtttagttatgagagaatatagtttaagataatgaatgtagagataaacatctatgagttaactgagggattaacgaaatacaacacaattataattatttagttatcaataattaataattaggaacttataaaaatgatatagtaattaattagaaagcaagaataacaacaatgaagacaaagacccatttaaaatatcactggtgtctttttaaaaaaacatgaatttgagtttacttctctgtacacacaataggtgcttttgccagactttttaaaaaaaaatcttttttatttttaatatttatgagaacatagtaggtgtatatatttatggggtacatgagatattttgacacaaacatacgatgtgtaataatcacatcaaggtaaatggagtatctgtcacctcaagcattcattatttctttatgttgtgaaaattccagttatactcttttaatttaaaatgcgttataaataattgttgactgtagtcaccgtattgtactatatcatattctagagcttattcattctaactacatttttgtacccattaaccatcctcctcactaccttcccagccccgttacagacttattagtgactgaattagagggctcaaaatgagagctatagtaatttatttgtgtgtgctagtattaaaacccataataattgacttggaacgattactagtaagaggctcttagtcatatgtaaaatggaagtatggaattgtacctcattttgtctgtgagaaataaagggcttgcttattcttcttatgtcagaatatacttggggaaataaaaccgtgctgtcttcgtcacctaggaagccttctgtgttactaagcaccttagtatggagaagagttcttgagtaaattgtacccaggttgttagtcttaatgtcatctctaagaggcatacagttcccacccaatatacaactttggtgtagtatagtcttttctggcagccatcttcctcttcttggtcgaaacttacctcttcaactcacccctagttctgaaaatgaatctccaaagattatatcagtatgtagtaatattgttaacactcacacttagtgtattcttctttcccagggctgagagaataataaggactctaaaaacataccatttttcatcatgaactccttatgtacatagacacattttataaatcatagttaatggatttgtgatcaccattcttctgacagtttgacatatatgtccttaactttatatagaactgacaagaattcttctttaacatcgtgcatctcctccctcgcttttaacagcttaacctatagtcgttcttccagttttctttactaatcttttcctttacccctgaggttaaaaagaccttatcttatgtaacctggatctttcaaggacctgggctgtacatcttaactccttagctatttatctcatttgtccccattcatggtgtcactaataatttgtaatggccaaagggatataaaaactttgagaaatcaggaaatcatttagaaaaacaaggttttgttttgttaatctgttttggtttattagcttcttgagcctgttttgtttcctcacaaaaacttttcttattttctttagacccagcaggcaagaacctcacaaaattttgtaactcatattccttctcaggttacaatgcatgttacatttttaaattttttacttttcttgaagagttaatacttgatacttctagttctttactttgaaattcactcctcaacccatttcattctatattcagctcctttgaagctcgtcagtggccatagaaagccagtcagttgtagtggaaagagctcagaacttggatttagagtttaagggttaaagtaccagtttttgtcacttacccacctacaattctagaaaaactatgtatctttgcacttaaaatgtggtctgaggaccaataacattgggcatccctggggagcttgttagaaatgcagaatttcaggtcccacccagacctactgagtcagaatctgcaagttaacaagatcccaacattgagaagcactgttacatggtcatctttgcaactcggtttccctatacgtaaaaaatagataatacttgctctatatatcaatcatcttaacaccatctgacacatcatatgttttaccaatttattgtcagcctcctcctgctagaatacaaattagctctgtgaggtagggattattgtctgtttattgctgtatgtagaacagtgcctggaacatagtaagcattcatgtattttgaatgaacaatgaatgaagggacagcttgtcaaatcctgtcatttctgttgcagtcacttactttacactgctgtttaaaactgctttcatttagaattattgtattagtgcaaatatagaacatttctatagaaatgtttgttggattgtgcaacctagatttttacattcccttctcactcatcttgaaaactttaaaactgtaaacaacttgccatgctatacagaattaagttaaaactcttcagagtaacctttagagttttttcagttttatgtacttaaatatatatatattatacagggtgcatttgttgggagagtccttcaaactcactgcacgcatagcatccctctaggccatattgtactgcccctgtgggacttgggggcaggaggaacccgtgaaaataagctgatgagcctttgctgtaccagggatcatgaagtcttttgtctctgactgaagaccttatgtcttctgccagcctgcaagacacaataacagattgtaagtagggtgaaatcaaatcctagacccaatagcattatcccatctcattgaaaattctcttaaaaatccaagttgtaagatccatataatatttcatccactggatatactgttgtttataaccattactctgttgttgaagatttaaaatgtttttactttagttttctaattaatatctttgtgtgcaaatatttatctcctttgatggctgtttccttaggattcatttctagaagctttttaaaggctcaaagctggctttttttccagcacatagaattttaaaatagaaaattttatatactattaacaaatctctttttctttaggagacacttctaaaggaggcatagctaaagttactcaatccaacttgaagtcaggcatcactaccactcctgttgattcagacattggatctcatttatccttgtcccttgaggacctgtctcagttggctgtaagttctctagaaactactactggtcaacacactgatactctcaaccaaaagacattagcagatactcatctaactgaagagactctgaaagtcacagctattcctgaaccagctgaccagaagactgcaacaccaacagtactctctagttcccactcacatagggggaagcccagcattttctaccagcagggcttgccagacagtcatctaactgaagaggctttgaaagtttcagctgctcctggactagctgaccagacaactggcatgtcaactctaacctctacttcctactcacatagagagaagcctggtactttttaccaacaagagttaccagagagtaacttaaccgaagagcctttggaagtttcagctgctcctggcccagtggagcagaagacgggaatacctacagtatcctctacatcccactcacatgtagaggacctcctctttttctatcgacagaccttgccagatggtcatctaactgatcaggctctgaaagtctcagctgtgtctggaccagctgaccagaagactgggacagcaacagtactctctactccccactcacatagagagaagcctggtattttttaccaacaagagttcgcagacagtcatcaaactgaagagactcttactaaagtttcagccactcctggaccagctgaccagaagactgagataccagcagtacagtctagttcttactcacaaagagaaaagcctagtattttgtacccacaggacttagcagacagtcatctacctgaagagggtctgaaagtttcagctgttgctggaccagctgaccagaagactggcctaccaacagtaccctctagtgcatactcacacagagagaagctccttgttttctaccaacaggccttgctggacagccatctacccgaagaggctctgaaagtttcagctgtttctggaccagctgacggaaagactgggacaccagctgtaacctctacttcctctgcgtcctcttcacttggagaaaagcccagtgctttctatcagcagaccttacccaatagtcatctaactgaagaggctctgaaagtatcaattgttcctggaccaggtgatcagaagactgggataccctcagcaccatctagtttctactcacacagagagaagcccattattttttcccagcagaccctgccagactttcttttccctgaagaagctctgaaggtttcagctgtttctgtattggctgcccagaagactgggacaccaacagtgtcctctaattctcactcacatagcgagaaatctagtgttttctaccagcaagagttgccagacagtgatctacctagagaatctctgaaaatgtctgctattcctggactgactgaccagaagactgtcccaacaccaacagtaccttcaggttccttctcacatagagagaagcccagtattttctatcaacaggagtggccagatagttatgcaactgaaaaggctctgaaagtttcaactggccctggaccagctgaccagaagactgagataccagcagtacagtctagttcttacccacagagggagaagcctagtgttttgtacccacaggtgttatcagacagtcatctacctgaagagagtctgaaagtttcagccttccctggaccagctgaccagatgactgacacaccagcagtaccgtctactttctactcacaaagagagaagcctggtattttctaccaacagaccttgccagagagtcatctgcctaaagaggctctgaaaatttcagtagctcctggactagcagaccagaagactggcacaccaactgtaacctcaacttcctactcacaacatagagaaaagcccagcattttccaccagcaggccttgccaggtactcatatacctgaagaggctcagaaagtttcagctgttactggaccaggtaaccagaagacttggataccaagagtactttctaccttctactcacaaagagagaaacctggtattttctatcaacagaccttgccaggtagtcacatacctgaagaggcacagaaagtttcacctgttcttggaccagctgaccagaagactgggacaccaactccaacctctgcttcttactcacacacagagaagcctggtattttctaccaacaggtcttgccagataatcatccaactgaagaggctctgaaaatttcagttgcctctgaaccagttgaccagacaactggcacaccagctgtaacctctacttcctactcacaatatagagagaagcccagcattttctaccaacagtcgttgccaagtagtcatctaactgaagaggctaagaatgtttcagcggttcctggaccagctgaccagaagactgtgataccaattttaccctctactttctactcacacacagagaagcctggtgttttctaccaacaggtcttgccacatagtcatccaactgaagaggctctgaaaatttcagttgcctctgaaccagttgaccagacaactggcacaccaactgtaacctctacttcttactcacaacatacagagaagccgagtattttctaccaacagtcgttgccaggtagtcatctaactgaagaggctaagaacgtttcagcggttcctggaccaggtgaccggaagactgggataccaactttaccctctactttctactcacacacagagaagcctggtagtttctaccaacaggtcttgccacatagtcatctacctgaagaggctttggaagtttcagttgctcctggaccagttgaccagacgattggcacaccaactgtaacctccccttccagctcatttggagagaagcccattgttatctacaaacaggcctttccagagggtcatctacctgaagagtctctgaaagtttcagttgctcctggaccagttggccagacaactggcgcaccaactataacctctccttcctactcacaacatagagcaaagtctggcagtttctaccaactggcattgctaggtagtcaaatacctgaagaggctctcagagtttcttctgctcctggaccagctgaccagacaactggcataccaaccataacctctacttcctactcatttggagagaagccgattgttaactacaaacaggcctttccagatggtcatctacctgaagaggctctgaaagtttccattgtttctggacctactgaaaaaaagactgacataccagcaggacctttaggttccagtgcacttggagagaagcccattactttctaccggcaggctctgctagacagtcctctaaataaagaggttgtgaaagtttcagctgctcctggaccagctgaccagaagactgagacattaccagtacattctactagctactcaaatagggggaagcctgtcattttctaccagcagaccctatcagacagtcatttacctgaagaagctctgaaagttccacctgttcctggaccagatgcccagaagactgagacaccatcagtatcctctagtttatactcatatagagagaagcccattgtcttctaccaacaggccctgccagacagtgagctaactcaagaagctctgaaagtttcagctgttcctcaaccagctgaccagaagactgggttatctactgtaacttcctctttctattcacatacagagaagcctaatatttcttaccagcaagagttgccagatagtcatctaactgaagaggctctgaaagtttcaaatgttcctggaccagctgaccagaagactggggtatcaacagtaacctctacttcctactcacacagagagaagcccattgtttcctaccagcgagagttgccgcattttactgaagcaggtttgaaaattttaagagttcctggaccagctgaccagaagactggaataaacatcctgccctctaattcctacccacagagagagcactctgtcatttcttatgagcaggagttgccagatcttactgaagtaactttgaaagcaataggggttcctgggcctgctgaccagaagactgggatacaaatagcatcctctagttcctactcaaatagagagaaggccagtatttttcatcagcaggagttgccagatgttactgaagaagctttaaatgtttttgttgttcctggacaaggtgaccggaagactgagataccaacagtacctttaagttactactcacgtagagagaagcccagtgttatctctcaacaggagttgccagacagtcatctcacagaagaggctctgaaagtttcacctgtttctataccagcagagcagaagactgggataccaataggactgtctagttcctactcacattcacataaagagaaactcaagatttcaactgtgcatataccagatgaccagaaaactgagtttccagcagctacccttagttcctactcacaaatagagaagcccaagatttcaactgtgattggaccaaatgaccagaagactccatcccagacagcttttcatagttcctattctcaaacagtaaagcccaatattttatttcaacagcagttgccagatagagatcaaagtaaaggtattctaaagatttcagctgtccctgaactaactgatgtgaatactggaaaaccagtatctctctctagttcttattttcacagagagaaatcgaatattttcagtccacaggaattgccaggtagtcatgtaactgaagatgtgctgaaggtttcaacaattcctggaccagctggccagaaaacagtattaccaacagctcttcctagttccttttcacatcgagagaaaccagatattttctatcaaaaggatttgccagatagacatctaactgaagatgctctaaagatctcaagtgctcttgggcaagctgatcaaattaccggattacaaacagttccctctggtacttactcacatggtgagaatcacaagcttgtttcagaacatgtccaaaggctaatagataatttgaattcttctgactccagtgttagctcaaataatgtgcttttaaattctcaggctgatgacagagttgtaataaataaaccagaatctgcaggttttagagatgttggctctgaagaaatccaggatgcagaaaatagtgctaaaactcttaaggaaattcggacacttttgatggaggcagaaaatatggcactgaaacgatgcaattttcctgctccccttgcccgtttcagagatattagtgatatttcatttatacaatctaagaaggtggtttgcttcaaagaaccctcttccacgggtgtatctaatggtgatttgcttcacagacagccattcacagaggaaagcccaagcagcaggtgcatacagaaggatattggcacacagacgaatttgaaatgccggagaggcattgaaaattgggagtttattagttcaactacagttagaagtcctctacaggaagcagagagcaaagtcagtatggcattagaagaaactcttaggcaatatcaagcagccaaatctgtaatgaggtctgaacctgaagggtgtagtggaaccattgggaataaaattattatccctatgatgactgtcataaaaagtgattcaagtagtgatgccagtgatggaaatggttcctgctcgtgggacagtaatttaccagagtctttggaatcagtttctgatgttcttctaaacttctttccatatgtttcacccaagacaagtataacagatagcagggaggaagagggtgtgtcagagagtgaggatggtggtggtagcagtgtagattcactggctgcacatgtgaaaaaccttctgcaatgtgaatcctcactgaatcatgctaaagaaatactcagaaatgcagaggaagaggaaagccgggtacgagcacatggtaagaagaaagtttcaggcttataaacgttatagtttaataatgtgtttaaagttagatatttatgttttgaggaagcttagccaatgaaaaatacaagcaagatcaagaaaaaaaatgaagttagatatttggagttctaaatgtattttccaatagaattgttagaatgactatatttcttctaacaatccataaaaagcctatttaaccaataatgtagttaagttacagtattaatagtaccagcctgagtttacgttcttgttcttaggagaagtagattctgatgtatgacagagagtaaagaggtcgcttgggctcctgagctcctaaagctatcacgtttctctaatcctcccattatagtatccttattctgaaggcagaaagagcctccaatttgctgtgctctaaattgctttttgtcctaaaactacatatattttctctttcccttttctaatagaactcttggtgttgatctcagacatttgaaaaaaaaatcaatgtattttatactaaaacttgggttagaggtttaaaagagaatatttacaaatctcattaatttctaatagaattccattaaaaacaaaaatctgtaagacaatatggggaatatattttgggaggcaatttaaaagcaatttaggcctacctagaaatcgtcccttgaggttaacttcctacgctgttccctgcacatttttattctacaaaaaaacctccaagttgtatttattacttttaaatatcagctgtcatggaattatgagtaattgtagcaggaactaaagggagaggtaaagaaactcatgattaaaaggaggattaagataaatatgattgattacccgatttaaagtggcttttttgtagaattatctatagagcatgacttaagaaaatcagactttgcagtgaaaggatctctgtcaagaatttctaataggttgtcataattgagaagaagacatactaagcattgcagtgggtattaaattgcatatattgatgatcttctgtgttgcaattgttgacaaattatcacttttgcattgtattatctcaagtgtatgctttctctccagcctggaatatgaagttcaatttagcacatgattgtggatactccatttcagaattaaatgaagatgacaggaggaaagtagaagagatcaaggcagagttatttggtcatggaagaacaactgacttgtccaaggtataaaagaaatctggaaatgaagaaagtaaatatgaaagaatgggtgatggaattaggatctcttacttgggcatcagttgagttgctgataatatttggctaaagccttttttggttttgtttttgagacagtcttgctctgttgcccaggctgaagtgcagcagtgcaatcacaggtcactgcagccctgaactcttagactcaaggaatcctcccacctcagcctctcaggtagctgggaccacatgtgtgtaccgccctgctcggctaatttttaaatttttggcagagacagggtctctacgttgcccaggctggtcttgaacgcttggattcaagcgatcctcttgccttggcctcccaaaatgctgggattacaggcatgagccactgtgcctaggcaggcatcttaatttttcaaaagttaagatataagtattagattcttacagtctagatatgttgtttttattgattccaaattcatattttgaaaaatttatcttcttagaaaaataagaactgatttgcttgttttatcaattttttttttaagaacagagaagactaaatgtcacccttattttctcttgaaagtggtatcttgaaatccagctattttcaaatgtttattttaaatacttgagtacacagctataatagcttatgtataaatggctttcattttaatagtacatattttccttctattaactatttcatatgtagaaaagagcatatatgaatcatttatgtaaagaatagcagcaagtaaaaataattcccatatatttactatcgagcttgagaaatagaacattaccaaatactgttgaagttctttgtttctcctttcccagtcatatcttttttatttcttattttgatatataatgattttccttctcttcagtatggttttgaactctaagatggaatcaatatgatacatattcttttgagaactaggtgtttcacacagtgttagggttttgagctgcttctatgtagatgtgcagagttttcatttgttccttattactgtacagtattccagtgtgtgattacatgataatttattctttctcctgtggataaggcattttgtctgctattttgcatagtaatagggtataataatgcctatcgtagagggttttggtgtggattatgtgagataatgcctataaaatgcttagtagaacgtgtgatgtctagttagtactcagtaactggcagctattattactattattaatcctgaaagaattgatatagctatcatgcaaggatttcatggcctgattcatacaaagtttcttagaaaactattctccagtgatatagtttatttggattatctcaattttggaaaagtttgaaaagtacaaattagattggattttaggttttacgtatatgcttgtgaaaaacaaaattgacaaaataataagaataataaaatgggcaattggttgtcttagcaccatttgtatatatgctgccaaagtgagcactatcctagcatcatttgtttaaaattacatagttttctcagtgatctgtgtttccctatttttaaaaattattttcttgcgttcatatttccagatccctcagcaagcaagttgccttcctttgggtagactctggtttgtctgtgtttttcttaaaataaggtgtcctgaattagatgaaacacaatttcacttctgatctgaccagcatgaagtatattcagtaattctctttctgtcaatgtactgtgagatctttaatggtcacagcataattgggcattaaaaaaaaccatgtactgctttcaaaacttaaagctgtaggaaaaaagcaaagcaaaacaaaccaaacaaaaaccatgaactgctgccaagattcctattctcatttcttgtatctatataatacttttttaaaaatcttcttatttttgagacagagtctcactttattgcccaggctggactgcagtggcatgatcttggctcactgcaacttctacatcccaggttcaagtgattctcctgcctcagcctcccgggtagctgggattacagctgtgtgagtggcgcatgacaccacatccagctgatctttgtatttttagtagagatggggtttcactatgttggccaggctggtcttgaactcctgacctcaagtgatccgcctgcctcggcctcccaaaatgctgggattacaggccattacgcctcgccctatgtaatactttttaactctcctgtatttctttttattgcttttatatcagtgttcaagcctattggaatgatttttaatcaaatttgatcatttattttattaaaatatccctttcagctttgtgccatttatatatttgataagtatttttatccaaattagcaataaaaatgtttactaagggctatggataaaaagtctaaaacttttggctgggcgcggtggctcatgcctgtaatcctagcactttgggaagccaaggtgggtggatcacttgaggtcaggagttcgagaccagcctggccgacgtggtgaaaccccgtctctactaaaaatacaaaaattacctgggtgtcatggtgcatgcctgtaatcctagctactcgggaagctgaggcaggagaattgcttgaacctgggaggtggagattgtagtgagccgaagattgtgccagtgcactccagcctaggcgacagagggagactttgtctcaaaaaaaaaaaaaaaaaaaaggtctaaaacttttgaataagattactctcacacctattttgagtacttcactatactgtcattcaaccatcttgtgtttcaccatcttatgattgacttttttcagtctattaactgagtagttgcgaaatagtgtttgtctagatatgccttgtccttagggaacccatattggccacactgtgtacggttttggaccttttatttttttaacttaaatatattaggatttccctttaaaacttctctaaaagcataatttcacaggtatgtaatatcccattgtatgaacataacaatttattcactaccctactgttggacatttattcattcattccaaaaatacatattgaatgcctgatatgcgccatcctcatctatagcctgaggacacaccactgaacaaaatagacaaacatttcttcatcatgagcttacattaaggaagagtatatgaataacaaccaaacaagtaaaataaatgtcagatggtgggataagagccagggagacaaagcagaatggtcaacacagaacctgagaaagaggtattgaattaaatatctgagtaaggtgagaaagtaaggcagttaacagtgacaagagcattccagacagaaatagcatgcacacagttgctgaggtaaagtgtgtgaaaggaaagggagtgttaaaggaaagggaggaggccagtgtgtttggagagtgagagtgaaagggagaagactagattgtggaaggcagtggttcttgacgggtagtaaatgcctcccaaagagatattttggaaaattatgtgatttttcttgggtcatcactgtaattggggattgtttctggaatgcagtagataggtgtcaggtatgttactatttctataatgtacaagacagttccacacaatgaagagttgtcccttgtcacatacagcttttgaatgtccctgtagatattaatgttgatgaaaaacctgttataaattacttcagtgtttgtcatgttttaaatgattttttttttagtatagggtgtttcttctgttttttctttctttcatgactgacatttttgaagagtacaacctagttactttgcagatttccctcaaattgaatttatctggtgttttatcatgatttgattcagatttgatttttatgtaggaaagccacagaagtgatgtgcttttcatgcttgtcaggaggcacattatgttgatttgtctcaatacttgtaatgttaactcataccacttagttaaggtggtatctgctggtttgtgtgttttacatattaattaataagttaataaatattagggagagattctttgagactgtaaatatctctagtttaggatctagtgtttatacttgcctgaataatttattaataaaatagctttaatttggttattgaaaaaaattccatcattgcttcaacatttcattggagttctgtggtaagttaaaagtgtcccttctccatttatttatttatatcattatggactcttggatttttcgtttactcaaagggtcacaacctatcactatcattgtttattttgatactcaaattatcccacacttgcccactggaaccattttaagctggttcctgtgtgttcttatgatcccatcatttcatgagcattcacccactttctgagctaggaagacactctaggaatatcttatattttcttttcaccaaccctagagctgtccatttctccaaggggcgctggttctttttagcagagagtggcatgtagaaactaagatctgtatgcttggtgtgcttattgatactatgatgctgttgcctttatgccctttcagcagacaatgtgtgtgtacataattacacgcacccccctctcccctgtaggcctgtttccttatctattacttttattataaaatgagagctgagtttatactagtacatccaattccattccagtactacagggttattctagcctttttttctttctttatttgtaactcacttccctgatagtaagaaacttggctcccattatcctccatatatttacttgtttaaactcccttgtatgtttctccctcagccccactgctcttcatgcctgcaacagattgaatttctttcccagccccaactctttcaacccacaagttttatatgtaatataattattattataccattccagatatttttaaatttccattatgatttctttcaacaatgaatggtgatatattaggatgataccttcagtgtgctgaaagaaaataaattatatctatctagaattgcatgtcagtgaaaatctgttttaagaatgtggtaatataaaaatgattttagacaaaaacagttcattcagcactcattaaaaaattcgggtggagccaagatggccaaataggaacagctccggtctacagctcccagtgtgagcaacgcagaagactggtgatttctgcatttccatctgaggtaccgggttcatctcactagggagtgccagacagtgggtgtaggacagtgggtgcagcgcaccattcacaagccgaagcagggcgaggcattgcctcactcgggaagtgcaaggggtcagggagttccctttcctagtcaaagaaaggggtgacagacggcacctggaaaatcgcatcactcccacactaatactgcgcttttccgacgggcttaaaaaacggcacaccaggagattatatcccgcacatggctcggagggtcctacgcccacagagtctcgctgattgctagcacagcagtctgagatcaaactgcaaggcagcagcgaggctgggggaggggcgcctgccattgtgcaggcttgattaggtaaacaaagcagcctggaagctcgaactgggtggagcccactacagctcaaggaggcctgcctgcctctgtaggctccacctctgggggcagggcatagccaaacaaaaggcagcagtaacctctgtagacttaaatgtccctgtctgacagctttgaagagagtagtggttctcccagcacgcagctggagatgtgagaatgggcagactgcctcctcaagtgggtccctgacccccaagcagcctaactgggaggcaccccccaggaggggcagactgacacctcacacgaccgggtactcctctgagacaaaacttccagaggaatgatcaggcagcagcatttgcggttcaccaatatccgctgttctacagtcactgctgttgtgcagccaccgctgctgatacccaggcaaacagggtctggagtggacctctagcaaactcccaacagacctgcagctgagggtcctgtctgttagaaggaaaactaacaaacagaaaggacatccacaccaaaaacccatctgtacgtcaccatcatcaaagaccaaaggtagataaaaccacaaagatgcagaaaaaacagagcagaaaaactggaaactctaaaaagcagagcgcctctcctcctccaaaggaacgcagctcctcagcagcaacggaacaaagctggatggacaatgactttgaagagttgagagaagaaggcttcagatgatcaaactactccgagctacaggaggaaattcaaaccaatggcaaagaagttaaaaactttcaaaaaaattagacgaatggatacctagaataaccaatgcagagaagtccttaaaggagctgatggagctaaaagcaaaggcgcgagaaccatgtgaagaatgcagaagcctcaggagctgatgcgatcaactggaagaaagggtatcagtgatggaagatgaaatgaatgaaatgaagcgagaagggaagtttagagaaaaaagaataaaaagaaacgaacaaagcctccaagaaatatgggactatgtgaaaagaccaaatctacgtctgattggtgtacctgaaagtgacagggagaatggaaccaagttggaaaacactctgcaggatattatccgggagaacttccccaatctagcaaggcaggccaacattcagattcaggaaatacagagaacgccacaaagatactcctcgagaagagcaactccaagacacattaattgtcagattcaccaaagttgaaatgaaggaaaaaatgttaaggacagccagagagaaaggtcggattacccacaaagggaagcccatcagactaacagcggatctctcggcagaaaccctataagccagaagagagtgggggccaatattcaacattcttaaagaaaagaattttcaacccagaatttcatatccagcgaaactaagcttcataagtgaaggagaaataaaatcctttacagacaagcaaatgctgagagattttgtcaccaccaggcctgccctaaaagagctcctgaaggaagcgctaaacatggaaaggaacaactggtaccagccactgcaaaaacatgccaaaatgtaaagactgtcaaggccaggaagaaactgcatcaactaatgagcaaaataaccagctaacatcataatgacaggaccacattcacacataacaatattaactttaaatgtaaatggactaaatgctccaattaaaaggcaaagactggcaaattggataaagagtcaagacccatcagtgtgctgtattcaggaaacccatctcatgtgcagagacacacataggctcaaaataaagagatggaggaagatctaccaagcaaatggaaaacaaaaaaaggcaggggttgcaatcctagtctctgataaaacaaactttaaaccaacaaagatcaaaagagacaaagaaggccattacataatggtaaagggatcaattcaacaagaagaactaactatcttaaatatatatgcacccaatacaggagcacccagattcataaagcaagtccttagtgacctacaaagagacttagactcccacacaataacaatgggagactttaacaccccactgtcaacattagacagatcaacgagacagaaagttaacaaggatacccagcaattgaattcagctctgcaccaagcagacctaatagacatctacagaactctccaccccaaatcaacagaacatacatttttctcagcaccacaccgcacctattccaaaactgaccacgtagttggaagtaaagcactctcagcaaatagaaaagaaattataacaaactatctctcagaccacagtgcaatcaaattggaactcaggattcagaatctcactcaaaaccgctcaactacctggaaactgaataacctgctcctgaatgactactgggtacataacgaaatgaaggcacaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaagaccgctagcaagactaataaagaaaaaaagagagaagaatcaaatagacacaattaaaaatgataaaggggatatcaccaccgatcccacagaaatacaaactaccatcagagaatactacaaacacctctatgcaaataaactagaaaatctagaagaaatggacaaattctttgacacatacaccctcccaagactaaaccaggaagaagttgactctctgaatagaccaataacaggatctgaaattgaggcaataatcaatagcttaccaaccaaaaaaagtccaggtccagatggaatcacactgaattctaccagaggtacaaagaggagctggtaccattccttctgaaactattccaatcaatagaaaaagagggaatcctccctaactcattttatgaggccagcatcattctgataccaaagccaggcagagacacaaccaaaaaagagaattttagaccaatatccctgatgaacattgatgcaaaaatcctcaataaaatactggcaaactgaatccagcagcacatcaaaaagcttatccaccatgatcaagtgggcttcatccctgggatgcaaggctggttcaacatatgcaaatcaataaacgtaatccagcatatacacagaaccaaagacaaaaaccacatgattatctcaatagatgcagaaaaggcctttgacaaaattcaacaacccttcatgctagaaactctcaataaatgaggtattgatgggatgtatctcaaaataataagagctatctatgacaaacccacagccaatatcataccgaatgggcaaaaactggaagcattccctttgaaaacaggcacaagacaggggtgccctctctcaccactcctattcaacatagtgttggaagttctggccagggcagttaggcaggagaaggaaataaagggtattcaattaggaaaagaggaactcaaattgtccctgtttgcagatgacatgattgtatatctagaaaaccccgttgtctcagcccaaaatctccttaagctgataagcaacttcagcaaagtctcaggatacaaaatcaatgtacaaaaatcacaagcattcttatacaccaacagcagacaaagagcgagccaaatcatgagtgaactcccattcacagttgcttcaaagagagtaaaatacctaggaatccaacttacaagggatggaaggacttcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctaccagtggtaatttatagattcaatgccatccccatcaagctaccggtgactttcttcacagaattggaagaaactactttaaagttcatatggaaccaaaaaagagcctgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccacatatctacaaccatctgatctttgacaaacctgacaaaaacaagaaatggggaaaggattccctatttaataaatggtgctgggaaaactggctagccatatgtagaaagctgaaactggatcccttccttacaccgtatacaaaaattaattcaagatggattaaagacttacatgttagtccgaaaactgtgaaaaccctagaagaaaacctaggcaataccattcaggacataggcatgggcaaagacttcatgtctaaaacaccaaaagcaatggcaacaaaagccaaaattgacaaatgggatctaattaaactaaagagtttctgcacagcaaaagaaactaccatcagagtgaagaggaaacctacaaaatgggagaaaattttcgcaacctactcatctgacaaagggctaatatccagaatctacaatgaactcaaacaaatttacaagaaaaaaacaaccccatcaaaaagtgggtgaaggatatgaacagacacttctcaaaagaagacatttatgcaggcaaaaaacacatgaaaaaatgctcatcatcactggacatcagagaaatgcaaatcaaaaccacaatgagataccatctcacaccagttagaatggcgatcattaaaaagtcaggaaacaacaggtgctggagaggatgtggagaaataggaacactttacactgttggtgggactataaactagttcaaccactgtggaagtcagtgtgtcgattcctcagggatctagaactggaaataccatttgacccagccatcccatttctgggtatatacccaaaggattataaatcgtgctgctataaagacacatacacatgtacgtttattgcggcactattcacaatagcaaatacttggaaccaacccaaatgtccaagaatgatagactggattaagaaaatgtggcacatatacaccatggaatactatgcagccataaaaaatgatgagttcatgtcctttgtagggacatggatgaaactggaaaccatcattctcagcaagctatctcaaggacaaaaaaccaaacaccacatgttctcactcataggtgggaattgaacaatgagaacacatggacacaggaaggggaacatcacactctggggcctgttgtggggtggggggaggggggaggggggagggatagcatttggagatatacctaatgttaaatgacgagttaatgggtgcagcacaccaacatggcacttgtatacatatgtaacaaacctgcacattgtgcacatgtaccctaaaacttaaagtataataataataaaataaaaaaattctaagtggttacctcagactaaacggaaataatctaatatgggaaatttgtgatgtaggaaatattaaagagcaaaagatgtgttaagtatgtggataaataaagctaaatacttaagtatatgaaacaaaaatactaggaccttcatgactgagatgaaatgttataaacttaaaatatatgacaacaatatcttacaggttagaagctgcataaatggagttaattttttccaagtttcttaagtgtttgggaaaaagctgttatttactttagcttgataactatatgtgttataatttctataataaccctgtcccctacatcataccttactacaaaattaatttgagatggatcatagactttactttgaaaggtaaaataaagtttcttgaaaatctcttcatgatgttgggttaggcaaaggtttcttaaacaagaacaaaaatacacttcataaaagaaaggattgctaaattgctcttcatgaaagttaagaatggtaatcaaaaggcagcatgaagagtgaaaagtcaagctacacagtggaagagggtatttcggatacatatatttgataaaggacataaattcagaatatataaggaagtcatgcaaatcaattattcctacccaaagacttcactaggtgtctcataaatgaagatatccaagtggacagtaagcatttgaaaacattgtcaatatcactgcctgtttggtaatgcaagttaaccataatgagatactgcttcatatcagagtagctaaaattaaaaagaacaatgctaaatattggtaaagttatgaagcaactggaatagtcatttattgctgatgggaaggtaaactggtacacaactcttaaaataatttatagttatttcataatggtaaacatgccttacctgggacacttcattcctacttctttttaggtacgtactcaagaactatcagtacatatgttcagtagaagacatggtcaataataattatagccccaaactgaaaactacataaatgtatatcaagagtagaatagatgaatcaattatgctttattcatccagtgaaatcctgtgtagccataaaagatagcaaactactactgcctcaacaaccttgaaagctgtcacacacgttatggttagcaaaaaagccagacacaaagagtcatactgaataattccattcatatgaaattcaaaaactaatcaatggtgagaaaagtgataagaatggttacctctggtggagtcaggtgtgtggtattgactgggaagacgcacaagaggtcttctcaggtataggaagtttttgtatatctggatatgggcagcatttacattgctgtcatcacatataaaaaataaactacctgacttcagatttgtacaccttattaaagatttattatatattaattaaaaggaaacattgaacaagagatacaattgaaatcatagaaaaggaactttaagaaggcaaccatttctaatcatagcaaaaactttataaaaagcatcaaggcataaatctaacaagatttatgagatcttttattggagaatagtaaaatttattttgaaaggctagtagaagtcctaagtacatagagaaatacactgtatttattaataagactctatatccacctagcacaaactgcttcaatgaatcaaggcagatgtttctttaaattttttttatcatggtaaaatacacaacacaaaatttacctcaactgtttttaagtgtacagtttactggtgttaagtacattcatattgttgtgcaaccaccaccaccatccgtctccaagactcttttcatcttgtaaaactgaaacttatacccattaaataataacttctcattctgtcttcccatctgccccaggcagccaccattttcctttttgtctcatatgattttgattactctgagtacttcctataaatggaataatacaatatttgtctttttgtgactggcttatttcacttagcctcatgtggttcatccatgttgtagcatatgttataattttgtaaagtgagtctgttgtagacagtatatagttggatcattctgccaatctctattgattaaatttatttacttttaaagtaattaacaataaggaggaacctgcttctgtcctttttctatttgttttctacatcaaggtacaaattttatgttcagatacaattccaaaccacgatgaggatttatcttaactgtcctctaccccacagaaatgcagaggccaacaaatcacatttgtaggctcctaaaggaaactctcttagattgcttgtcaaaaactgttgagatcattttggccccttccatgctatgagaacgagatccacactgtacccaatgatttactgacttctctcggcagaatactgtctcttctccttctctcttctgtttggtaatgaagagaagaaaagtttgaagtcagtactttatatcatttagtatatggaccaataactcaacaagtttagaaaaaaaaaccatgaagtaaactttacttatactctaaaataaaccaaaccaaactacgaaagtagtaaggaggaaattataaaataaaatctatcagttaatgaactagaaaacagaaaaatgatagaattgagcattaaaatctagatttggaccttggaaaaattccaaatcagcagacaagttctgactagctagaagatgagaaggaaaaacatacaatgtggtaaatgaaaaggagcatgccagatataccacttagaaaatttgaaataataggagaatataatgtataacatataactctcgttaggtataaaattttcatgaaatgactgattttcttagataatataattaaacagaagcgtgtaacagattaaacattatgagagagaaaaactttattgatcaaacatttggcttccaagaaaagtacctgacctagctcaatattaggtaacattatgaagtatttcctgggcatgataatgacattgtggttatatgataggtgaattatttagggtcgaagtgtcaaatcagtgtctttgtggagggataaagctttgtggagggataggggaaaatgttcgacaattgttgaatctaaatagaaggaattcacatgtttattttaacattctatcaactttttggtatactcttaacaaaaagaaaaaaacaatgcctgacttagatgtttatatgggtgactcaagctatcaagtaatggataactcctgtgccatataaacagttccaatacactaacaaaaacttcctaatttacttgaggacattaacaaaaacctcagaagacatacctgaaattatgaatcttttgcatcagtgtgatgtctccacttttatttctgattttatttatttgagtcttctagttttttcttagtctagctaaatgtttgttaacattgtttttaccttttcaaaaactaacaatttagttgatttcttcctgtttttctattttttatttctgctctaatttttattctttccttttttctgctaactttgggcttagttttgttcttttttttctagttccttgagatgtaaagttgagttgcttatttgagatctttcttcctttaaaaataggcaattatcattagaaacttccctcttagtcctgattttgcttcatcctgtaagtgttcatttgttgtgtttttgtcttttttaaaattttccttgatttcatctttgatccactggttgttttaagagtgtgttgttaattcccacataattgtgattttcccagttttccttctgttactgatttctaattttagtctattgtgcttgggaaaaaaaggttggtatcatttcagtcttcttaaatttgttcagacttgttttatgacttaatatgtgatctatcctggagaatgttctatgtgcagttgagaagactgtgtattctgcaactgttaggtggaatattcagtatatgtgtgttctgttcattattgaaaatggggtactgacatcttctactgtattgctaattgctatttttcccttcagttctgtcagtgtttgctttatgtatttaggtactctaatgttgggtgtatatatgtttatacttgtgatatcttcctaatgaattgactcttttatcatatgaccttctttgtctcttgggatggttttttatttaaagtctatatcgtctgatagtgtggccacacctgtgctcttttggttgctatctgcatggaatatattttcctattccttcacttttagcctgtgtgtccttaaatctaaagtgagtctcttctagatagtatatagttagatcttatttttaaaattaattcagccactatatgttttttgattagggagtttactccatttacattaaagtaattattgatagggaaagacttactagttccattttgttaattggtttctttcttgtagttgttttgtcccttttgtcctctcttgctgtcttcctttgtgatttgttgattttgctttgatccttccttttttttttttctttcgtgtatcttctataggtattttctttgtggttaccaaagtcttaacagaaaacaacttatagctacagcgaaagcaatttaaaaaaatagacaaacaggactgcatctaattaaaaagcttttgcacagcaaagaaaacagttaagagactgaactggtaatctatggaataggagaaaatatttgcaaaccatgtatctaatgaggggttaatatccaaagtatataaggaacacctgcaactcaacagccaaaaaaaaaaaaaaaaatccccaaaacaaaaaacaaataacctggttaaaacatgggtaaaggacttgaatgaacatttcttaagacatacaaatgtgtaaggtgctgtatatgaaaagatattcaatatcgctaatcatcaggaaaatgcaaatcaaaaccacaatgactgaacacttcatatctgttaggatggctgatatcaaaacaaaacaaatggtaacaagtgttggagaggatgtggagaaattagaaccctgtacactgtagatggtcatgtaaaatggtgtagctgctgtggaaaatagtatggagattccttaaaaaataagaatagaattaccatatgatcccacttctgggtacatatccaaaggaaatgaaatcagaatcttgaggagatcccatgttcacaatagcattaatcacagtagccaagatatataaacaagatgtataaacatctatagatgaatggataaagaaaatgtggtatatacatacaatggaatattattccaccttaaggaagtcctgctgtatgtgacaacatggatgaccctgcaagacattacactatgtgaaagaatccagtcacagaaggacaaatactgaatgatttcacttatatgaaatatctaaaaatagtcaaattcagaaaacagagagtagaatggtgattgccaaggactgggaggaaggggaaattgggaattgatgttaggtaggtatcacaggcaaagcagatagttcaatattgggaaatttataaacaagtttttacattagtagatctaatggagaaatgattatttcattaagctccaaaaagtatttgggaataaaaataaaatctgtaattaaaaatatttctttagagtagaatatttctttatagtagaataatacctcaaatatgataaagaatatgtatttgaaatttgcaatcagcataatcaaagtcaaatacttttgttatgcatataaaacatttgtgagaaaagtcatataatatggtggagtagggaactctagggctcttgcaaaaacacctaataagcttccagaaactatcagaattagttttcgtagaactctggaatttagttaacattaaaaaccaggaaaagtagggagctgtagcgctgcagaaacagaacactatggcaccttaaattgctcacctaccattccttgtgcctagatgaacaatgactttgaagacagcagcttatactcatggtgcaggctgttagcacgagaaggattagtacagatcttgctctcaaaaaattgtgatcgttttaacctgtctgaagtatctgaaggaccagtatagagcttccttttgttttacacagctcagagctttcctgggactggggtggcttgtctgtcatcacgtgtcaaaagtatttaaaagccagagtatcagctgtagaagcctgagtctggggataaaaattaggacaatgaataggtagacaaaaagccaggaaggaacggttgaaaaggagatacggggtggtataaggacttttaaatgcttttttgtatgctgagaaattgagaatgctacgtacatgcctaggattggacaactcctcagagaaggcttgagaagaccctaagctttcaccactagctgaccttcaggctctgcctaactaagtaggatgtgaaggctaagatatagttgtaaacagcctggcttagtgttgatggaatgccccaacacagagcaaaaaagactgggagtgttttttttctttcctattaccttttttctttccttggctgcaggtgtttaaggaacctgtcaaaatagtagttgaccctgaagctaagtgagcacagacttcagttccatgcacaacaaagaatgtaagctttatgaaatagtcactaaacaacacttacaacaagcagtaacagcaaactccagggaagggggagaatccagtatccagagttgtcactttataatattcaatatgtccagttttcaacaaattataaggcatgcaaagaagtaaaaaagtgtgactcattcaaaggaaaaaagagaaattaatgaaactatccctgaggaagcccaccttaaatgtactcaatgagctgaacaataccatcagcaaagaactaagggaaaccaagaaaaggatttcccaccaaaaagaaatatcgacaaagagaaattataaaaaggaaacaaatagaaattctgcagctgaaaagtacagtaacaaaaattctttagaaggattcaatagctgagtagtctgaacaaagaatcagtgaacttgaagaaaggtcagatgatttatttattcgaggagaagaaagagaaaagaataaagaaaatgaacagggctatgggacatccccaagcataccaacatatgcattatgggattcttagagggaagagagagagagagagagagagagagaaaggggcggtaataatatttgaagaaataatggttgaaaacttccctaatttgttgaaaaatgaatttcaaatgggttaaactcaaagagacccacaccatgtcacattatagtcaaattgttaaatatttagcatagatgttggttctattagtagaaatatactttccttaatgaagtcagctttaacagattttttttttaaatctggttttgaagtcataaaatacaaaactatgagcttcttacaaagttattcctgccgtaaatactgtggtaatttatatatttaaaaaattgagaatttttttaaaacaagtgtttccaaaagcttattgatttttaagtaagttttgtatcacatggtaatacgtttcttttatttgtagaaagtagatttttactttttagtgcttgttgactctgtgtgtgtgtgtgtgtgtgtgtgtgtgtgtgtgtgtgtctattggtttacatgacggtgaagaactacttatttcttttttggtttgttacatgaagtctttgacattgtttgtttgtttgtgacagggtcttgctcagtcaccgaggctggagtgtagtggctggatcttagctcactgcaatgtccacctcccgagctcaagctatccttccacctcagtctctcaaagtgctggtattacaggcttaagccactgcacctggctgatgtgtcattaagctggatgatgagagaataatataacctgataaaactcatgtagatcttttgagaagagataattttaattgtgaaatagcatctggaaatcagtaaaagacatattttagctaaccagtaatttcataacatctttatctcagtataatttactataatacataaggtttgcccatttaaagtgtatagtttatttatagaattttacaatagcataattttagaactttgttgtcattagcccctctcccccaattccctagccctaggcaaacaccagtccactttctctcccaattcttttttgccaattctggacattttatataaacagaattgtaatgtatgatcttttgtgactgccttcttttacttagcatagtgttttcaagagtcattcatgttatgttgtaatgtgaatcagtacttcatccctttttattgccaaattacatttcattgtatagatactttgtttactcattagttggtagacatttggattttccactctggccattgtgaatagtgctgctatgaacatagtgtttatgtgttagggtaggtgtttcatttctcttggttatatacctaacagtagaattactgggacatacagtaactccatgtttaacatgttgaggaacttctaaacttttttctgaagtagctgcactatttacattcccatgagcagtatatgagggtttcagtttctccacgtcctttccaacatttgtcattttctgtctttttgattatagcctggttgggtgttaaggggtatttattgtgttttttacctatttctaacaactaatggtgttgaacatcttttcatgtgcttattggtcatttatcttttctgatgaaatacctattcaaattctttacccatttataaatttatcactgtacaaatttgttgagttgcaagcattctttttatattctggatattagacctttagcagatttatggacttaccaatattttctcccattctgtagacttttttactttcttgatggtgacctttgatacgcaaaagttttaaattctgatgaactctaacttatcagacttttattctttgcacttttggtgacatatctaagaaatcagtgcataacccagggtcacaaagatttagtgttttcttctgagagatttagttttagtttttatatttagatctgtggttctatttgaggcaattaaaatttttatttttttaattgtgataaaatatacataaaatttatcatcttaaccattgttaagtatatggttcagtggcgttaagtacattcatattgttgtttaaccaatctctatagctttttaaatcttgtaatactgaaactctatatccattaaacaacaactccccattttccccttccccttaggccctagcaaccaccattctactttctgtctctatgaatttggctactctaggtaccttatagtagcagaatcacacagtatatgtctttttgccactggtttatttcattcagtagtatattcttaaaattcacccatgttgtactatatgtcagaatttccttcttttttgagattatattattccattgtatgtgtatgccacaaacaaaagtttatccattcatctgttgatagacacttgagttgcttctgccatttggctattgtgaatagtgctgctgtgaacatgcttgttataattatctcttcaaggtcctgctttcacttcttttgggtacagacccaaaagtggaattcctggatcatacagtcattctacttttaagtttttgaggaagctccgtactgttttccataagggctacactgtttacattcccaccagcagtattcgagggtactgatttctccacatccttgccaatacttgttattttctgtttttttttgtttttttttttccttcttaataatggctattctaacaggtctgaattgatgtctcattgtggtggtgattttcatttcccttatgattagtaatattgagcttcttttcatttttggttggccagttgtataccttctctggagaaatgtctattatttttgcctatctttgaatcaggttttgttgttgttgttcctgagttgtaagtgtcctttatatgttctggatattaaccttgcatcagatacagtgagtctttgcctcacatctttgttaagttcttggaaactgacctgtaagtgaagtgacgtatagcatagcaaaacaaactgatataagttaattgataaaacaagagttaagttcctatggtattcagtacattgtttcacttaaaggtgcaatttctaagtacctattgatgatgttaagtgaagacttattgtacatgatttgcaaatattttctcccattttctaggttaccttttcactctgttgatggtgtcctttggtgaacagaagttttaaattttgatttagtccaatttatcaacttttacttttgttgcctttctcctttgagtcagtttttatgtatggcatgcaaattcgtctttgcatatagatattgagttgtttcagcactgttgaaaagactcttctttccctgttgaattttcatgacctctttgctgaaaatcaatttaccataaatgttagtgtttatttctggactgtcggttctatgccattgatctacatgactgtccttatgccagcactgtgctgtcttgattattgtagctttggagtaagttttgacatcggaaagagtgagtcctccaacgatgtttgtcattttcaagattattttggctgttctgggtttatgatctgcttgtcaattactgaaaaaaaaaaggctaggcttttaataagagttgcattgaatctctagattactatgggaaatattaccacttgaatctctagattagtttaggaagtattaatctttcagtccataaacatgagccagttttctagttattttgattttcttccatttcattctatgttttttagtatactagacatatatttattttgctaaatatattctcaagtatttaattctttttcttgctgttgtaaattgaattttttttaaaaatttatttttggattgtgaattgctagtgtattaaaatacagttgatttttgtatattgcactggcatcctgcagctttgctgaacttattagtcttaattggtttgtcctggtttccttgggatttcctgtatgaagttcatgtcatctgcaaatagatatagttgtacttctttctttccaatctagatgtctttaatttctaacctggttgccctggcaatatgtaacatccaatatgatactgaatagaagaggtaagaatggccatacttgtcttgttcttgattgtagggagaaagcatctagcttttcattattcggtattatgttagcgctgagtctttcataggtactcttcatctggttaaagaaatcccttccattcctagtttgctgagaaattttatcacaaaaacgtattgggttttgttgaactgaacagtagcttttaagagcctgttacatatctaatgacatgtggttggtttgttgtaaaattacttggaaatggttatgtgaaaatactgaaatttacttggcaaatactaaagctacaagaatttttaaaatggaaaggttattatgaaagcttgaaagatgcaatgggaggaggtagagcatgaagtgttaaaaaatttgtaagatataattgttggaaaggaagaagagaaatatattttgggatgagtataaatctactcatgcatacttttaagaggctggaataggtttatgtttctcaaattcggatatttgcttcccactgatatgtcaggaggtatcaaggcaataagaagccacagaataaaaacaacattttttttgcccaaataaaatttttacatctatttttatcagctaatgacgaatatttttatttatttagtaatttattcgtttatttatttatttatttatttatttattttactttaagttccaggatacatatgcagaacgtgcaggtttgttacacaggtatacatgtgccatggtggtttgctgcacctatcaacccatcatttaggttttaagccctgcatacgttaggtatttgtcctaatgctctccctccccttgcccctgaccccaccgacaggccccggtgtgtgatgttcccctccctgtgtccatgtgttctcattgttcaactcccatttatgagtgagaacacgtggtgtttggttttctgttcctgtgttagtttgctgagaatgatggcttccggcttcatccatgtcccagcaaaggacatggtcttattcttttttatggctgcatagtattccatggtatatatgtgccacattttctttatccagtctatcattgatgggcaaaaagtggcatttttaaagtgttagttttgtccagtggtatttaattttttttaagtcaacattttgttttgaaataattgtagtttcacatgtgataaataatatagagatatcacatatacccttcacccaatttccccaagtggtaacatcttgcataactgtggtgatatatcacaaccacaacgttgatattgatacagccaagatactgaacatttacatcactacaaaggtgcctcatgataccttataatagctacttccacttctctcctgccccaccttttactgagctcctggcaaccactaatttgttcctttgtttctataactttgtaatttcaagaatgtcatataaatgataacatatagtatgcaaccttattgtattggcctttttttcactcagcatacttatctggagattcatccagactgttttatgtatcagtagtttttcttttttattgatgtatagtattccaaagtatgaatgcaccacagtttaaatattcactattgaaggacatcttggttgtttcccagtttttggctttaccagtacagctgctgtaaacattcatatgcaagtttttgtgtgaatatgtctttgtttctgtggggtagatgcccaggattgcaattgctgggtcatgtggtagttgcatgtttagttttttgaaagacaggccacacctttttccagggtggttatatcatttacattcccaccagcagtgtgtgagtaatccgtctactccatatcctcaccagcatttgatactgtcactatttttattctagtcattctaataggtatgtagtggtatcttattaagtttttaatgtgtatttccctaatggtttttgatgttgcacattttttaatatttctgtttccagtctctttctcctgttaagtgaaatgtctgtatcttttgcccattttctttttttatttttatttttatttatttatttttattattatactttaagttttagggtacatgtgcacattgtgcaggttagttacatatgtatacatgtgccatgctggtgtgctgcacccactaacttgtcatctagcattaggtatatctcctaatgctatccgtccccactccccccaccccaccacagtccccagagtgtgatattctccttcctgtgtccatgtgatctcattgttcaattcccacctatgagtgagaatatgcggtgtttgctttttgttcttgcgatagtttactgagaatgatgatttccaatttcatccatgtccctacaaaggacatgaactcatcattttttatggctgcatagtattccatggtgtatatgtgccacattttcttaatccagtctataattcttggacatttggattggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacattgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatgtccagtgatgatgagcattttttcatgtgttttttgtctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggtttcctgttcactctgatggtagtttcttttgctgtgcagaagctctttagtttaattagatcccatttgtcaattttgtcttttgttgccattgcttttggtgttttagacatgaagtccttgcccacacctatgtcctgaatggtaatgcctaggttttcttctagggtttttatggttttcagtctaacatgtaagtctttaatccatcttgaattaatttttgtatacggtgtaaggaagggatccagtttcagctttctacatatggctagccagttttcccagcaccatttattaaacagggaatcctttccccattgcttgtttttctcaggtttgtcaaagatcagatagttgtagatatgctgcattatttctgagggctctgttctgttccattgatctatatctctgttttggtaccagtaccatgctgttttggttactgtagccttgtagtatagtttgaagtcaggtagcgtgatgcctccaggtttgttcttttggcttaggattgacttggcgatgcaggctcttttttggttccatatgaactttaaagtagttttttccaattctgtgaagaaaggcattggtagcttgatggggatggcattgaatctgtaagttaccttgggccgtatggccattttcacgatattgattcttcctacccatgagcatggaatgttcttccatttgtttgtatcctcttttatttccttgagtagtggtttgtagttctccttgaagaggtccttcacatcccttgtaagttggattcctaggtattttattctctttgaagcaattgtgaatgggagttcactcatgatttggctctctgtttgtctgttgttggtgtataaggatgcttgtgatttttgtacattgattttgtatcctgagactttgctgaagttgcttatcagcttaaggagattttgggctgagacagtggggttttctagatatacaatcatgtcatctgcaaacagggacaatttgacttcctcttttcctaattgaatagcttttatttccttctcctgcctaattgccctggccagaacttccaacaccatgttgaataggagtggtgagagagggcatccctgtcttgtgccggttttcaaagggaatgcttccagtttttgggcattcagtatgatattggctgtgggtttgtcatagataactcttattattttgaaatacgtcccatcaatacctaatctattgagagtttttagcatgaagtgttgttgaattttgtcaaaggctttttctgcatctattgagaaaatcatgtggtttttgtctttggctctgtttatatgctggattacatttattgatttgcatatattgaaccagccttgcatcccagggatgaagcccacttgatcatggtggataagcttttcggtgtgctgctggattcagtttgccagtattttattgaggatttttgcatcaatgttcatcaaggatattggtctaaaattctctttttttgttgtgtctctgcctggctttggtatcagaatgatgctggcctcataaaaagagttagggaggattccctctttttccattgattggaatagtttcagaaggaatggtaccagttccttcttgtacctctggtagaattcggctgttaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcatagaggtgtttgtagtattctctgatggtagtttgtatttctgtgggatcggtggtgatatcccctttatcatttttaattgtgtctatttgattcttctctctttttttctttattagtcttgctagcagtcttttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttgtgccttcatttcgttatgtacccagtagtcattcaggagcaggttgttcagtttccatgtagttgagcggttttgagtgagattcttaatcttgagttctagtttgattgcactgtggtctgagagatagtttgttataatttctgttcttttacatttgttgaggagagctttagttccaagtatgtggtcaattttggaataggtgtggtgtggtgctgaaaaaaatgtatattctgttgatttggggtggagagttctgtagatgtctattaggtccacttggtgcagagctgagttcagttcctgggtatccttgttgactttctgtctcgttgatctgtctaatgttgacagtggggtgttaaagtctcccatgattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcacactgatgggtcttgactctttatccaatttgccagtctttgccttttaattggagcatttagtccatttatatttaaagttaatattgttatgtgtgaatttgatcctgtcattatgatgttagctggttattttgctcattagttgatgcagtttcttcctagtcttgatggtctttacattttggcatgattttgcagcggctggtactggttgttcctttccatgtttagtgcttccttcaggagctcttttagggcaggcctagtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttatagggtttctgccgagagatccgctgttagtctgatgggcttccctttgtgggtaatccgacctttctctctggctgtccttaacattttttccttcatttcaactttggtgaatctgacaattaatgtgtcttggagttgctcttctcgaggagtatctttgtggcgttctctgtatttcctgaatctgaatgttggcctgccttgctagattggggaagttctcctggataatatcctgcagagtgttttccaacttggttccattctccccatcactttcaggtacaccaatcagacgtagatttgttcttttcacatagtcccatatttcttggaggctttgctcatttctttttattcttttttctctaaacttcccttctcgcttcatttcattcatttcttcttccatcgctgataccctttcttccagttgatggcatcggctcttgaggcttctgcattcttcacatagttctcgagccttgtttttcagctccatcagctcctttaagcacttctctgtattggttattctagttacacattcttctaaatttttttcaaagttttcaacttctttgcctttggtttgaatgtcctcccgtagctcagagtaatttgatcgtctgaagccttcttctctcagctcgtcaaagtcattctccatccagctttgttccattgctggtgaggaactgtgttcctttggaggaggagaggtgctctgctttttagagtttccagtttttctgctctgttttttccccatctttgtggttttatctacttttggtctttgatgatggtgatgtacagatgggtttttggtgtggatgtcctttctatttgttaattttccttctaacagacaggaccctccgctgcaggtctgttggaataccctgccgtgtgaggtgtcagtgtgcccctgctgggaggtgcctccctgttaggctgctcaggggtcaggggtcagggacccacttgaggaggcagtctgcccgttctcagatctccagctgtgtgctgggagaaccactgctctcttcaaagctgtcagacagggacatttaagtctgcagaggttactgctgctttttgtttgtctgtgcccttcctccagagatgtagcctacagaggcaggcaggcctccttgagctgtggtgggctccacccagttcgagcttccaggctgctttgtttacctaagcaagcctgggcaatggcgggcgcccctcccccagcctcgctgccaccttgcagtttgatctcagactgctgtgctagcaatcagcgagactccgtgggcctaggacgctcggagccaggtgcggggtataatctcgtggtgcgccgttttttaagccggttggaaaagcgcagtattcgggtgggagtgacccgattttccaggtgcgtccgtcacccctttctttgactaggaaagggaactccctgaccccttgcgcttcccaagtgaggcaatgccttgccctgcttcgtctcgcacacggtgcgcgcacccactgacctgcgcccactgtctggcactccctagttagatgaacccagtacctcagatggaagtgcagaaatcaccgtcttctgcgtggctcacgctgggagctgtagaccggagctgttcctattcggccatcttggctcctgtccctcttttgcccattttttaattggattgtcttttttttccctttttactgttgtgaattgtatatatatgttagtatatatgttagatgtaaggctagcagatacaagacctttgttggatatgaggtttgcaaatattttcttgtaacctgtagctgggagagagaggggcattttgttttgctggatagtctaggtaggcttcgctagactttcactgacgccgcaaggaagggatagcactttatcagccagcagagatgaaagtaagtcctgggttcctcacttggcctttgctggtgttggtgtgagtgggtctagttttttctgtgatggttggctggagtagaatggttattatttaaaagttctctcttttgctaggcttcacctctactgggtttttagctagtgagaaaagctcttgttagggttttttgtctgtgtccattgttcctgggtagctgacttcttcagctccaagtctgtatatgcaagagaaaaagaaaacccagtgattgcaccacagcataattcctcaggtccctagatctctagctaatctacgttcttctctacatctttcagattcttcttacatttgttttatatatattttccagtgggctgaattatacttagcaggagaaatagggaaaagtacatctggccaggcgcagtggctcatgcctgtaatcccagcactttggggaggctgaggcaggaggatcccttgaatccaggagttggagaccagcctgggcaacaaagtgagacccagtctctacaaaaataaaaataagaaaattagcccggtgtagtggcatgtgcctgttgtcccagctatccaggaggctgaggtggcaggatcgcctgagcctgggaggtcgtggcttcagtgatagtgccacagcattccagcctgggtgacacagcaagaccctgtcttaaacaaagaagaagagaaaagaaagaaaaatgtcacaggatcctcagggtgtcagtttgcaagctggaaaccactgtggccagcagcaccttctgcctgagtattgttcacactgctgggcacattctccgcacttggcctggcaggctgtgcttggctcgcactactatgctatgtcttacacctgccaagcatgagccaggtgtggagtggtgaggggtgtgtgggcaagcaagtgtggggtctagccactgtacacagccaggcatgctgacggctgtggtagggcaggcagctccagtgctggcactggtgctggcgccacgcaaggctgcagctggaccagatgtactgtgcgtggcttctgctgtgggcacccacatctgggtgagggaaatgtggtggtggcaactggaagcttggaagacaccaggaaccacaaaaccccaaagagggtgtcatagtcctggctcagggaccccctaggtctgggcttcccgaaaggccacagcttgtctcttcttcttgttccctgcaacatggcaggcggggagggggcatgtttcagccctgtttgtgttacagctcttttagtcccaccatttggtggatcctgagctcttgtcctgcatccatgaagaatgaggtatgtggacaactggagggtgagcaagatggagaggagtttcatcgagtggcagaacagttttcaggagacccaaagtgggtagctcctttctgcaggcaggtcatcctgatgactgtccatctgtcagtggagaggagaacctagagtgggtagctcctacctgcatgcaggtcatcccataatctgcatctttcagcagagaagagacccggagtggctagctcctatctgcaggcaggtcattccattgtctctccaagtctggctgagtccagggtttttatgggcttcaaaggggaggagatgcatgccaattggtccatgggcaggcccggaaaaagcactataagttctcctttctgcgaaactggcagcccttcaacccatccctggcttaaaggtggagcttcactggtgacctgcccctttctgcccaggagcctgtctgccatctctgccatctacggtacccatggcacacccaggctgtttatgtcagggggcgcctgcaggcccactctgagctgccctcagccctccctgcccctgcaacctccctcctgtgcttgtgggtgcccagtgtctggaggggcggcagggggctggtgtgacagtgctgtcccaagtgtgcgcacacctggctgggtcgcaacagtgcctggacttggcctcaactttgctgtgtaattggagcgggaaccaggagtggggagaggcctggcagtgggagcaggcacttctgagcctgcaggggcagggggagttcccagatccccgaaagtgcagtggtgcctgggtctacagctgtgactgggcagctgcagctgtgcccaggagggtggggttcctgcccctccaactcagaagggagtggggcttctgcctgttcctggctcccaccacctcagtacagcgagtagccctagctgttccttccccactgcagctggcatcattgcagcagccactccagatgggatgccgctgccatcaaaaatatatctactccatcacctggggagatgcagcataatttaaaatatttttatctgaaatcagatgttgctatatcatcaaatagaatgccaagttataatgactgtataggtaaaatacagaaatctcaaagaaatgttatatttatggtagctttgagtactgatcctatgcgccaggaaacaaggtcttggttttttccccccattgttaggggtaaaatattaggatgtaggtcaagcttctgtaatagccaaacatagagtggctcaaataagatagaattttattttttcacgtcattgttcatgttaggaaagtgagctctgttccttgatgtcatccagggacccaagctggctggacaactaagctgtcttacacatgacttccaaggttgttccatgcattaccattttcaggaggcaagaaaaatagtgatgatagtggtggtgatattgggggaacatgcaggtcaagaacttgattttaaggacaggaagcagaagttgtacttgatgccttcattcatatcccattggtgtcagtctagtaatgtggttacaactagctgcagaagaaacaggaaatgtctcccacttggtggctatgtggccagcaaaaatttgagtaaggcatttctattattaaaagaaaggtgagaatacttactggtggacaatagtaatctttgctgtttactttagtggaaattttttagaagaactctctgagtggtcttaatcattgtgagccattttattctgtagttaactgtcttttttgcttgctgtgctctttgtcctgttatattataaaagaatgacatgaccttcatggtctaatcttagcgtgggtataaaactgatttgtataaaactgatttgtttataactacttggactacttcaaataagaacctgtttgtttgtatcttctagggtttacagagtccacggggaatgggatgcaagccagaagctgtatgtagtcacattattattgagagccatgaaaagggatgtttccggactctaacttctgaacatccacaactagatagacacccttgtgctttcagatctgctggaccctcagaaatgaccagaggacggcagaacccatcatcatgcagagccaagcatgtcaacctttctgcatccttagaccagaacaactcccatttcaaagtttggaattccttgcagttaaaaagtcattccccatttcagaactttatacctgatgaattcaaaatcagcaaaggtcttcgaatgccattcgatgaaaagatggacccttggctgtcagaattagtagaacctgcttttgtgccacctaaagaagtggattttcattcttcatcacaaatgccgtccccagaacccatgaaaaagtttactacctccatcactttttcatctcaccgacattctaaatgcatttccaattcctctgttgttaaggttggtgttactgaaggtagccagtgtactggagcatctgtgggggtatttaattctcatttcactgaagaacaaaatcctcccagagatcttaaacagaaaacctcttccccttcatcatttaaaatgcatagtaattcacaagataaagaagtgactattttagcagaaggtagaaggcaaagccaaaaattacctgttgattttgagcgttcttttcaagaagaaaaacccttagaaagatcagattttacaggcagtcattctgagcccagtaccagggcaaattgtagcaatttcaaggaaattcagatttctgataaccatacccttattagcatgggcagaccaagttccaccctaggagtaaacagatcgagttccagactaggagtaaaagagaagaatgtaactataactccagatcttccttcttgcatttttcttgaacaacgagagctctttgaacaaagcaaagccccacgtgcagatgaccatgtgaggaaacaccattctccctctcctcaacatcaggattatgtagctccagaccttccttcttgcatttttcttgaacaacgagaactctttgaacagtgcaaagccccatatgtagatcatcaaatgagagaaaaccattctccccttcctcaaggtcaggattctatagcttcagaccttccgtctcccatttctcttgaacaatgccaaagcaaagcgccaggtgtagatgaccaaatgaataaacaccattttccccttcctcaaggtcaggattgtgtagtggaaaagaataatcaacataagcctaaatcacacatttctaatataaatgttgaagccaagttcaatactgtggtctcccagtcagccccaaatcactgtacattagcagcatctgcatctactcctccttcaaatagaaaagcactttcttgtgttcatataactctttgtcccaagacttcttccaagttggatagtggaactttagatgaaagattccattcattggatgctgcttctaaagcgaggatgaatagtgagtttaactttgacttacatactgtatcttcgagatcactggaaccaacctccaaattattgaccagtaaacctgtagcacaggatcaagaatctttaggttttctaggacctaaatcttcactggatttccaagtcgtacagccttctcttccagacagtaacactattactcaggacttgaaaaccataccttctcagaatagccagatagtaacctccaggcaaatacaagtgaacatttcagatttcgaaggacattccaatccagaggggaccccagtatttgcagatcggtgagtctcattgtgataacaagcaagctggatggactttgtaataaagggtttcaaatacttaagtagatatcggttcttgggggaaaggccgtgtgatttctctgagtggaggttgtgtctggctaattactagaagtctttcaaggaataaatgtgttaagtaagagagaacatgtgacagtaatgcatttatatttcagagggcttttggcaagacttgacatcaagtgtttttaaaaattgaatgaccttgaaaagaatctttgatcatccaatgatacaattacgaatttatttactgtgttggacatatgctgaagatctcctttggaggttgcacacacatacatgggtgcttggtcactctctctcccgctctccctctctctctctcttctccagctctctggttccatttcatgacttccctcaaatatttagtatttacaaagaaagtggctttacagtggaaaatcctggcagataccagtttagtcaaatgatgaagattagcatcgccagtaaaacatctgtcaacataatgtgctccctgatatgatgccccacctcatagagtattgtaggaaaggaaacccaattcagggataagttcgttagatttatattattcagcccaattttagcacattgccattaattcagttttacttaatgagcctcttatgatatggtgaagcagaactacctgtatgtttagtattttaccttatagttgaagaggcatcgtaccacagtggagagcgctaggcttggaaaggaggaagaaagaaatgtttattcataatctacatgtggtagtagtcatggcaataaggaacttagatatgctatcctacttagttctcatcatgatcctatgaagcaggtgatgatatctctattttcctactgggaaatcttttgtgccaaaagatgttgtttgtgggcaagagaaagagcattcaaatgcattctgtttaatcagagtaaggatttgttcctctacacagtactctgtcctagaatttgaaccctaattccaacacttccaaccatgatgctggacaactgatttaatatccttggcactcatatgtagaaggaaagggttggaatgctgaaaagtcccttatagctctaaaagttagggattgagataatagattggggcaaaaaaacaaggtcaatctctgatttcaatgttaaaaatagtagagtgccatagagatcagtaatgatacctttaaaatttttttctttgagacagagtctcgctctgtcacccaggccagagtacagtgatgtgatcttggttcactgaaacctccgccccctgggttcccgtcccgcctcagccacctgaatagctgggaccacaggcgtgcaccaccatgcctggctaatttttgtatttttagtagagacgaggttttgccatgttggcaaggctggtcagtattgatacttaaaaaaaaaaaaaaaagtttagaaattaaaacattgacaatttcatatacaatttttaaactcttcaaaggttaaatgctaaggtattgtactgaataccttaaaaatgagataaagctatgaatgagaagaaagtaatagatgattatatatatgaactaacaataatgccatttgttcagggtgtacgtttgtagtggatgcttatattatacttagtgtaataatcagaaatagatattattacctcagttgtggatttaaaaaacctgagacttagagaaaatattttgcccaagatcacatggccattgagcattggaggtggcatttgaacctaggtttatcaaactccacagtccataaataaggcaaactacacacacacacacacacacacacacacacagatgcataaaacatatatatataagtaaatatatatataataccttataaaatatttataaagggctgggtgcggtggctcacacctgtaatcccagcactttgggaggccaaggtgggcggatcacctgaggttgagaatttgagaccagcatgatcaacatggagaagccccatctctactaaaaatacaaaattagctgggcatggtggcacatgcttgtaatcccagctactcaggaggctaaggcaggagaatcgcttgaacctgggaggcggaggctgcagtgagccaagattgcaccactgcactccagcctggcaacaaagcgagactctgcctcaaaaaaaaaatttataaagtatgtatgtataaaatatttataaagtatatgtgtataaaatatattcaaactttttcattttgagataattttagacttaggagttgcagaaatagcacagagagtttctgtattatctattgctgtgtatcatgttaccctgaaatatagcaacttaataaacgtgaaaatttatgtaggtcagaaatctaaatgtagcttatttgggtacttctggcttaggttgtctcagaacgttgcaaacaaggtattggctgcaaatgtggtctcatcacagggcttgcctgagaggatatgcttccagcctcactcacatggccatggctttggccagagacatgggctttttgattctataaggcactcataatatgacacctaagcttcccttagtgaggcagtgagagggcaagagagggtgcccaaaacaaaagccacagtctttttgtaacctacccttggatgtgtcatctcgtcacctctgccacattctcttcagtagaaatgagtcactgtctaaagctctcacccaagggttgggaattccacaaggtcctgaataccaggaggtagatgtcattgggggatatgttagaggttgtccatgtaacctttactgaagcttccatttatgttaacatcttaccgtaacatcataaccataaaatatttatcaaaataagaaattattattggtgtaaaactatatagtctaacattgatttcaccaggtttttccacaaatgaaccttttttgtttcagatccaacccaggattccgtcttgcattttagttgtcatgtcttagactcctccaatctatgacagtttcccagtctttttttgtctttcatgaccttgacgctttgaagagtgctaatcagttattttgaagaagcttcttcaatttagcattgtttgatggttcaaggttagattagggttatgcattctcaacacgtcacaacagagagcacattatgttgatatacattactggtgatgttaaccttgatcacttggctaaagtggtatctgctaggattctccactgtaaggttattgtttttcctttggagatactaaacatttgagggagattttgttagactatacaaataacctgtttctgcttaaactttgactactaattttagcattcatgagtggatcttggctgtagcagttattactctggtgttttaatttttttatgtctgtcatctcttttacatttgttaattggaattcttctgtaaggagaattgttcttccctcatttattccgccctaggttatttatttacattactgtagactcattagtgtttatttcattatttggattataatccaatgctaccattactgttttgttgctcaagttctctttttagctctttagagcacttttaggttggctcctgtaccctgccccagagctggaatcaactgtttcattaaaaatccctctttttattgttgttgttgttgttgttttctttctttttgagccggagtcttgctctgtcacccaggctggagtgcagtggcgtgatcttggctcactgcaacctccacctcccgggttcaagcaattcacctgcctcagcctccagagtagctgggattacaggtctgcaccaccaaacccagctaattttctgtatttttagtagagacagggtttcaccatgttggccaggctggtcttgaactcctgacctcaggtgatctgcccacctcggcctcccaaaatgctgtgattacagacgtgagccaccatgcccagccaaaaaaccctcttatttttgaagggaggaaggagtacagtatttagaaagcaagatgtaaggacctggcatgctcattgctggtgggatgttgctgtgtctagcctttctcagtgaataaagctaagaaatataggtagatttgtaaatttatgtgtatactcatatctgtatcttttaacgtgtgtgtgtgttttaaatcatgtgtccatattgatacctctgactctagtacagatccacaaggttgattctagcctttcccctttctttatttgtaacttctgtctctaatagcgataaaactggctctcattatctgtaatatatttaccctaatatataaatagtttcagaattcatagcccctacccacatgaaaaacaaattctgcatctagagtacagtgtttatctgcagtttcgaagttatcattaaaatatctagacaaaaatgctgtttgctaaagtttcttaagtcagcatctcccttccccatattcttcagtatgagtacgtgattcatttataatatagattcattagtcacattctgcattccatctttgcctcatatcctggttcacctttgaaaatttccgtacttataaatttcactttctgtgctttacaattctatccattgctacagtttcatatgagcagttccatcaatccccaaattcccctatgccgttcctttggagacagtctttcctctgatccctcacccctggcagtccctggtctgtattcttccttagagttttgcctttctagagtgtcacacaaatggaatcataaaatatgtaacagccttttgggtctgaattttttactttgcaaaatgcatttgacacatccatcttgtgtggatcagtagtgcttttttattgctttattaaatgcagtaatattttattgtaattgagtttgtttatccattcactcactgaaggatatttgagttgtttctagtttgggaccattaaaattagaactgctgtaaacatttatatacaggtttttgtttctctacagtaaatactaagaaagaggattcctgagttatatggtacaggtgtatatttaactttgtaagaattattcagagctaaactaatactggtttttcagagtgtctgtatcattttgcattcctgctagcaatgggtgagcattctagttactccacatcctcaccgatgtgtaaattgtcaatatattttagccatttttatagttgtacagtggtatctcaacatagttttaatttgcatgtccttccttaatggctaattattatgaacaccgtttcaagagcttatttgccatcctcttcggtgaagtgctttttaaatagggttgtttgctttcttattggtgagttttgagagttcttaatatattctggatacgagtcttttctggatatgttatttgcaaatatctcttcacagtatgcgacttgtcttcttatcctcttaaaaaaggctttcaaaaaacaaaggtgtttccttttgatcaagtccaattaattgatttttaaatggatcgtgtgattgggttggcaatactttcctttcagcacttaaaaaatatgctccttccttctggattccatggtttctggcaaaaaattcatagtcatttgagtcattgttttctatgtaagaacaatgtgttatttttctctgattattttaatttttttccagcacattgattatgcttctagatatgggtttcttcttttttttaatttttaaattttcatttcagtagtttttgggataaaggttgttttggttacatggataagttctttagtggtgatttctgagattttagtgcacccatcacccgagtagtatgcacaccatacccaatatgtagtttttttaagcccataggtttacaggcatacctcagatatattgcaggttcagttccagaccactgcaataaagccggtcacctaaattttttggcttcccagtgcatgtacaagttatgttaacactatactgtactctatgaagtgtataatagcgttatgtctaaaaaaatgtacctaccttaatttaaaaattgtcgttggttgatgggcacttaggtttttatgagttacttcacttagaataatggcctccagctccatcaaagttactgcaaaagacattatttcattcctttttatggctgagtagtattccgtggtgtatatataccacattttctttatctactcattggttgatgggcatttaggtttttatgtctttgcagttgcaaattgtgctgctgtacaagtgtgtgcacgtgtctttttaatgtcttctttttctaggtatagatttctttggtacatcttgtttggggtttgctgagtttttttaagcctataggtttacaggcatacctcagatatattgcaggttcagttccagaccactgcaataaagccgatcacatgaattttttggtttcccagtgataatacaagtgatgtttacactatactgtactctattaagtgtataatagtgtcatgtctaaaaaaagtacataccttaatttaaaaattctttattgtttaaaaatgctaacaattatttgaaccttcagtgagttactttttgctggtggcagtcttaccttgatgttggtggctgctaactgctctgggtggtgattgctaaagattgaggtggctgtagaaatttctttttttttttctttttaattttcattggtacatagtaggtgtatatgtttatgggtacatgagatgtttgatacaagcatgcagtgtgaaataaggacattgtgaagaatggggtacatcccttcaagcatttttatccattgagttgcaaacaatgcaattacactaagttattttaaaatgtacagtcattatttactatagtcacccttttgtgttacatagtaggtcttattcattctttctattttgtgtgtgtgtgtgtgtgtgcccattaaccatccccatctctccccaaacccctcactacctttctcagcctctggtaaccatccttctactctctatgtccatgagttcaattgtttggatttttagattccacaaataagtgacaacatgcagtgtttgtctttttatgcctggtttatttcatttaacgtaatgatctctagttccatccatattgttgtaaatgactggatctcatcattttctatgtctgaatagtactccactgtgtatatgtaccacattttcttacccatctattgatggacacataggctgcttccgaatcttagcttaccacaaacactgctgcaacaaacatgggattgcattgaaactgtagattgcttttgagtaacaaaatcagtcttccatatactgatttcctttcttttgggtatatactcagcagtgggattgctggatcatattgtagctcagtttttagtttttttaaggaacctccaaactattctccttagcaattgcactaatttacattccaagcaatagtatacaagggttcccttttctccacgtcttcaccagcatttgttattgcctgtcttttccatataagccattttaactggggtgagatgatatctcattgtagtttttagttttagtgttttgattggattattagattttttcctatggaattgtttgagctctttatgtattctggttattaatcccttgtgagatgggtagtttgcagatattctcttccattctgtaggttgtcttcttcactttattgattgtaccctttgctgtaaagaagctttttaatttgatgtgatcccatttgtccattttcgctttggttacctgtgcttgtggggtattgctcaagaaatttttgcccagaccaatatcctaaagattttccctcatgtttttctgtagtagtttcatgatttgaggtcttaggtttaagtttttaatccattttgatttgatttttgtatatggcgaaagatatagagttctagcttcattcttctgcatgtaagtatccagttttcatttatttctgctgttttatagtttttgtcagggaattctgatatctcttttatcctagccttggtgtctgttcccatgtgatttagtttttatatttgtctcttcaaaatctcatattgaaatttgatccccagcattagaggtgggacctaaagagagatgtttgggttatgggggcagatccctcatgaatggctcagtgacctccctgtggtaatgagtgagttctggctcgtagttcacccaagagctggttgtttaaaaaagaatgactcccctcctccccaccttccacttcttttctcttcccgtgtgatgtgggctctccccttacacttctgctgtgattggaagcttcctgagttcctcaccagaagcagatgctggtcccatgcttcttacacagcctgcagaactgtgagccaaacaaacctttttacttggtaaattacccagcctcaagtattccttaatagcagtgcaaacagactaagacaccatttgagctgagatttttctggttctaaatatgatgaataattttggattgtatttcataatgacgtgttatgaaatgacaagtcttgtttaaatgccatagagaatgttgatgtttttgttttagcagacaatgacccaactagtttcaggttaaaaattccagccagccttctgtaggttgttgttccaagtccattcagttttcaaagattttgcagtgctgttcacatctgttgtctgtgtgtgtgcctagtggcccttttctaggtacttttatcccttttctatgtactttctgtgactacattgtgtcagggctgagtggcacaggacagaaggagaaaaagccaaccaggagtggtcactcttgagaccacatttcctttggtgtaagttgaaggtttcccttcttcagaactttaggctcctgccagcctctgttactgcttgtaccattgccaccatgagattactgggatgctatgactaatatacagagataaggaaaaaggggattccacactctatatagagtgttgggagacccttctttcattcctgaagcctgaactagaaggcttcgctgtgaagtctttctctctatgctaatatccacttttaggtttcaggctatattgagttcaggccaaggaatgacagaggaaacaaaaatgatggcaaactcattaccattttgatgatatttcagattttatgatcttcaatctgcctgcttctgttattttccacagtcttccaatagctgctccatgtagtctatctaggttttatagctcatctcatctaggattagatacgctaacctggaactggaaccacttctactgttttttgttcccattaactgcatatgtgagtttcagttattccacatccttgccaacactgggtattaacagttatttttaatttcactcattctaaatgtgagtatgaaacagtatggtattgtaattttaatttgtatttccatgatgactaatgatgctgagcatcttttctgtgtctcttgcccatttgcatgattttatttatgaagtatctgttcacttttatccattggattatttgtctcagtattataggaatttttataatatattccagatacaaatcctctgtgtattgtgaatattttctcatagtctgtggtgtgatttttgttttcttaatggtgtctctggggaacagaaagctttaattttgatgaattccactttggtaatttttttttaatgattagtacttttttgtgtcctgattaagaaatgttgcctaatcaagtgttgtaaaagttttctcctgtattttcatgtagaaatgttatggtcttaactttgtgatcaagtctgtgatctgtttccaaattctcctttgtggtgtaagttatgcagttgaggatcattttctttcctaggaatattctagcaccacttttcaaaaatgattatttccttattgaagttagttggaaccttggtcaaaattagttggccttatatgtgtaagttttagagtttctactctgtttctttgttctttttatttatctttacaccagtaccacaatgtcttgattactgtagctttatagtaagtcttgaaatcaggttatgtcctccaaccttgtttttgttttcaaaattatttttgctatttcaagtcctttgcattttcatacaaattttagaataagcatactgggatttttttggggattgtatggaatctgtagatcaattttgtagattgacatttgaattttcagtcttcctatgcatgaacatggtgagatttttcttccccacttatttaagtcatctttaatgtcccccggtgacatattgtaattttcgttgtgtagattttacacatctactaaatatattcctaagtagttaatatactatggtatatggcattttaaaatttaagttttctcattgttcattgcttatatatagaaatactgttgtcatgccaatttgtaggtcccaacaagttaattttaattttaatttattattctttgggtcagagctttcatgcctactgtgggatgttttagggcaatgagtgctgtagagaatttatacaaggcaaaagttccagtggttgacatatatctatttgttctctgttttatgttcagtaactcctctaagatttcaagagtttcttctttaaatttactgggatcctcaggtataaagtctattcttcatacataatcatttcaccagagaacagagcagttttactccttcctttgcagttctcatgccttttatttctttttcttgcttaatgcactggctagaacattgaatatgataccaaaacaagtagtaaaagcagacatcttgccctgttccctattcctggagggcaggagagtagagtagtgttttgtcattaagtttaatattacctgtagatttttaatgggtgccttttatcagcttgaggatgttttctaagtgagttttatcatgaatgggtgtttaatttttcagatgtttttcctgatctatggatatgatcatacatgttttctccttttttctactgatgtagtgaattacattggtccagttgatcaactgtattgttgaaattgtcatctttactgaatttttatctgcttgtttaatcagcatttgaaaacagcatacatctccagttatgtttgtgtgttttctgtttctcctttagatcttctttggagtattttgtggggaggggaacaataacaaagttatagaaaaggtaaatatggcacaaggaacttctctttctccttagttatttgggaatacgttgttgacctgctgcacaatcactttcgtgtaatatagtctcatttcctataaaaggacattctcctataggaccacaataaaaccatgagaattaggaaattcatactagtgcattacagacattatttagatttctccagttctcccagtaatgtctttttttttatttttatttttttataacactttaagttttagggtacatgtgcacaatgtgcaggttagttacatgtgtatacatgtgccatgctggtgtgctgcacccattaactcgtcatttagcattaggtatatctcctaatgctatccctccccccttccccgaccccacaacagtccccagagtgtgatgttccccttcctgtgtccatgtgttctcattgttcaattcccacctatgagtgagaatatgcagtgtttggttttttgttcttgctatagtttactgagaatgatgatttccaattttatccatgtccctacaaaggacatgaactcatcattttttatggctgcatagtattccatggtgtatatgtggcacattttcttaatccagtctatcgttgttggacatttgggttggttccaagtctttgctgttgtgaatagtgccgcaataaacatacgtgtgcatgtgtctttatagtagaatgatttataatcctttgggtatatagccagtaatgggatggctgggtcaaatggtatttctagttctagatccctgaggaatcgccacactgacttccacaatggttgaactagtttacagtcccaccaacagtgtaaaagtgttcctatttttccatgtcctctttatcactttaaaactcaataaagttgtggctgttaggtgcctttatcattttaaaactcaataaggttgtggctgttaggtaccttttcatcccacagtaggcatgaaagctcttaggcaccttaataccccaaacaagatactcttttcccttttgtaattaagtgttttatggaaggtatgtttaaattatgtaaacatcttattcatcagcaaacttacttattaatttgtatctgtacagaatcttccttattttattcagtgagttatgatcaatttctaccttttttctttttaacttgttatttgaaaatacatatagactcacaagaaaaatatgtgactcacaagaggttacaaaaatagccaagggaggtccccactcagcttccccattgataatgtccttacataactataatgcattatcaaaaccagtaaattgatattggcacaatacagtcaagtggactacagacgctaatcagatttcacaagtttttgcatgcactcagttattctaatgcatatatgtgtaattctgtaaaatttaaacacatgtatagctttatgtaaccgccatcataatcaagatacagaagtgctctgtcactgtgaaggaattcccttgtgccttcccttttctagtcacaccctgttccctcaagccagccttctttaacccctgaaagccagtgatctgtttttctactgtataattttgtcattttgagaagttatatagatggaatccaacatgttacatagatggaacataacatgtaaactttgagatgtgttcttcttactcagcatactcacctggagatccattcaacttgtgtgtatcagtagttaatttctttgtattggtcagcattccattatttggaatttatacagtatgtttatccattcacctgttgaaggacattgtttccaatgcttattactaataaagctgttatgaacattcatgtacttttttttttatactttaagttttggaatacatgtgctgaatgttcaggtttgttacataggtatacatgtgccatggtggtttgctgcacccatcaactcgtcatctacattacgtatttctcctaatgttatctctccccttgcttcctaccccacaacaggccccagtgtgtgatgttcccctccctgtgcccatatattctcaactcccacttatgagtgagaacatggagtgtttggttttctattcctgtgttagtttgctgagaatgatggtttccagcttcatccatgtccctccaaaggacatgaactcattcttttttatggctgcatagtattccatggtatatatgtgccacattttctttatccagtctaatattgatagggatttgggttggttctaagtctttgttattgtgaataatgctgcagtaaacatacatgtgcatgtgtctttatagtagaatgatttataatcgttggggtatatacccagtaatgggattgctggtcaaatggtattctagttctaaatccttgaggaatcaccacactgtcttccacaatggttgaactaatttacacttccaccaacagcataaaagcattcttgtttctccacatcctctccagcatctgttgtttcccaactttttaatgattgccattctaactggtgtgagatggtatctcagtgtggttttgatttgcatttctctaatgaccagtgatgatgagctttttttcatgtttgttggctgcataaatgtcttcttttgaaaagtgtctgtttatatccttcgcccactttttgatggggttgtttgtttttttcttgtacatttgtttaagttccttgttttcattcttaagtaaattaagtttccttgatttttgttcttttgcatttgctgaggagtgttttacttccagttatgtggatctcagccctttttcagatggatagactgcaaaattttctaccattctggaggttgcctgtttactctaatgatagtttcttttgctgtgcagaagctctttagtttaattagatctaatttgtcaagtttggcttttgttgccattgcttttggtgttttagtcatgaaacctttgcccatgcctatgtcctgaatggtattgcctaggtttttttgtagggtttttatggttttaggtcttacatttaagtctttaatccatcttgagttaatttttgtataaggtgtaaggaagggatccagtttcacttttctgcatatggctagtcagttttcccagcactatttattaaatagggaatcctttctccattgcttttgtcaggtttgtcaaagatcagatggttgtagatgtgtggtgttatttctgaagcccctgctctgttccattggtctatgtatctgttttggtaccagtaccatgctgttttggttcccgtagccttgtagtatagtttgaagtcaggtagcatgatgcctccagctttgttctttttgcttaggattgttgtggctatacgggctcttttttggttccatatgaactttaaagtagttttttctaattctgtgaagaaagtcaatggtagcttgatgaggatagcattgaatctataaattactttggacagtatggccatttcacaatattgattcttcctatccatgagcatggaatgtttttccatttgtttgtgtcctctcttatttccttgagcagtggtttgtaggtctccttgaagacatccttcacatccattgaatgttgtattcctaggtattttattctctttgtagcaattgtgaatgggagtttgctcgtgatttggctctctattattggtgtataagaatgcttgtgatttttgcacattgattttgtatcctgagactttgctgaagttgcctatcagcttaaggagtttttgggctgagatgatggggttctctaaatatacaatcgtgtcatctgcaaacagagataatttgacttcctctcttcctatttgaataccctttatttctttcccttgcccgattgccctggccagaacttccaatactgtgttgaatagcagtggtgagaggccatccttgcattgtgtcggttttcaaagggaatgtttccagcttttgcccattcagtatgatattggctgtgggtttgtcacaaatagctcttatttttttgagacatgttccatcaatacctagtttattgagtgtttttagcatgaaggggtgttgaattttatcgaaggccttttctgcatctattgagataatcatgtggttttttgttattggttctgtttatgtgatggattacatttattgatttgtgtatgttgaaccagccttacatcccagggatgaagctgacttgatcttggtggataagcttttgaatgtgctgctggattaggtttgccagtattttattgaggatttttgcatcgatgtttatcaggtatattggcctgaaattttcttttttgttgtgtctctgccaggttttggtatcatgatgatgctggcctcataaaatgagttagggaggagtccctctttttctattgtttggaatagtttcagaaggaatggtaccagctcctctttgtacctctggtagaattcggctgtgaatccatctggtcctgggcttttcttggttggtaggctattattgcctcaatttcagaacttgtcattggactgttcagggatttgacttcttcctggtttagtcttgggagggtgtatgtgtcgaggaatttatccatttcttctagattttctagtttatttgcgtagaggtgtttgcagtattctctgatggtagtttgtatttctgtgggatcagtggtgatctgccctttatcattttttattgtgtctatttgattcttctctcttttcttctttattagtctggctagtggtctatctattttgttaatcttttcgaaaaaccagctcctgaattcgttgatttttttggaagggtttttcgtgtctctatttccttcagttctgctctgatcttagctatttcttgtcttctgctagcttttgaatttgtttgccctcgcttctctagttcttttaattgtgatgttagggtgtcgattttagatctttcctgctttctcctgtgggcatttagtgctataaatttccctctacacactgctttaaatgtgtcccagagattctggtatgttgtgcctttgttctcattggtttcacagaatttatttcttgctgccttgatttcgttatttagccagtagtcattcaggagcaggttatttagtttccatgtagttgtgcggttttgagttttcttttctcttttcttttctcttttcttttcctttcctttccctttccctttcctttcctttcctttcctttcttttcttttctttccaccctgccctcctttcttcttcttctttttttttttttttttccgagtctcactctgttgcccaggctggagtgcagtggcgcgatctcggcttactgcaagctctgcctcctgggttcacgccattctcctgcctctgcctcccaagtagctgggactacaggtgcctgccaccacgcctggctaatttctttttgtatttttagtagagacagggtttcactgtgttagtcaggatggtctcgatctcctgaccttgtgatccacccgcctcggcctcccaaaatgctggggttacagatgtgagccaccgcacccggctgagtgagtttcttaatcctgagttctaatttgattgcactgtagtctgagggactgtttgttatgattttcattcttctgcattttctgaggagtgttttacttccaattatgtggtcaattttagaataagtgctatgtagtactgaggagaatgtatattctgttgatttggggtgtagagttctgtagatgtctattaggtctgcttggtccagacctgagttcaattcctgaatatccttgagctgagttcaagtcctgaatatccttgttaattttctgtctcgttgatttgtctaatattgacaatggggctttaaagtctcccactattaccgtgtgggagtctaagtctctttgtaggtcgctaagaacttgctttatgaatctgggtgctcttgtattgggtgcatatatatttaggatagttagctcttcttgttgcattgatccgtttaccattatgtaatgctcttctttgtcttttttgatctttgttggtttaaagtctgttttatcagagactaggatttcaacccctgtttttttttgttgttttgttgttgttgttattttttgctttccatttgcttggtagatctccctccatccctttattttgagcctatgtgtgtctttgcacatgagatgcgtctcctgaatacagcacaccaatgggtcttgactctttatccagtttgccagtctgtgcattttaattggggcatttagctcatttacatttaaggttactattgttaggtgtgaatttgatcctgtcattatgatgctagctggttattttgcccattagttgatgtagtttcttcatagtgttgatggtctttacattttattattattattattatttttgcagtgactggtactggtttttccttgccatatttagtgcttccttcaggaggtcttgtaaggcaggcctggtggtgacaaaatccctcagcatttacctgtctgtaaaggattttatttctccttcacttatgatgcttagtttggcgggatatgaaattctgggttgaaaattcttttctttaagaatgttgaatgttggcccccactctcttctggcttgtagggtttctgccaagagatctgctgttagtctgatgggcttccctttatgggtaacctgacctttgtctctggctgcccttaatattttttccttcatttcaaccttggtgaatctgacgattatgtgttttggggttgctcttcttgaggagtatctttgtggtgttctctgtatttcttgaatttgaatgttggtcagtcttgctaggttggggaagttctcctggataatatcctgcagagtgttttccaacttggttccattctccctgtcactttcaggtacaccaatcaaacgtacgtttagtcttttcacatagtcccatatttcttgtcttcacactttatttcatgaagttgatcttcagtctctgatatcctttcttccacttggtcgattcagctattgatacttatgtatgcttctcgaatttctcatgctgtgtttttcagctccagcaggtcatttatgttcatctctaaactggttattctagttagcaattcctctaaccttttatcaatgttcttagcttccttgcattgggttagaacatgttcctttagctcggagaagtttgttattacccaccttctgaagcctacttctgtcaatttgtcaaacttattctccatccagttttgttgctggtgagagttgtgatcctttggaggagaagaggcattctggttttggaattttcagcctttttgcactggtttttcctcatctttgtggatttatctacctttggtctttgctgttggtgaacttcagatggagtttttgcgtggtcgttctttttgttgatgttgatgcttttgctttctgtttgttagttttccttctaacagtcaggcccctctgctgcaggtctgctggagtttactgggggtccactccagaccctgtttgcctgggtatcaccaatgaaggctgcagaacagcaaagtttgctgccttctcctacctctgaagttttgtcccagaggggcacccgccagatgccagccagggctctcctgtgtgaggtgtctgtcgacccctgctggtaggtgtctccccaccaggaggcacgggggtcagggacccacttgtggaggcattctgtcccttagcagggctcgagggctgtcctgggagatctgctgctctattcagagctggcaggcaggaacgtttaagtctgctgaagctgtgcccacagctgccccttcccccaggtgctctgtcccagggagatgggagttttatctataagcccctgactggggctgctgcctttctttcagagatgccctgcccagagaggaggaatctagagaggcagtctgggcttcacccagttggaaattcccagcggctttgtttacactgtgaggggaaaactgcctactcaagcctcagtaatggtggatgcccctcctctcacaaagcttgaatatcctaggtcgacttcaggctgctctgctggcagtcagaatttcaggccagtcgatcttagcttgctggactccttgggggtgggatccactgagctagaccacttgccttcctggcttcagccccctttccagaggagtgaacggttctgtcttgctggcattccaggcgccactggagtatgaaaagaaaactcctgcaactatctcggtgtctgcccaaatggccgctcagttttgtgcttgaaaccagggccctggtggtataggcacccaagggaatctcctggtctgtgggtttcgaagactgtgggaaaagcctagtatctgggctggaacagtcctcatggcttcccttggttaggggagggagttccccaacccgttgtgcttcccgaatgaggcgacacccccaccctgctgctgctcaccctctgtgggctgcacccactgtctaaccagtctcaatgagatgaactgggtaccttagtcggaaatgcagaaatcacctgccttctgcgttggtcttgctgggagctgcagactggagctgttctatttggccatcttgcccgggaatccctcatgtacttgttattacatgaccataagttttttatttctctatgacagtgggtctcaactaggagtgattttacctctcagggaacatgggaaatgtctgaagacatttttgattgtaatgactaggaaagaaatgctactggtgtctagtaaataaaacatagaggtgctgtggaatatcctagaatgcacaagacagtcctccacaacaaagaattgtttcaaaatgtcagtgctgaggttgagaaactgcactaggattaagacccaggagtgtgattattgagttgtacgtaagtatatgtttaattttataggaaactgccagagtgttttccagagtggttataacattttgcatttccaataacaatgtgtgagagatcaagttcctccacatcctcatcagcatttatactgtcagtattttttatatttttatttttttgagatggagtctcactctgtcacccaggctggagtgcagtagcatgatctcagctcagtagcaggatctcagctcactgcaacctctgcctcccgggttcaagcgattctcctgcctcagcctcccgagtagctgggactacaggtgcgtaccaccacgcctagctaatttttatatttttagtagagatggggtttcaccatattggtgaggctggtcttgaactcctgaccttgtgatctgcccaccttggcctcccaaagtgctgggattacaggcgtaagctaccacgcctgtccactgtcagattttttttttttttaatttagccttcctgattggtatataggggttatctcattattgctttaatttgcatttctctactactgacaatgaacatttttaatatgcccatttactatctatatgttttctattaaaattgttttgctcattttctaattgcattttttttactgttgaatttagagaatctttatatattctggatacaaattctttattagatttcagacttgcaaatttttacattgtacaaaaccaagttttcttattctatttattgttactattgtaatttgttttgatgctcaaaatacagatttggtggccggtggcagccccttcaagctggctctatatcctttttgtatgtccccgtcatcttttgatcatgtctttgctttctggcacaagatatttcaggctcatcttatacttttctttctccagctctggaatcaactacttctccaagaagcctgttcttccagtggaatgtgctatttagaggttaggatttaaacactaggcatatgtgttgctcccagccctacacttatttacattaatatttatttctctatctgtatatattaaaaaccatatgttcatctcattttttacttttttctttgtttttgtaactttcatatctaatagtgagtaacctcacttccagtgtgctttatataacgaattctctcatttcttgccaacctctccccagcaaggatgaccctaacgctccacttggattcaaacactttattgtctgtctccttgggtggatgctcttttcaccctgcttgggctttggcattccatgctagaccactcctcaacatgtatagcacccctccctacttggtctctgacttccctgtgtcagaatgctcatcaccctcaacgtatggacactctccccaccccacgtaggttctgactccccatgctgaactaccccctcacatggatttcttcctcatgctgcataggctcatgacacctcacattggtctccctctacttggatgccctcatcttgtttaggatttgactcaagatgtcaggctacgccatttagacagcctcctcactcaggttctgacattcaaggtcagactgactcctgtcaccctgcttgagtagtgactcaccacactgcccttaccctgtatgacacccttctcatcctgcaggaaatctgacttcccagcctaggctatctctctgtgtaggtattttccttctctactgcagctctgccactccatgtaaggccaccccagtgtggagacacctacctcattctgcttgggctctaactccacatgtctggtggacctccctcttcatggaagccctccatatcctgatttggtgcttttattgcacactaagccacacgtctgcagagactgtcttcttgccctgcttgaattctaatactctgtgctaggacacttctttacatgggcaccttccttaccctaatgagattctgataccttgctctggcccgttgtcactccatttgctacagattcccgccttgttctgcctacctaatggttttaagattgtattgtttgggatgggaaagataaaagaaagggagaatagaaacacaggagaggggaaagagaataggaagcttattttttgttactttgtgattaatatatcttttctctccttttactttcaacctatctgtgacctcacagtaaagtgcatcacttgtcaatgtcatatggttgaatgttattcatttttaatcttgtctgttaatctttatcttataactgagatatttagttcatttacatttaatataattattgagctagttgattttgctatcctctattattttagattaattaattatttttattccatgctattttctctattggcttcttttacttttttttcttttagtggttattctagagattataatatacttccttgactgtatagtttaccttaaattagtacttttttcgctttatgagcagcaaagtatcttaggacagttgaactctatttactcactcctcctatttgtgcttttgttgtcatatatttctgttctacatgttctgaatcccacaggacattattattgttgctttgaacaaacaacattcttttccatatatatgtatataagaaatataaagcaacgtaaaatatgtatatatacacaagagtgtatgtatgtatatgtacatgtatatatttacatacacacatcctttaagtgttctgcattctttctagcagttctgtactatgttggatcattttccttcagcctaaaaaatttcctttagtatttcctgaagtcttctggggattatcttagtttttatttgtttggtttaagaaatgtatttcagttggttatagaattgtaggtttttatttcagcactttaaagagctactatctttgttgaaaggccaagtgtcgttcttatttttgcacctttgattttcagcagtttggctttgatgccccaagagttggtttttcttagtattactttgtgttcactgagcttcttaactcagtagattaagtcttctacctgttttggaaaattcttacccattaactcataaatattgtttctgcactcttccctcttctcctaggagtaagattacacatgtattggattatatgactgtgccccgtgagtctcttatgctgtcatccgttcgttctttttatgtttggcagttttctgtagactttttgaatttacaaattatttttacacagtgtctatttgcttctactacagttgaatcagattttagataatgtatttttattctgaaatattcatttctttttttaatagattgtagttttctgttgagattttccatattttatctatttccctttatcttttgctctcaatatattaataaccattttgaagtctttttgtgctaactagtagctaaatcccctgtaaatcagtttttcttgtctattttttcctctcaatttttgatcattttttcctgcttcatatgttacataatgttttgtgtgttggatattgtaaataagaggataatagagattgagggtatttgcatctagagggactagaaaaacaagagcaagccaaccccaaagctaacagaagaaaataaataacgaaaattagagctgaactgtatgaaattgagatgcgaaaatccatacaaaagattaactaaaccaaaagttgattcttccaaagaataaacaagattgacagaccactaactaaattgttaaagaaaaaagaagacaaaataagtacaatcagaaatgacaaaggtgacattatcactgactccacagaaatacacacacacacacacacacacacacacacacacacaaactcagagactattatgaacacctattcacacacaaactaggaaacctagaagaaatggataaattcctggaaatatacaatctcccaagattgagccaggaagaaatggaaatcatgaacagaccaataatgagttctgaaattgagtcagtaataaaaaacttcttcacgacaaaagaaaccgtcagcatagtaaatgaacaacgtacagaatgggacaaaatatttgcaaactgtgcatccaacaaaggtctaatatccagaatctgtaaggaacttaagcagttcaacaagcaaagaacaaccctatttaaaaaatgggcaaaggacatgaacagacgcttctcaaaagaagacatacttgcagccaacaaatatatgaaaaaatgttccacattactaatcattcaagaagtgcaaatgaaaaccacaatgagataccatctcatgttagtcagaatgtctattaataaaaagtaaaaaaaataacaggtgttggtgaggttgcagaagaaagggaaggcttgtacactgttggtgggaacataacatagttcagccactggggaaaactgtggagattccttaaagagcttaaaacagaactaccattcaactcagcagtcccattactgggtatatacccaaaacaaaataaatcattctactgaaaaaacacatataatcaatatcatattattgctattcacaatagcaaagacatggaatacaaaaaacaatttttgctttaagcctgacagatctttggtttttcaacaactaaatattgtaagaactcagttgaggctttcaggtgtttgaactcagctctttagactctttgccctcacaactttagaatatggtaaatgttgtaaggggaacaacagtcatgcatttcttgcagttaaactttctcaagggaaattcatttcattagtactcttgcaaataattttactgtttttctgactcagcccctttattggggttggcccttctgacttttgactgagagtctagtgagtctttaattccttacctttaaaagttctctccctcaagcattagttattaagccccctgccttaagcaggtacaacatttggcaaatgttttaaggaggagagctgatgtgtgtttgtcccaggcctctccatctagtgggacttggtttcttatagtgccatgagtatgaatgagatttcagtctattactctgactcagcccccagcctcccataccaccaaaaaaagggaaattgaccttttttttcttttctcataattgtccttttcaattagtgaatggtagacatacggtagagactcaaaagttctacttttgtgatatattctagatattactctaatacaatatgacattattctcttttcttgaaactttattttcaagtgattttttgaaagttttagtctttttttttttttttttcttatagagacaaggtgttgctctgttacccaggctctggagtacagtggtgcagtcacggctcactgctgcctcgaactcttggtctcaagcagtcctcctgcctcagcctcctcagttgctgggactataggcgcatgccactgtgcctattttttttatgttttgtagagacgatcttgctgcattgcccagggtgacctctaactccttggctcaagtgatcctcctgcctcagcctcccaaagaactgggatcacagatgtgaggcactgtgccaggccttattttcaagtaattttagagttacaaaaaagaaacacgtatagtagagttccttataccactcttctagcttctcctgttgttaacatctttttttttcattttatttttatttttatttttttgaagacagagttttgctcttgttgcccaagttggagtgcaatggcgcaatctcggttcattgcaacccctgcccgctgggttcaagtgattctcctgcctcagcctcctgagtagctgggattacaggcatgcaccaccacgcctggctaatttttgtattattagtagagatggggtttcaccatgttggccaggctggtctcgaacttttgacctcaggtgatccacccacctcagcctcccaaaatactgggattacaggcgtgagccaccacgcctgacctattttttatttttaaacttttaggttcagggggtacatgttccaatttgttctataggtaaacttgtgtcatgggggtttgttttacagattatgtcatcacccaggtactaagcgtggtacccagtagttttttttttttttctgtttgtctcccctgtccctccaccctcaagtaggccccagtgtctgttgttcccctctttgtgtccatgagttctcatcatttagctcccacttataaatgtgaggatgcagtatttggttttctgttcctgcattagtttgctaaggataatgacctccagctccatccatgttctgcaaaagacatgatcttgttcttttatatggctgcatagtattctatggtgtaagtgtaccacattttctttatccagtctgtcatttatggggcatttaggttgattcatgtctttgttattgtgaatagtactataatgaacatttgtgtgcacgtgtctttatggtagaatgacatatatttctttgggtatgtacacagcaatggattgctgagtcaaatggtgcatctggttttagctctatgaggaattgccacactgctttctacaatggttgaactaatttacactcccacaaacagtgtataaccactcccttttctctgcaaccttgacagcatctgttatattttgacttttttataacagccattctgattgatgtgaaatggtatctcattgtggttttgatttgcatttatgtaatcagtgatattgagcttttttcatatgcgtggtggctgcatatatatcttcttttaaaaagtgtctgtcatgtcctttgcccactaagttccttgtaaatgctggatactagacctttatcagatgcatagtttgcaaatattttcttccattctataggttgtctgtttgctctgttgataatttttcttttgctgtgcagaagctcttatgtttaattagatcccacttgtcagtttttgctttcgttgcaattgcttttggtgtcttcgtcgtgaaattgcctgtttctgtgtctggaatggtattgtctaggttgcatatgtggtatccacatcatcactggtgatgttaactgatcacttggataaggcagtgcttgctaggtgtctccaagatggaaataagttactatttcttccttcttatactctgttttttgaaatccagtcacttagttcagtgcatacacaaaggaggaggggaaggttaagcttaaccttctttggtgggaggtattcacatctgttatctggacttcttcttaaagcaaaatttgcttcttctttccaattatttatgtgttcaattatttacttgctccactctgttttaatattaattccctatgatctcaagatataactgcaaccttgaaaactcctagttctcccagaactccttgacagaatgctctgtttcttgtttatctttgtacactgtgtgtatttagcacagtcccctaatttatggtggacatctagtaatttaaaaaaatgtattttcaattcagctgaaaaatagcatttcctcaactaaattatataatttaacattctaaattaaaagtaggttttaagataaaagtaaacatgtgtgataacattgtatcaaacaaaataaagggtactgctgaaattttaccttaataacgtttgacattgatgtgtccacaatatattcctatagctacttaaatattccttgaaaccacttttggaaagagatttcagtctctaatggccaaggatataatctgctgtattctttctcttttttggtcagattaccagagaagatgaagaccccactttctgctttctctgaaaaattgtcatctgatgcagtcactcagataacaacagaaagtccagaaaagaccctattttcatctgagatttttattaatgctgaagatcgtggacatgaaattatagagcctggtaaccagaagctacgcaaagctcctgtcaagtttgcctcatcatcttcagtccaacaggttactttttctcgcggcacagatggtaagagaatgtgattgcattttagattgttagaccagctcttttgtgtagttatcttagaaatttgtggttgtgtctttctagtcagaaaacctaattttaatttaagaattagggtccatatgattatatctgtcttttatttgcatagctgtcaacagaatatgatttattatattttatcttaatttcaagcacagttaacatgtagaactcatgctgtttgtgttaaaacttagttttgtctcatcatatttgcaataaaaatgcaagtagttcataacaacttgaaagtaattgaggtctgcttttaaaatggcggataaattatcttgtattacagtaacagtaatgttattactatatagtgcgtatatagggagagtatgtatatactaaatactataacaaatagatgcataaacatgtgatagtgcaaacacaatagcagtttatctcttacttataaagcaatcaccagagacccaggttgtcttcttgctctgttttctttaaaatatataacccaaggttatgttggatttaccttcatggtcaacaggaaggaacaaaaagcattgaggagcacatataggagatgtttacaggtcaggtctggaagtaacccaaatcactttccactggccaggaatgtagtttagctgtgttttccaaaatgaagaagaaatggattttggtgaataggtagcagtctctaccataaggtgaacatttagagtgttttatatgctatagtttcagtgatattttgatagtacttttaccatgtaacatttagaattagaccaaattgtaaattattttctttttttgagtaagtagcaggaaaattaacaattaagtttccattcttccccaaatgaagatggagactttactaatttttaaaatatttactattttggacaagtctactcaaagtacatcttaagtttctctacttatacaaaaaacttgtccacctacacacgtagatggaatatacctaaatgtaaagaaaattgtttagttcagcatttaaattgcattgaatttaagtaagtgcatttatatactaagatggttataattcttgaacatttttcttgtgaaattaaagcataccaaaaatatatatatagtttaataaattatcacgaagaacacctttatgtgttggttacctgttgttacagtggtacagtataacaaacaacctaaaaaatctctatggtttataacagcagacatttgtttttcttactcacaggcttatgggtcaattggactttggctgggctggctgtaagctgcagaaatggtttgggtctgttccagatacttctttctgagactcaggctaatgggtcaatagctatcctagagtgtggtgttctcatggtggtggcagaaacacaagagaggaaacagctataaaagcagtgcgcggtggctcacgcctgtaatcccagcactttgggaggccaaggtgggcagatcacgaggtcaggagatcgagaccgtcctggctaacacaatgaaaccccgtctctactaaaaatacaaaaaaaaaaaaaaaaaaaaatagccggacactgtggcgggtgcctgtagtcccagctacttgggaggctgaggcaggaggatggcatgaacccaggaggcggagcttgcagtgagccgagatcgtgccactgcactccagcctgggcgacacagcgagactccgtttccaaaaacaaaaaaaaagcatattttaaacttctactgtcatcaaacggatcaatttatagaggccatgatttatggttcatataaactttttatcaaagaatcgatattatttggtttagtaataagtgttattttcaacactgtgggtcaaaagtaaaattttatgaggtgtttttttttgtttgtttgttttttgtacaaaacattttaaggtacaaaaaatcgtatgttaactacatgactgcttacccattagtctgaattaacaagttcctctacccctctccagtgcttttttcctttcccggaagcagccattatttgctatgtattcacttcttcccctagacaggcagtccagtgtaaccttaagactactgcatccaaacaaagttcttgagaacttcaaaaaattctttatttgtctcaggtccatcgccatgtgatagtcatttctgctctgggtccattgtaattttgtccaatcgttgctgttaattttctccaacctgtgaactgcatggcatattcagccattgctatcaagcttaatatataccgatggagaaagaaaattaataaatcagtattctaacaataactacgggaacgaccaaatagaattggaggctacagcttttttctttttctttttccttttttcctgatagagtggtacaaatattcctaagttgtctcagactaaggttgaggtcctttttttttttttttttttttgagatggagtctcactctatctccaggttggagtgcagtggtgcaatcttggctcactgcaacctgcatcttccgggttcaaggattctcctgcctcagcctcccaagtagctgggactacaggcgcgcaccaccacgcccaactaatttttgtatttttagtagagatggagtttcaccatgttggccaggatgatctcgatctcttgaccttgtgatccgcccaccttggcctcccaaagtgttgggattacaggcgtgagccactgcgcctggccaaggtcattttttattaatttcttgactggactttctttagaggtcactttgccatgcccagtgatagaaattaatgcctctaggtgttaatcatactccttttaaaaagtaaccttatttcttgtggataattcaggtctatcatagatttagtcagcactctgtaagctgctctatgttttgctttagtgatataaaaaatgttaagtagctaggtggctcctgtccctggtagaattgtccctttcttatttctaagatcttccatctaacaacactcatagtcacaaaggttgaaagcaaaaacttcttaaaaagcttgtttgttcccaaatgcatgcattctatctggtactcggtataggcaagtaccatctatggttcagagcatatcccaaatcccataagaaagcattgtagactcagaaagtggtgttccccagcttatgccataacacttttcagtaaatagcttgctcactttatttatttatttattttttaggtttagcatagttatggtccataaggcatggataaggacagtaaatccctttaggcatcaaccttttgtctcatttccttcatttggaagtgagtttcttccttagaagcaggctactaacaatgtggaattcattgccaaaatgtcatcagaatgatagagttgccaaagatggtgacacagttctaagtaatataaagattattgtttctggccaggcgtggtggctcacacctataatcccagcactttgggaggccgaggagggtggatcacctgaggtcaggagtttgagaccagcctggccaacatagtgaaacctcatctgtactaaaaatacaaaaattagccgggcatgatggcacatgcctgtaatcccagctactcgggaggctgaggcaggagaattgcttgaacccggaaggtggaggttgcagtaagcagagatcgtgccagtgcactccagcctgggcgacagagtgagactccttcccccttccccaccaaaaaaaaaaaaagattattgtttccagaggagagctcattctactccaggactatcagaatcagtctagaggattttgggttttattaactagagatgagcaactaggagtccatctagaaatggttacaggatataagagaaaaccgtggtctataagaataaagataaacggaaggagctggaggcattcggccatgagaaatggtagctacattgaaaattcataatcatatgagcaatacaaccctatgaaatgctcagaaataacctaaacaaaaattttaaatgacctaatgcaggaaacactaatcctttttgtaaagatagaaaataataatttactaaattaaaaggtatgattctagaatggaaggctgaatattgtaaaggtatcatttattcccacataaatttatactctaaagtaattctgcacaaagttctaatggaactgttcttttgaactgtgtaatttatctttatgaatttatttttatttttaatttgtctgggtatatagtagacatagatatttatgaggtacatgagctattttgatataggcatacagtgtataataatcccatcaaggtaaatgggatatccatcacctcaagcatttatccattctttgtgttaacaatccagttacattattttggttattttattttttaagtatttattttttttgagatggagtcttgctctgtcacccaggctggagtacagtggcatgatctcagctcactgcaacctctgcctccttggttcaagcaattctgcctcagcctcctgagtagctgggattacaggcacccgccaccacgcctggctaatttttgtatttttagtagagaaagggtttcaccatgttggccaggctggtctcgaactcctgatctcaagtgatctgcctgcattggcctcccaaagtgctggattacagatgtgagccaccatgcctagctgtcttttggttattttaaaatgtacagtgaattattgactgtagaccctgttgtgctatcaaatactatatcttactgattatatctgactatatttttatacccattaacaatcctcacttcccccacactgctcactacccttcccagtctctggtagccatctttctctctcatgtgtgtccatgaattcagttgttttaatttttagatcccacaaataagtgagaacatgtgaagtttctgttcctatgcctggcttatttcactttatataataacctccagtttcatccatgttgctgcaaatgacaggatctcattattttttttggctaaatagtattccattgtgcatgtactgcctttgtgtatatgtactacattgtgtatatgtaatagattaatttatccattaatctattgatggacacttaggttgcttctaaattttggctatggcgaacagtgttgcaataaacatggggtgcagatttatcgctgacatactgacttactttattttggttatatacctagcagtgggattgctggatcatatgttagctctaattgtagttttttgaggaatctacaaactaactgttctctatagtgttgtactaatttacattcccagcaacagtgtacaagagttcccttttctccacattcttgccaacatttgttgttgtatatcttttgaataaaaccattttaactggggtgagatggtatctcattgtagttttgctttgcatttctctgatgatcactgatgttgagcaccttttcataagcctgtttgccatttatatgtcttcttttgagaaatgtttgttcagatcttttgcccgtttttaaattggattattagattttttttttcctatagagttgtttcagttctttatacattatggctactaatcccttgtcagatggatagtttgcaaatgtttcctcctattcggtggtttgtctcttcagtgttgtttcctttgctgtgtgaaatctttttaacttgatgtgatcacatttgtccatttttgctttggttgcctgtatatgtgggatattactcaagaaatctttgccaatatttaatgtcctagagagttttctcagtgttttcttcctgtagtttcatagcttgaggtcttagatttaagtctttaatccattttgatttgatttctgtatatgatgaaagatagaggtttagctttattcttctgcatgtagataaccagctttcccagcaccatttgttgaagagaccgtctttttcccagtgtatgttcttggcacctttgttgaaaatgagttcactgtaggtgtgtggatttgtttctgggttctctggttctgtttcattggtttatgtgcctgtttttaagccagtaccatgatgttttggttattatagtattgtagtataatttgaagttaggtattgtgattcctccagtttcgttctttatgcttaagatagctttgtctattctgggtcttttgtggttccatataaattttaggattttttctatttctgtgaagaatgtcattagtattttgatagggattgccttgaatacagattcagtggaataccccactgctttaggtagtatggacattttaacaatattgattcttctaattcatgaacatggaatatttttccatttttttgttgtcctcttcaattatcttcatcagtgttttatagtttcctttatagagatctttcacttctttggttaattgctaggtatttgattttatgtgtggctattgtaaatgggattatttttaaatttccttttcacattgttcactgttgacatatagaaatgtgaactgatttttgtatgttcatttttgtattctgcaactttactgaatttattgattgtggaggctctaggtttttacaaatataagattgtatcatttgcaaacaaggataatttgacttcttcctttccaatctggatctcctttctatctttctcttgtctgattgctcgagctaggacttccagtgctatgttgaataacggttttgaaagtaggcattcttgtcatgttccacatcttagaggaaaggctttcagtttcttccccattcagtatgatactagctgtgggtctgtcatatatggcttttattatgttgaggtatgtgttctctatacctagttttttcagggtttttatcacgaagagatgttgaattttaagaaatgttttttcatcgtcaattgaaatgatcatgtggtttttgtcctccattttgttgatgaggcatcacattgattgattagcatatgttaaaccatccttgcatccctgggatgaatacttcttggtcatgatgaatgatctttttaatgtgttgttgaatttggtttgctagtattttgttgaggatttttgcatcaatattcatgagggagattggcctgtagttttcttttcttttttctcttttttttttttggatgtgtctttggtttactggtcttgtagaaggagtttggatgtattctctcctcttccatttcttggaatagtttgagtaggattagtattagttcttctttaactatttggtacaattcggcagttaagccattgagtcctcagcttttctttgctgggagactttttattacaacttttaccttgttgcttgttattggtctctttcaattttggatttcttcctggttgataggttgtatgtttctaggaatttgtccatttttttctagctttttcaatttattggtgtaaagttgctcatagtagtgtctcatcatcctttaaatttctgtgctataggttgtaatgtctcccttcttaatctctgattttatttacatgagtcttctatttttcttagtctggctaaaggtttgtcgattttgtttatcttttcaacaaacaaactttttgtttcattttgcgatgtttttctcatatcaattttatgtatttttgctctgatctttatttctttttttctgctaattatggatttcatttgctcttttctagttcattagcatacgttgttaggttgtttatttgaagtttttctatgtttttttaatgtaggtgcttatacctataaactttcctcttagtactggttttgctgtatcccgtaggttttggtatgttgtgtttccattatcatttgtctcaagaaatttgtaaatttctttcttgatttcttccttgacccactggtcattcagaaacattatttcatttccatgcatttgtatagtttccaaagttcctttcattattgatttctagttttatttcattgtgatcagagaaatgacttgatataattacaattatttttgaatttttgaacacttgttttgtggcctaaaatatgacctgtccttgagaatgatccatgtgctgagaacaatgtgtattctgcagccgttggatgaaatgttctgtaaatatctattaggtccattcaatgtatcttcgttgatttttctgtctggatgatctgtccaatactgaaagcggggtgttgaagtttacagctgttattgtattaggttctatctctctctttagctgtaagaatacttgctttatatatctgggtactccaccgttgggtccatatatatttacagttgttatatcctcttgctgaattgacctctttatcattatataatgacctttgtctgtttttataatttttgtcttaaagtctattttgtctgatatgagtatagctgttcttcctctcttttggtttctatttgcgtgggatatctttttccatcctgttatttttagtctattcatggtctttataggttaattgtgtttcttgtaggaaatagatggttgggtcttgtttttttttgcattcattcaaccactgtatgtctttggataggaggatttagtctactgctttttattttttattttagatttgcccttttgaggctattttctagatcctgtaggcatgctttattcttttttattcctttttttcttttgtcttctctgactgtattttcaaatagcctgtcttcaaactcactgtgtttaatcaattttgctgttaagagagtctgatgcattctttagtgtgtcaggtgtatttttctactccagtatttctgcttctttttaattatttcagtctttttgttaaatttgtcttataggattctgagttctttctctgtgtcatcttgaatttctttgagtttcctcaaagcagttttttttttttttttttttttgagatggactcttgctctgtcgctgaggatggagtacagtggtgcagtctcagctcactgcagcctctgccgcctgggttcaagcaattctcctgcctcaccctcccgagtagctggaactacaggggtgcgccaccacacccagctaatttttgtatttttagtagagacggggtttcaccatgttggccaagctggtcttgaactcccgacctcaggtgatctgcccacctcggcctcccaaagtgttggaattacaggcgtgagccactgcacccagccaaaacagatatttttgaattctttgtctgaaaggttccacatctctgtttctccaggattggtttttagtgtcatatttagttcatttggtgaggtcatgttttcatagatggtctagaagcttgtggatatttgttggtgtctgagcattgaagaattaggtatttattgtagtcttcacagtctgactttgtttatacccatccttcttgggagtgctttcaaggaattcaaagggagttgggtgttatgatctgagtttttggtcactgtagccatatctccattagggggcacttcaagcctagtaacactgtggctcttgcagacttgtagaggtaccaccgtggaggttgtattagtccattttcaaactcctagaagtatgctacctgagactggttaatttataaagaaagggagttcaattgactcagttctgcatggctggggaggcctcaggaaacttacaatcatggcagaaggtgaagggaaagcaaggcacgtcttacatgggggcaggagagagtgagatctcagggataactgccacgttaaaaccatcaagatctcatgagaactccctcactatcacaacaacagcatgagagaaactgcccccatgatccaatcacctcccaccaggtccctccctcaacatgtggggattacaatttgagatgagatttggctagggacacagagccaaaccatattattccactcctggcccctcccaaatttcatgtccttttcacatttaaaaaccaatcatgccttcccaatagtcccccagaatcaactcattctagcattaacccaaaagtccaagtccaaagtctcatgtgagacaaggcaggtaggtcccttctgcctgtgagcctgtaaaataaaaaacaagttagttagttccaagatacagtgggggtacaggcattggataaatgttcccattccaaacgggagaagctggctaaaacaaagggattacaggccccatgcaagttgaaaacctggctgggcagtcattaaatcttaaagctccaaaatttcctttgactccatgtcatacatccagggcatgctgatgcaaggggttggctcccacagccttgggcagctccacccctgaggttttgcagggcacagctcccacagctactgtcatgagctggtgtttagtacctgtggcttttccaggtgcacagtgcaagctgttggtggatctaccattctgaggtctagaggatggtggccctcttctcacagctccactaggcagtgcccaagtagggactattagtgggggctccaactcacattaccagtctgcatttccctagtagaagttctccatgagtgctctgcccctgcagcagacttcttcctggacatctaggcattcatatatcctctgaaatctaggtggaggctcccaaagttcaactcttgtcttctgtgcatctgtaggcccaacaccacgtgaaactgtcaaagcttggggcttgcaccctctgaagcaatgtcctgagctgtccttttagccacaggtggagctggagcagctgggacacagggcaccaagtcccaaggctgtacagagcagctgggccctaggcggggcccacaaaaccatttttccctcctaggcctccaggcctgtgatggaagggactcccgttaagatctctgacatgccctggagacattttccccattgtcttggctattaacatttggctcctcgttacttatgcaaatttctgcagccagcttgaattccttgaatgggtttttcttttctactgcatagtcaggctgcaaatttttcaaatttttatgccctgcttcccttttaaacataagttccaatttcaaaccctctctttgtgaatgtacataactgaatgctttcagaataagccaggtaacctcttgaatgctttgctgtttagaaatttctcctgccagataccctaaatcatctctttcaagttcagatctccagggcaggggaaaattgctgccagtctctttgctaatgcatagcaaaagtgacctttatgccagttcccaacaagtttctcatctccatctgagactacctcaacctggacttcattgtccatatcactgtcagcatttttggtcaaaacctttcagtaagcctctagaatgttccagactttcccacatcttcctgtcttcctctaagccctccagcctgttccaatctctgcctgttacccagttcccaagttgcttccacatgttcaggttatctttatagcagtgccccacttctggcaccaattctttgtattcattttcacactgctttaaagatactacctgagactggtaatttataagtaaaagaggtttaattgactaacagttccacatggttggggaggcctcaggaaacttacaatcatggcggaaggtgaaggggaagcaagacacatcttacgtggcagcaggagaaagagagctcaggggaaactgccacttctaaaccatcaagatctcctgagaactccctcactatcgtgagaacaaggtgggaaccacactcataatctaatcacctcccaccaggtctctgcctcaacatatggggattacaatttgagatgacatttggttgggtactcagagccaaaccatatcagaagtttctgataagatccagaagaattctctggattaccaggtagagactcttgttcttttcctttactttctcccaaagaaatggagtctgtctctgtgctgagctgcttggagctgctgtgacacaagcacccctgtggccaccaccagtgggactgttctaggttagacctgaagccagcacacactggttctcgcctgaggtctacaggaaccacttgctggatactgcctatgtttgttcaaggccctggggctctacaatcagcaggtggcaaagccagggagtcttgtgtgctttccttcagggtggcgatttccccctggccctaggcaggtccagaattgctgtctgggagccatgacctgaagtcagaaaccttagtgctttattctgctgtggctgaactggcatccatgccacaagacaaaaagttcttattctttcctcttttccacaaacagaggagtcactccccatggccaccactgccccaggcttgtggtgactgctggctgcctaccactgatattcattcaaggcccaagggctctttcgtcaccttgggtgaatgcttctaggcctggaactctcacttcagggcaatggcctcccttctggcccagggcaggtccagaaatgccatccataagccaacacctggaatcaggaactcctggagcttactttgtactctacccctctgtggctgagctggcacttaagctgcaaaacaaagtcctatttaatcttccctctccttttctcaagcaaagggagtctctcctcatagccaccatagctgggaaatgtgctgggtcacacctgaagccagcacatctctgagtctcacccaggtgagtactgcctggctaccactgctcactattcaggacccaagtactctttagtcagcaggtgatgaatcctgccaggactgggtccttccctgcaaggcagcaagttcctttctggcccagggtatgtctagaaatgtccaggaactaggtcatggaatggaggcctcaggactctgcctggcatctctatcattctgtggctgagctagtatccaggttgcaagagaaaggtctgtttaatcttccgtcttccgaagtgaaaggaaggaccctctcctggagcaagctgtgctgtctaggtttgggtatggagtggtgcaagtgcttcccttggccattttggctggtgtcttactaggttgcatacgcccaagtcagctggctctgattccagcacatcaccaagactttcctgggaattgtgtttcttattgctttaggctatggtatatgctattttatcacagaaaccctaaattacaggtaagtagtctagagcagatagctgagttgcatatctggtggctgtggcatccttccatctctggaagtgtgacttccatttctgggtctagagtaactgctacagctatcatgatctgcagtatctaggaagtggggggctttaatgggatacctttactggaatgcctggaagtttcacacattcttgcactcttcccatgggctgaacaaagttacccatatgttcacacatggctgtaagggagattggaagtgtatatagatgtataggtgtaaggaggtagggaagttggacacgaggtcatatttgacagtttctaccaatcatgaaagaaaaactagtatatagaaaaaaaatgtccataatagtaagatgagggcatatttttaaaatgagattccatttacctctattagcaattaatcatttcttaatgactatacacgtgctgttggaggaagagtaaattgtcgcagacatattaataagcaatttagcagtcagtacttttttgaaaacttcatgaatggtgtaatttttcactttgtaaaaagaatttaccttggatgggtgatgggggagaataagtataaacaggaaaatctttattcacagaattctttataattgaacattttaacacaacctgcattttcaacattaggctaagagttgactatatttaatctggtataaccataaaaatgtgaagaataggaagtaaaatgaatatttttattataaataatagaaaagctgaatttcaaattatgcatactatatgcagacaactttgtaaacaaataaaaaacaggaaaagatgggtaagttatacattaaaatgttaacaataattatccttgagtggtaggaccttgtaatttttacgtttatatattttcttaatattgaaaattcatactcttgcagtggaaactatgttttgaagccctgtcacatagatgagaattagacttattttctatgactctggaagcagaataagaccagtataagggcttaattatgaccaggttagggttcgatgtaagataacatgttttttagttagagtcatctatatatggaatggattgctaaaaagtcatctcaatgaaacatatccctaccatcctacttaaactgtttcccctgcatttaaaccccaatttctcctgtattcttaattaccttcagcatttctatattttccctgtatcacttataatgtattaaaatgctagataatttactcatttagtatgttaattatttactgtatattttcctcctctagaattctcattcttcttgaaggcagagatacatttctctttgtttactcataaattccaaaagtcatgaacactgcctgaaacatagaaggcattccatatttgttcaatgaattaacaaatgtttttcatattaattgttctgatttttacctccttaggccagcctttattattgccatataagccttctggtagtaccaagatgtattatgttccacaattaagacaaattcctccatctccggattccaaatcagataccaccgttgaaagctcccattcaggtattatgcagaaattattcgaagttttattgtttgatattttatttgtgtattggctagttgattctggagtgacaaaagtccagtgctctttaatttttcagtgaaatatggaacttttcataccttgatctctggttcagataggtgagttatttgatcagatatatacacataagcatttataaatatttgatgaaggaaattgtatggatcattatttgggttagtgggctccatctagggcaaagtttctaagctttcttggttcacagtacccttagttgtttcactgatttattttctccgctttatatataataagcaattatttttttcaaatagcaactaaggaattagaacataaatactaattgttttcctctgacaactaatttaacaaatttgttatttatttttggttttggtttttgaaaaaaaaatttgttcataaataacaatgatgacttactaatgacatatgtgtagctgttggacactgtgcaacttcccaaaccatgagatgagattggaccctcttattttctgccttttattacagcagctgccaaaaatccagcttttgccaaggcacaacagcattgaaaagaacatagcactatctgatgttgacactttgaccttgagctagtagtttatcactgtcctttccctagaattttaaactatcctgcagcatccctgtgaatccactacagaggaggtgcagagttaggaaatgaataataccccatggaggcactagataaatatttcctatggagattttaagttaagggtgcagagttagtgtggtgtagggttttgattggtgggacagtattttgagttgtcgacgggatatgacttgattcactttagacaaattgttttttccatgattgtctataaatgtcattatatatatagaaattacaaagaaaggagaagttgcccctggtcttaggcagacatttttgttactttgatatgaaagagaaccaaactagcttctgatagtaactgcactaaagcctctgatacaacctcgcctgatttcccacaatgatggcattgaaaaaaaagaaccacaaaaatactcaccacaagttaagattgttaagtttatagccataaatgaagaaatgtttactccttgcaaggctatggttttaaaaacactgttaatggctaccagaaagaaaacaagctcacttaattgattgtaggtaggaaaatcttctgtcccacttactcatagttcagaagacagaatgtctgtaaacagtagaaacctggtcagatgtgccagtactttctgaggcctccagtgtcctgctatcgatatacgtcactaacacttccatctggttggagagattaacttagagaaagactgaacagtgtaggtgatgggagaagaaaatgactcaggactggcacactgtatcctgataaatatagtttctgtaataaagtactgtatgcatcagtacgacaaaaagagatctagttgccatacacacttgagattgttttttcatgttttcatctattctgagagtgaggaagttgggaatagaaaataatcctttcttagaccagtagacctacactggatgaaagcctagaaattgttctaattcctagccgttatctatgaatatgttgtacatctatagctatgagaggagccaattagagtttggggccaagagcaagacatacatcattgttagcaaatatttgggccaaataactgttcttcagttgagaatcagtaaataatagaactgatgcaaacaacgacggcaaaaaactggggcaaaggaaacagccatccaaagaaagagataaatgtctgcaaataaaccagtcttaatagcaacccagggagtatttattcaagaaaaatggccaaatcccactaagcacagtaagcgttagcattttaacttgccctagtcccattcccagtacctcagctcagtgatagccttcagaaatatagctttcttttccaagaccagaggatgcaaaatggagctgggcctcttttaaaagttccttcccaaagaattgttaatatttgacctatctagtggttccgtgaagattccacacaaaaggcttatctttacttgacctgactgggagccatccagtgctaaaggcctctggtgaaggggagggaaagatgtttatcaaaaacatttacagacaagtattttaatatcataatggctgaggtgtggactagcagttgaggtaaacagtaaactaactggaaagcttaaaagtaacacccgaggataagatgttgatagattctttgaaaggcgctgacatattcctaagactctgggagaccccatgtatgcgtaggcctgtgtatgctcaggaaagacccaaggcgctaggtcttatctctggctgaccttgaggatctgtacaagaagaaaagggaaggctaaggtaaagttgacagctgcctaggtcagtgttgaaggtacatcccaacatatgtgtggagccatttgatgaaggccgggagatttattggttctaggcatttaaggaaatccctgttcaggcattagctgaccattaagctaattgagtagtaacttcagtggccatatataaaaagaatatagactttacagaattaattcagagaagttattaaaacaacataaagcaacaacaccaaaccctgagatggaagtagaatctggtttccagagttggcgcattgtattacttaaatgtccaggccgggtgcggtggctcatgcctgtaatgccagcactttgggaggccaagatgggaggattgcctgagccctggagtttgagatcagcctgggcaatgtagtaagaccctgtctctacaaaaaattaaaaatcagccaagcatgatggcctacgcttgtagtcccagctactcggaaggctgaggcatgagtatcacttgaaccctcgagtttaaggctgcagtgaactatgattgcgccactgcagtccactctgggcaacagagtgagaccatgtctcaaagaacaaaaaaacaaaaaaacaaaggcaacaaaagaaaaatatatatgggagactttatcaaaattcaaaacttttgtacacaaaacccagtcaaaagaatgaaaaggtgactcacagcataggagaaaatatttgcaaatcatttatctgttgagagattaatacctaaaatatgtaaggaacccttacaactcaacaacaataacccaaacaatctgattcataaatgggcacagaatctgatggacatttctccaaggaagacgtgcaaatagccaataaacacctgaaaatcttctctatatcattaatcatgagggaaataccaaacaaaaccatagtaagataccacttcacacccattacaatcactgttattttaaaaaataagcggagagagccaagatggccgaataggaagagctccagtctgcagctcccagtgtgagcgatgcagaaaacgaatgatttctgcatttccaactgaggtactgggttcatctcactagggattgtaggacagtgggtgcaggacagtgggtgcagcacaccgagcgtgagccgaagcagggcaaggcatcgcctcacccgggaagcgcaaggggtcatggaattccctttgctagccaaggaaaggagtgacagaaggcacctggaaaatcgggtcactcccaccctaatactgcgcttttccaacgggcttaaaaaatggcacaccaggagattatatcccgcacctggctcggaggatcctacgcccacggagcctcgctcattgctagcacagcagtctgagatcaaactgcaaggcggcagcgaggctgggggatgggcgccctccattgccgaggcttgagtaggtaaacaaagcggccgggaagctcgaactgggtggagcccaccatacctcaaggatgcctgcctgcctctgtagactccacctctgggggcagggcatagccaaacaaaaggcagcagaaacctctgcagacttaaatgtccctgtctgacagctttgaagagagtagtggttctcccagcacacagctggagatctgagaacggacagattacctcctcaagtgggaccctgacccctgagtagcctaactgggaggcaccccccaggaggggcagactgacacttcacacggccgggtacttctctgagacaaaactttcagaggaacgatcaggcggcaacatttgctgttcaccaatattcgctgttctgcagcctctgctgctgatacccaggcaaatagggtctggagtggacctccagcaaactccaacagacctgcagctgagggtcctgactgttactaacaaacagaaaggacatccacaccaaaaccccatctgtacgtcaccatcatcaaagaccaaaggtagataaaaccacagagatggggaaaaaacagagcagaaaaactgaaaattctaaaaatcggagcgcctctcctcctccaaaggaacgtagctcctcaccagcaatggaacaaagctggatggagaatgactttgacgagttgagagaagaaggcttcagatgatcaaactactccgagctaaaggaggaagttcgaacccatggcaaagaagttaaaaaccttgaaaaaagattagacgaatggctaactagaataaccaatgcagagaagtccttaaaggacctgataaagctgaaaaccatggcaagagaactacgtggcgaatgtacaagcctcagtagccgatttgatcaactggcagaaagggtatcagtgatggaagatcagatgaatgaaatcaagcgagaagagaagtttagagaaaaaagaataaaaagaaacaaagcctccaagaaatatgagactatatgaaacaaccaaatctacgtctgattggtgtacttgaaagtgacggggagaatggaaccaagttggaaaatactctgcaggatattatccaggagaacttccccaatctagcaaggcaggccaacattcacattcaggaaatacagagaatgccacaaagatgctcctcgagaagagcaactccaagacacataattgtcagattcaccaaagttgaaatgaaggagaaaatgttaagggcagccagagagaaaggtcgggttacccacaaagggaagcccatcagactaacaactgatctctcagcagaaactccaatccagaagagagtgggggccagtattcaacattcttaaagaaaagaattttcaacccagaatttcatatccagccaaactaagcttcataagtgaaggagaaataaaatcctttacagacaagcaaatgctgagagattttgtcaccactaggcctgccctaaaagagctcctgaaggaagcacgaaacatggaaaggaacaactggtaccagccactgcaaaaacatgccaaattgtaaagaccattgaggctaggaagaaacttcatcaatcaactaacgagcaaaataaccagctaacatcacgatgacaggatcaaattcacacataacaatattaatcttaaatgtaaatggactaaatgccccaattaaaagacacagactggcaaattggataaagagtcaagacccatccgtgtgctgtattcaggaaacccatctcatgtgcagagtcacacataggctcaaaataaagggatagaggaagatctaccaagcaaatggaaaacaaaaaaaggcaggggttgcaatcctagtttctgataaaacagactttaaaccaacaaagatcaaaagaggcagagaaggccattacataatggtaaagggatcaattcaacaagaagagctaactatcctaaatatgtgtgcacccaatacaggagcacccagattgataaagcaagtccttagagacctacaaagagacttagactcccacacaataatgtgaggactttaactccccactgtcaacattagacagatcaatgagacagaaagttaacaaggctatccaggaattgaactcagctctgcatgaagcagacctaacagacatctacagaactctccaccccaaatcaacagaatatacagtcttctcagtaccataccacacctattccaaaagtgaccacatagttggaagtaaagcactcctcagcaaatgtaaaagaacagaaattataacaaactgtctctcagaccacagtgcaatcaaactagaactcaggattaagaaactcactcagaaccgctcgactacatggaaactgaacaacctgcccctgaatgactactgggtacataacgaaatgaaggcagaaataaagatgttctttgaaaccagtgagaacaaagatacaacataccacaatctctggaacacattcaaagcagtgtgtagagggaaatttatagcactaaatgcccacaagagaaagcaggaaagatcgaaaattgacagcctaacatcacaattaaaagaactagagaagcaagagcaaacacattcaaaagctagcagaaggcaagaaataactaagagcagaactgaaggaaatagagtcacaaaatacccttcaaaaaatcattgaatccaggagctggttttttgaaaagatcaacaaaattgatagactgctggccagactaataaagaagaaaagagagaagaatcaaatagacgcaataaaaaatgataaaggggatatcaccaccgatcccacagaaatacaaactaccatcagagaatactacaaacacctctatgcgaataaactagaaaatctagaagaaatggataaattcctcaacacatataccttcccaagactaaaccaggaagaagttgaatctctgaatagaccagtaacaggctctgaaattgaggcaataatcgatagcttaccaaccaaaaaaagtccaggaccagatggattcacagccgaattgtaccagaggtacaaggaggagctggtaccattccttctgaaactattccaatcaatagaaaaagagggaatcctccctaactcattttatgaggccagcatcatcctgataccaaagcctggcagagacacaaccaaaaaacagaattttagaccaatatccctgataaacattgatgcaaaaatcctcaataaaatactggaaaaccgaatccagcagcacatcaaaaagcttactcaccatgatgaagtgggcttcatccctgggatgcaaggctggttcaacattcgtaaatcactaaatgtaatccagcatataaacggaaccaaagacaaaaaccacatgattatctcaatagatgcagaaaaggcctttgacaaaattcaacaacccttcatgctaaaaactctcaataaatgaggtattgatgggacatatctcaaaataataagagctatctatgacaaacccacagccaatatcattactgaatgggaaaaaactggaagcattgaaaactggcacaagacagggatgccctctctcaccactcctattcaacacagtgttggaagttctggccagggcaatcaggcaggggaaggaaataaagggtattcaattaggaaaagaggaactcaaattgtccctgtttgcagatgacatgattgtatatctagaaaaccccattgtctcagcccaaaatctccttaagctgataagcaacttcagcaaagtcacaggatacaaaatcagtgtagaaaaatcacaagcattcctatacaccaatagcagacaaaccgagagccaaatcatgagtgaactcccattcacaattgcttcaaagagaataaaatacctaggaatccaacttacaagggatgtgaaggacctcttcaaggagaactacaaaccactactcaatgaaataaaagaggatacaaacaaatggaagaacattccatgctcatgggtaggaagaatcaatattgtgaaaatggccatactgcccaaggtaatttatagattcagtgccatccccatcaagctaccaatgactttcttcacagaattggaaaaaacgacttttaaagttcatatggaacaaaaaaagagcctgcatcgccacgtcaatcctaagacaaaaggacaaagctggaggcatgacgctacctgacttcaaactatactacaaggctacagtaaccaaaacagcatggtactggtaccaaaacagagatatagaccaacggaacagaacagagccctcagaaataatgccgcatatctacagctatctgatctttgacaaacctgagaaaaacaagcaatggggaaaggattccctatttaataaatggtgctgggaaagctgcctagccatatgtagaaagctgaaagtggatcccttccttataccttatacaaaaattaattcaagatggattaaagacttacatgttagacctaaaaccataaaaaccctagaagaaaacctaggcaataccattcaggacacaggcatggtcaaggacttcatgtctaaaacaccaaaagcaatggcaacaaaagccaaaattgacaaatgggatctaattaaactaaagagcttctgcacagtaaaagaaactaccatcagaatgaacaggcaacctacagaatgggagaaaaattttgctatctacccatctgataaagggctaatatccagaatctacaatgaactccaacaaatatacaagaaagaaacaaacaaccccatcaacaagtgggcgaaggatatgaacagacacttctcaaaagaagacatttatgcagccaacagacatgaaaaaatgctcatcatcactggccgtcagagaaatgcaaatcaaaaccacaatgagataccatcttacaccagttagaatggcgatcattaaaaagtcaggaaacaataggtgctggagaggaggtggagaaataagaacacttttacactgttggtgggactgtaaactagttcaaccattgttgaagtcagtgtggcgattcctcagggatctagaactagaaataccatttgacccagccattccattaactgggtatatacccaaaggattataaatcatgctgctataaagacacatgcacaggtatgtttattgcggcactattcacaataacaaagatttggaaccaacccaaatgtccaagaatgatagactggattaattaaatgtggcacatatacaccatggaatactatgcagccataaaaaatgatgagttcatgtcctttgtagggacatggatgaagctggaaaccatcattctcagcaaactattgcaaagacaaaaaaccaaacactgcatgttgtcactcataggtgggaattgaacaatgagaacacatggacacaggaagggaacatcacacactggggcctgttgtggggtgggggaagcggggagggatagcattaggagatatacctaatgttaaatgacgagttaatgggtgcagcacaccaacatggcacatgtatacatatgtaacaaacctgcacgttgtcacatgtaccctaaaacttaaagtatagtaaaaaaataaataaataaaaaagcaaagaatggaaaattatcagtgttgtcagggacatggagaaattggaaccattgcttattgctggtgggaatgtaaaatggtatagccattacggaaaacattgtggctattcctcaaaaaattaaacatagaattatagtatgatccagtaattccacttttaaatatataccccaacaaagtgaaagtaggatcttcaagagctatttgtacacccatgttcataacagcattattcacagtggccaagaggtggaaacaacccaatgtctattgatctatgaatggataacaaaatgtgacatatatgtgtaatggagtattattcagccttaaagaggaatgaaattctggtacatgctacaacatggatgaactctgaagacattaggccaactgaaataagccagtctgcttatatgaggtacctagaaaagtcagattcatggagacacaaagtagaattgtgtttactaggggctggggctagggggagtgggaagttactatttaatgggtacagagtttaagtctgggaagatgagtaggttctggagatagatggtagtgatggttacataacagtgtgaatatacttaatgccactgaagtgtacacttaaaaatgattaattttttgtggtttttttttttttttttgaaacagagtcttgctttgttacccaggctggagtacagtggcacaatctcagctcactgcagcctccgcctcccagattcaagcagttctcctgccttagcctcctgagtagctgggattataggcacccaccaccacgcccagctaatttttgtatttttagcagagatggggtttcaccatgttggccaggctggtctcaaactcctgacctcaagtgatcttcctgcctcagcctcccaaagtgctgggactataggcgtgagccaccgcacgtggtcatggttacattttatgtatattttaccacagttaaaaaaacttaagaagttaccaaaaatcttaattgaattttaaaagtagatgtctatgttccaaatcagggttgagtatacgaaattagcaaagtaacagaacgagaaatacaggaaactttaagatagcataaacagttaaatcagatgagtggaattcggtgagatgtctttagctgtgataaataattttagcatatgttgatattgtctcatgcatgtatttaacttaagcaagttcaaataaatatacttaacaaaagaggagagaaagaattttaaaagtgcaggtgttttgtgcatgcactctaccctttatgaacatatgactacggaagaatatgtaatgaaagatgggaaacttcattctcaaaattaattgtagtcctcgtttgccttttgtagtgtaggcatcttatcttgcttatttgggtatgattctagagtttgaagaaatgtctttttggtacaatatcagatacttcatcaggtgctcagattcaggtgcagtgctatgttacaagcttggaggaaaaagtggaccctcatgggtttcttgagcagacacgatgtcaatttcaacatatgccttcctaaggtaccttcaagggtgattttgaccctctatagcaaggttttcacctcacatgctgactttaaaccctgaattccatttaaaatgtatctctactttagtgaaaaaatagtaatgagactgtatatggtatgatccctgtaaatgttcacttagtaggatatataaccaaggtttagttgggttttcttttattgtttccttcatactttcctgaattttctacaatgatcaggttgttttgtttgtttgtttgtttttaatgatgggaagctgtcagctcacgttcatttgtttattcaaacaataggtattaaagatgttactgtgttccacgcagatacactgtggtaggtgttacaatttcagtattgctcaaaataaactataatggagtttatgttcacgttggttgacagatattaaacaaataaaccataaataagtacgtaattacaagtgataaatgctaagaaaataagaagagttccaagataaacaagtagacccagttttgttttacgaacttatgaagatcttttccaggaagaaacttttgagctgaactctagaggatgggaatgaattaggtaggcagagagtggagtgtgagaatgttccggcgagagggaagaagatggggaaagcccctgaagcagaaaagagcttgatgcatttgacaaatggaaagaaggcagcgtgggttgaaattccaacaaatttaaagatctgattggtttttgtagtgattcatgaatcaggcaacatcccattctataatatggaaagggtgcactgggcatgggagagagttggttctggtaaggtagccagaccaggaacaaggaaacacaatacagacagtccccaatttacagtggttccgttgaactattttttgactttatgatggtatggaaatgatacacatttagtagaaaccgtacttcagtacagtatttaataaactatatgaactatttgatactgtattataaaatagacttcatgttagatgattctgcccacctgtaggctattgtaaatgttctgattatgtttaaagtaggctgggctaggttatgatgcttggtaggttaggggcattaaatacatttttgactaacagtattttcaacctatgatggacttaccaggacataactacattgtaagtggtggatcatctgtaataccaaaaaaagcatattgattaacatcaggttacttacctggtaaagattaaagcagagataagttcctttttacgccagctcagggtgactggcccctttttcagttagttgctgtgaatctcttgtttttagaaaaaactggtccattttggaactttccttctttcttaaagtttcagttggattgtatggcatttagtacaagtgactacattttggtttggtctcttggggcttagtgcaggagctcagtctaaaacaatggactcccataaattttatttaacagggtagagcatagtgatgggtagatatggttaaagataggtgggttcaagatcatgcaggatcttatcaactgtattaaagtgttcggattttattctagtactactgcaattatggtttgatttatacttgtaaagtttattcttgccactatatggagaaatggtttatagatgggaaggcggagagccatggcggggcgggttagagtgcaagtagagacaccagttagttagaaggctgttgctttagacagtaccagagatggtagcatgagtatcacagtgttatctatagagatagggagaaatggacagtcagcatccttttagaaatagtttctcctagatttggtgataggagtatggagagtgagggagaagagcgtgaaaaaaatgtctggcgtgagcaactaggtgaatagaggtgccatttactgaggtggagattgaggaaaaagcagatttggggaagatgatcaaaatgtctgctttggacatgttaaaaatgagattcctattatacatccacatagagatgttgggtctacaattgaatgtaggcagagttaatttacacatgttaaggtaatagtgccacatataaggtggcattattcacattataaatatatacttttatgaaaacatacagatgggcatgaatattccagatctttagttagagttctggagcaataatgttaactcttgtgctgccccaaacataaatctatactcgcacatactatagctatgcacaggtacaggaaaataagtatatgtacattcactgacacgcacacatgtgtggctgcactctctcagctgcctctcacctcctctgaggttgattctcttgcttattcacccactgctctcagggatgtaattgttcctcacctgactctgaacttgaaagggtcatctctcttggagaacgaggggtggtggtgcagactgtgcgtgcacatgctgctgctggtgtgtactccctgggagaatttgtgaaaagaatgaccaccatttacagttgtttgtgttgtactacaatatatagtaacttaaacattttgatttgaagaagacacatcttttctaatttccataaaagtgctgtaagagctagccgtgtccctgaatgctggagtcggatgctcagaagaaaggtactcttgggcaatggtacattatttgttggtcatcagcatataccttggtggtcgataagtttacctaggaagagaagagaggccagttccgactccttaaggaactccaccattgagagatttggtagaagaaaatataaaaaataagtttccggagaggtaagaggcaaataagagaaagtgatgttacagaagttgagaagaacccaatataatctatttggcccagaaggcttggtgttttccttgcagtctgtcctgcaaaactcttcagggcttactgtgcactgtactaatgatacaggtacttacccagctcttattgccatatacatactaggagctcaggaaatagaggatcttagaaaaatcatctcataggagattagtataagcctttatatgtccagaaatgttcttttgcctgttagatgtggcatggattatagattaatttattttatcaaggaatgtgggaatattgaaatatattttaaaagaaaattaaatactttcaaatcttttacttatcatctgtcattttccattcagtgttttgtcttttgtattgtcagattaatcttctggaaacatagctaaatatattattattttgttgaaaaatcttccgttatgttgcattttatatacaataaagtttatactcttcagcttgggatcccatgcactggtgaattttgtcccaaacaactattttttaatatcttctaccactgtccttaatgtattctgcaatccaacctgaccataaagtgtccactatttttaaatacttcttttctttgcttatgctataacttctgcctaaaatgcctttcttccttcctctctatatcaaaaaactactttttttccaagatacaatccattttctccttcctccaaaaccatcatgagctggaaatattctctctcctgaactgattctccattttacatcttcttttatatcatttgcatctctgccttgtattattagaatttattttacatggcttacaacttcagtttgactgacgtttccttctgattatcctacccattgtagtgtagtgtttttttgtttgttcgtttgtttgtttgtttgttttttaagaccaagtctcactctgccactcaagctgcagtgcggtggcaacatctctgctcactgcaacctctgcctcccaggttcaagcgattctcctgcctcagcctcccaagtagctgggattacacgcacctgccaccacgcctggctaatttttgtatttttagtagaaatggggtttcaccatcttggccaggctggtcttgaactcctgacctcaggcaatccgcctgcctccaccttccaaagtgctgggattacaggcatgagccatcgtgcctggcctgtagtgcttttttcatagaattggtctaagaggcaaatttttaaaaagtctttctcaatctcatgtcgctatttgtgttttgtattacttccccgtttttctgtaggatccaatgatgccattgctccagacttcccagctcaggtgctaggcacaagagatgatgacctctcagccactgttaacattaaacataaagaaggaatctacagtaagagggtagtgactaaggcatccttgccagtgggagaaaaacccttgcagaatgaaaatgcaggtaactggattggctttgtatactttgtagctttttctccccttttcatcctaaatgagattactatccaatctttatcctttttttctgttttgttatacaagcttttctccttgctgttatattgagcatatacaagaaggcaaaatttcataaaatcctttaataataaaggaagcataagcttcagagatttttgaaaattataaacttcattttcacaacggataataaaatatgatacaacttttgaaatgaaataatacccaatcaagtatgttttagatactaagatccacagaaaatcttgattaaatgccacattagtttatctctgtcagatattacaaagtaatgtcttataggctggattctgtagggagatatgtagctgacatgattttttttttttaatttttttaaagacagggtctcactctgtcacccaggctggagtgcagtgatgcaattatagctcactgcagtgttgaactcctggactccagtgatcctcccacctcagccttctgactagctggggccagaggcacacaccactatgcctggctaataatttttttatagtgatggggggttttttgtagtgatgggggtctcgctatgttgcctgggctggtcttgaattcctggcctcaagctgtctaccagcctcagactctcaaagtgctgagattacaggcatgaaccaccgcatccagcccccatgttgttttaaaatttttaaaattttccaccaacattcaaaactaagatttttgattttccttgaaaaatcagaaaatctgactgccctttggctcgcattcattcatggtggtaatcagctgcagctgagccatggctgtccccctgcaggcaggacatccattctcttgtttgcttccatctccacagctctgagacccagtctgcttcattcatccaccttatctgtctgctgatcactgtgggtatttgagtttcaatcttttttttttttttttttttttttttttgagttggagttgcgatcttgttgcccagggtggagtgcgatggcgcgatcttggcacactgcaaccttcacctcccgggttcaagcgattctcctgcctcagcctcgagtagctgggtttacaggcacccgcctccacacccagctaattttttgtatttttagtagaggtggggtttcaccatgttggccaggctggtcttgaactccagacctcagatgatctgcctgcctcggcctcccaaagtgctgggattacaggcatgagccaccgtgtctggcccccactgttttataaaagctttttttcttctgcacccctgccattatacttttgtagctgatagatgataatatttattaaatgaaaactccagtagccactgaaaattctgtgtgtataattgcctgtgtttgttacatttatacttttttattcctgtgtataactattagctaaataggtgctactgatcccagggcagtttttaaatgtagggtggctctatgttctagttttggcatagtgttaatgactttgtgtgatagcatcagtgcctttgtgagaaaaataaatgagatctgcatggttttttttattttattttattattgttatactttaagttttagggtacatgtgcacaatgtgcaggttagttacatatgtatacatgtgccatgctggtgtgctgcacccattaactcgtcatttagcattaggtatatctcctaaagctatccctccatttttttagataatttcgttctacttcaaaacacagtgaagtctttttataaatcccttttgaaataagagaagcatatctaccagctaacattgagactgccaagtaaataaaaagaaataattttacaaaatatagttcataaatgaaaactcttctgcaccagggaatccgttacgtgttttccactatccatatgctagtggcagtttggttgaaacagataagcctaagatcccagtgtcagatacttcaggtgagtgtagatgtggaaaaattggcaggaaagaagtgaactctgtcagaagtctgcacaaagaactcaccagctttacctcactcccaggcttcatttggtaaggatgatacatttgaaataaagtcaggctcagttatctgaggacctctacaatctcccatctgttggtctacttacagactttgcatcctaaggaaaagccctcctcctggcttagtccttagtagccatttcaccttgagagaagcctagcctcagaacctcttgccttagagaattaaagaagaatagaggagagaatgcctgcctgggaaactgaacaatgacctatgtaatagctaaatgagctcataaaatatcatatcataagtaaaattctcagtggaaggggtggaatataaaagtgagaaaatctcttcaaaaatagaacataaagagaagggaaaagattttttaaaattcaagattgtccccaaagtttcaacattcaaagcaggtattctgtaaagacaatagagaaggcaaaaaagaaagaaccaaaggactagtataggaataaatttcagaactgaaagatgtgagttttcatactaaaagggactaccatgtacataaaaatacacaccgaggcacatgaccttgacattttaaaactgatttgaaaagagattctaacagcttccaaaaagaaaacatacattccatataaagaaatggaaatgagactggcatcagacttctcaaaagtgataaacagagttagaaaccaaaggagtaataccttagaattctgagagaaaattatttcactaaaacaagggagtttatttaagttacaaaagaaggaaagaaagaaaacatggtgggattgaggaaatggagggggccaacacaggaaatgggaaacgaattctcactgtggcggtggtacacaaggcctagaacccattcagtttgaagcctgcaaggaaaaagtcgaatttgtaggataccttatgtgattgactatacttagaggaggttttcagttctatttgcagctatgaggatgaagtagggattggcacatagaaactcagaaaatgcaaaaacaaagcggttattaactcttcaggaaagcagaagtttgtaatagaaaataaatgtaattacagtatactagctggcttagctgtgaataataattatataaacaatcatatgtaaatactaaatataaacttaattgaatattgatttaatcactcagaccattatttatgtgacatataaacactgaatgttaatatagggctaaaacttttcagaagataggatgaaaggatatatatgggtaggagggttttataatgagataaatccatagatcttagtatatagtataagaataaatcccagaactgaaagatgtgagattgtaattgatcttagaaggaaatcaatagataatttctggaacataaaatgatatggtagtataaagcatgttattaggaaataaggatattgatcctagaataaatggctaaagaagttgaaaatggtagcctttagaaattggggatctgtagtggataggagagggaactgctgacttttcttgtaagcctcgtgaaactatttgacttttaaaacatatacattgttatttttattaaatcagaatttatattgtccttcacctcaaaaaagtaagaagaaaaaaatacatttggcaaatactgactaaagaaaagctagtgttgatatggacaaaatataattccaggacaaaaaaaaaaaaattaaaggtagatacaagagtttatctcatagtaataaaagggtcaaatataccaggaaagataaaattgtgagcttatatgtatattctcaaatatattcaggaaaaattacaggaatgtgtaggtaaattcaacagtacatttcagaaatgtgaaagaccaggaaatagagaaagtagggctgagcgtggtggctcatacctgaaatcccagcagtttggggggccaaggcgggtggatcacgaggtcaggagatcgagaccatcctggctaacacggtgaaaccccgtctctactaaaaatacaaaaaaaaaaaaaattagccgggcgtggtggcgggcgcctgtagtcccagctactcaggaggctgatgtaggagaatggcatgaacctgggaggcggagcttgcagtgagccaagatcacgccactgcactccagcctgtcgtatttaaaatcaggtgttaccctcagcatgggggagatggaaggaagaatgaggggagcgtgtaagtttctagccagattttatttcctaacctgggtaaggttatatacacttgctttttgtaattcactgaactctttatgtgcacgttttcccccatattttccactgtacaattaaaaagatattttaaaaagcaatatggtacttagaaatgaatctaaaagggtctgtaagataaacaatacggtacttaggaatgaatcttaaagggcatgtaaaactattttaagagaaaattataaaactacattgaaatatattaagacctaaatagttggaaaattacacaattgtaataataaagatgtcactaaattaatttctaaattaaatgcattgctactcagaattccagtaggatttttcgtggaacttgacaggctgattctaaaatatttatggaaaatcaaaaaacgtatatttaaagaataagataagggatcttgccataccagacatcaagacttattacatgtgtagcttatttaagacatcatttacaaaggaataaacagaaagaaaaatgaaacagaatggtgacccagaaacatatccatgaatgtggaaacctaacatacacagagatggcataacaatctgtggagaaaggatgaagaggaactattcaatagagtttgaaccaatgaatatatatctggaaaaaataaaatcagataaatcactgccacacactaaacagaaatgtatagtataccaggcatattaaaagtaaatgggataactaagtttttagaatttagatggtctgtccttatgaccatgtgataataaaagatttcttaatcaggacacgcaaagcacctaccctaaagggaaaatataataaatatgccattattaaactgaaaaactttttgcctaaacgatatcaaacaattaaaagacatgaaacagcctgggagaagatatttataatgcacaccacctgcaaagacatttcacaggaatgttcattgcagtgcttttcaaaataggaaatagccttaagttgatcaacagaggtgtattcgtatatattaatacagtagaataatacataacgttcagaatcaaagacatatattaattgactaactctcaaaatcataatattgagtgaaaaagtcatggtgcgtaaaggtacagacagtattgtacccttcgtataaggtttaaagaaacttgcaaaacaatgctgtacactgttggttaatatatgcaatgtggtaaagaattacaaaacatccttgatattgataaactgtaaatttggtgtaaaggctgctactgagaagtgagaatggcatcattgggaacactttacacaagaaacattatatttgtaatattttatttcttaagctctatggtaaatacttgggtgttcattttgttgcctatatttttggtatgcctgaaatattttattaacattaaaacattttttaatgatctaaaaatttcagaagacatttagagaaaagagattaggaggattgaagtaataagaagtaagaaaaatgtgtgaatttaaaagaggtagcaagagttaactggttctttgcatttttagcaatctctattgcctttctgatttctttgttgaaaaatatacttacagataaaaaaatcaaaaatgatcaaaaaagtagaaaagagaaatagtattagacaagtttaaaaggctataactgcatgaaatttttaaaaaattgtatgagaatgctgtatttaaaatctagatgataaaagtgcttttcttggattatatgaaatataaaaattgactccataagtggtaaaaactttgaataggccaaagaacttgaaagcattgttcacatcttttttcctttgaaaaaacatacctgatctttcctttttttttttgtttttttttttactgttgcatcaaaccatcaaggaacagattttttttagaatgtttttattttattttatttttttgagacagagtctcactgtcgccccggctggagtgcagtggcacagtctcagctcactgcagcctccacctcctgggttcaagtgattctcctgcatcagcctcctgagtagctgggactacaggcgtgcaccacgacgcctgctagtttttgtatttatagtagagttggggtttcaccgtgttggccaggctggtctcgaactcctgaccccaagtgatccacccgcctcagcctcccaaagtgctgggattacaggtgtgagccaccccgcccggctttagaatgttattttatttaaactgttgttgtacacagtaaagtatgaaaaatttttcaattcatgtcacagtttttacacaggtggagcctaagaggtacttttttcctaatatgtaaatgggtttggggttttgtttgtaattgtgggggaggattacttgtctgttgtgtttattatctttccttttctgaaatcaaatgatgtcgttattccagatgcctcagttcaagtgctaatcactggggatgagaacctctcagacaaaaaacagcaagagattcacagtacaagggcagtgactgaggctgcccaggctaaagaaaaagaatctttgcagaaagatactgcaggtagctaaactggattgtctgcgtattattttcttctggtcttctaaaatgagactattcccttaagaacagaaacagaaatatattctctattttcttcttgctgtcttcagctctcttctatctcatgtatatatgaaatagttaaggtatgtttagctatattttttatatactttggcaggtaaaattaacatatttaaagttctttgtgatatttctggagggttttgaatatagtaaacaaattaatctaatttccagaaattcatttaatggactttttacctccgctgataaaatctctcaattctgtgagacacggaccctctaataccatttttgtacataatcctttatttaggaattcagcttgtttacttcctacctatcagttactttacttcaaagggattatgctgatttaaataaccctaatagtgtatttacgttaggattagttttgactcagagaggaaaacaaaagcaaaataacataggcttgaagaagacagaaaactctttctcttttttgtaaaactccagaggtaagcatccagagttgacctggtactccagagtatcggaacaaagctgttgctctcttgttactctaacatttttggccttcattcttaagctgtagccatcagcccatattgcaaccagcaggaagaaaggaaaggaaaaagcacattccttcctttaaggatacttctgagaagctatatataccattccttttgcattctattggccagacttagacacatggtcacatgtaccagggaagctgggaaattgagttgttattctaataacaatgtgcccagctaaagttagggttctgtttagaggaaaaggaaagtggatattagaggacagatagtattgatagtttctgccacaattgtaaactaaaacattttagaacatgattagctgcttctcttctttaggtattgcttgtttaaaaaggttagattgtattctgggcaacacttctgaattttaccccattttactattactaaatgaatgttccaaaaacagttttgatcatgttaatctcctaatcaaaaactttagtgtttcattgcctgtaaggataaaatctaaactcttttagcactgtcttctagaactgtagagtccactctcaaacaactttctaacactagttctcacctcttttccttataaattctataatcaaatgctatatacttgctctgtttcttagatgctaagttactttcctgacaccattcttgtgttatgtagtcaccttttttttccatcttaatgtgtatcccatcttagctctcttctaatgccaaaatcagttgtctagagttctatggtactcccacctgcaattagtttttctttctttgaataccgctacctctttttctgactgtttcttacagtatatctgtttacgtatgtgattttttgccccaattttcaattattttctaaacgcatttctgagtcatcttttttcttcaatatcagtaacaaagcctttcacataatacgtacttgagagacatttaaaaatcttttatgtcaagttcctgtctgtatagtgtgttaatttccctttcgtagattccagtgctgctgctgctgcagagcactcagctcaagtaggagacccagaaatgaagaacttgccagacactaaagccattacacagaaagaggagatccataggaagaagacagttcccgaggaagcctggccaaacaataaagaatccctacagatcaatattgaaggtaatgggattgggttgtgtatgagtgtgtgtgtctttgtgtgtatgtgagggtcagtgttagtgtttccatttcattctgatgagaatatagcctcatgattaaacaaaaattccttttctttttttaaaactttcttgtgtaaagtactttgatgctactattaggttactatatatatatatagatttccaaaaagtaattgttactttttggaaaagatattagcaacttagaaacaggattataaataaatacctaaggctgatagttttagaagtgaagtatcttgtctcagtccccagagacaaccttaaaggccttccagaagactatagcaaagatagtgagaccatcaatacaaacttttaaaaaattacaataaaatcacatttatttttgtttgtccatgggtctctttttctgacataaaagcgtatagaacacaagacattactacctagccatcaagctttacctcttagaggaagatggaacagcctacataaggagagaaaagagtcaaggagctaaactacccatactggattttggaaatagtctgggttcaactgcttacatcaagaatatacaaaataaatgattttttgacaatagccaagactacacaatggggaaaggatagtctcttcaacaaatggtgttgggaaaactagatatccacatttaaaagaataaaggtggaccttttctttacaccacatacaaaagttaactcaaaaagggttagtgacatacatgtaagaccttaaaaccataaaactcccagaagaaaacataaggggaacacttcaggacattgaacttggcagtgatttctcagatgtgacaccaaaaacacagacaacaaaagcaaaaatagaccaatgaaactacatcaaacttgaaaacttctgcatgacaaagtagacaagagtgtgaataggcattctacagaatgagagaagatatttgcaaatcatggatctgataagggattagtattcagaatatataaagaacttatgcaactcaatagcaagaaaaacccaaacaacttatttttaaaaacacgtaacttattttaaaatgagcaaaggacttgaatagacaatagaagatatacaaatgccatatcaagcatataaaaagatgcccaatctctctaatcataagagagatgcaaatcaaaaccacaatgagatatcactcacacctgttaggatgaccactatcaaaagaaaaaatagcaaatgttcgtgaggatgcaaggaaattgaaacccttgttcaccattggtgggaatgtaaaatgatgtagctattatggaaaatattatggaggttcctcagaataataaaaaagaattagtatatgatcccgcaatcccactgccactgctgggcatataacctaaagaattcaaaacaggacttcaaaaagctacctgtatactcatgtttattgcagcgttatttataatcaagaggtggaagcaacccacatgtccatcaacagatgaatgtattaagaaaatgggaattatttgtcaataaagaaagcatgttacatacatatttgtattgtgcagccttaagaaagaaggaaatcctatcacatactacaaggtaggtgaacctcaagaacattatactaagtaaaataaatcagtcacaaaaagataaataccatatggtttctcgcaaatgttgagggatttaggaggatgagagagaccttgggtttaaacaggagagtcttttattgagtgcactcaggcccagcagactcacgtccaaaggctgggcccagaacaaagacagcacttgacttttatacacacttcacaaaaggggatgggctagcttgaagcaagcttacagtggcgtgaaagcgggaatacagaagcaggacaaagacagttaatcaaattgtaacaggttcataactcaggattgcacataaccgttgctatgcaacccagatgtccattatctaggtttgtctaggcacgggcttatcccataaccttcactatggtgcccaggcagctgtagttcaggcctactcaggcttctcatgaccttcattgtacttcttagataaaacagaatacttgaagtcactagttacagagaacaggaatctataaactcattccataaaacaaaggaaaatttgttttttcttctccctgtgttgaaggagtgctgggagagtctccagagcacattacataatattatcaagacttttcctgggtctgggctgtgcctgttgctgcctctgggacaagtcagcctaatgcaggaaaacttatttctctttctttttaattttatttttctttaatttcccacctcagtatgaaatatctaaagtagctgaaatcatagaaacagaaagtagaatagtgattgcccaggcttgtgagagggtggacagagaattagtgtttagtaggtgtagggtttcagtgttacaagatgaaagagttagagattgttgcacaacaatgtgaatatacttaacactactgaactgtacacttaaaaatggctaaggtggttaatttaatgtcatactatttgtcacacacaaaaataatacataagatgaagaaatataacattgcaactttgcaggggttagtgtgggagacatagcttgcaaaagaaagatggaaatataatctgtaaaagcatactctagaagataagaaaaatttttctaaatgttttacactctgaataattttagaagacatgaagtatatgaaataaaaattgatagaataatgaaatgaaaagggagatttaggggatagaacaaaatgaaatgaaaaaaaagtaccaattagaagaaagagatgaaagcaattaaaaaaaaatgatggaatttgaaggctgacagtgaaaatccaacacaatgatatctgttgttgcctctaaagaagataatagaaaaataaagatataaggaagaatggaacttacaattgtatgtatgtatgtatgtatgtatgtatgtatgtatttttagacatggagtctcattctgttgcccaggctggagtgcagtggtgtgatcatagctaactgtagcctcaaactcctgggctcaagtgatcttcccacctcagcctgtagagtagctgggactgtaggcacatgctaccacacctggcttgaacctgtaatttaaaaggacgtaccaagtcctaggaaaattttgtatatagtgttcaatactgagatgtatgtttgcgatagtactgaactttaaagaaaaagaatgaatcatgcaggcctccatacagaaaaaaacaagtagaaaatgctaaaagacagggggacaggcagaggacagggaggttaaaggaggtataaatgagcaaacttcacctttaaagttgtaaaatcaaaaaatacatgtgtaagtaattatagggttgaaaattataggccagacgcggtggctcatgcctgtaattccagcactttgggaggctgaggtgggtggatcacctgaggtcaggagtttgagaccagcctgaccaacatggaggatccccatatctattaaaaatacaaaattagccgggcatggtggtgcatgcctgtaatcccagctactcagaaggctgaggcaggagaagcgcttgattccgggagacagaggttgcagtgagctgagatcatgccattgcactccaacctgggcaacaagagtgaaactccatctcaaaaaaaaagaaaattataaaatttacccctaaaagagttaaaattaaactataaaacatccaaaatatttagaaaaacaggttagcttggaggtaaagggagggaaaaagaaaacagtaaatttgtaacaaaaacaaaaaattgccataaaatgaaagacagcaaagcatgcaagtctatatataagtaaactaaattcacctatattaaaaaaaaaaaaacttcttggattatattaaaaaacaaacccagttccatgctatataacaaacatatcaaaagtaaaattactgagaaaggtggaaagcaaaaagaaaacttagagatgtatcaaaaagaaatttggggacattaatatagatgaggttaaattcaccaaaagttttgcaggaattgaagaggtatatttttatactgatttgcaatccacaatgaggatattttgcataaatctttaaacatcaaataacttagcataaaaaattcataaaacgaaaaccaggagctcaatcaataaggaaatttatgttgccttaaaaaagaatgaaggagggcagggtgcggtggctcacgcctgtaattccaacactttgggaggctgaggcgggcggattaagaggtcaggagatcaagaccattctggctaacatggtggaaccccgtctctactaaaaatacaaaaaaattagccgggcgtggtggcaggcgcctgtagtcccagctactcaggaggctgaggcaggagaatggcatgaacctgggcggcagagcttgcagtgagccgagatcacgccactgcactccagcctgggtgacagagcgagactccatctcaaaaaaaaaaaaaaaaaataaaaataaaaaatgaaggtatggaattatatgaaaacaactcttaggatggattgtgaggcaaaaggtgcttaacagggggattggacggtggaatttgcttgtagggagaaaaaaaataaaacagacaaccctaggaaatcttcaaagagaaatggacaaatacaaaataatactggggagcttgaacacacataattagcttatgacagatcgtggagatgaaaattttttttgtaagtgaagtttaaaaacacctgggaataatacaagtaatgaggttgatgtggggtgtgtgtggctgtgtgtgtgtgtctgtgtgtgtgcatgcatgcataagcctatatgggttaaacttaaaaaaaaaaccctttccaaaagaccatagaaaattttttcatacagctttattcagatataatttacccatttaaaatatgtaaggctgggcacagtggctcatgtctataatcccagcactttgggaagctagggtgggtggatcacttgagatcaggagttcaagaccagcatggtcaacatggcgaaaccccgtctctactgaaaatacaaaatatagccgggcatggcggtgcatgccgataatcccagctattcaggaggctgaggcaggagaatcacttgaacctgggaggcagaggcgacagtgagccaagatcgcgccactgcacttcagtccaaacgacagagcaagactccgtctcaaaaaaaaaaaaaaaaaaaaaatcaaacatgtaattcaatgatttttactgtattcacagataagtgcaatcaaccatcaccataatcaattttagaatattttcttcacttcaaaaaagaaaccctgagacttaagcaaatactgatccactttttgtctcagtagatttccctattctggactttcatacaaatgggaccattaagttggggacataacatgaaacttagggcccgcccataatgaaaaatgttaaaggaaattcccatgtaaagtaggcctccagtgggctacactcttactataagaataaaagataaacacgtccatgtagaaggggacagtaagaaaactgcctgttttaaccttgataatgagtttggggaaagaagacaaaatttatcctcagaatttataaccacaaactagtgttcacacagatttacagtcattaattttgtactggtataatttattagtgcagtaaactacaggtgtgttctgaaaaatctcaagccgagaatttaacaatggcagtaggttggtattgcagactcacatgcctttcggatgcaaatgcacatctctctgaagaaacttcaacccagacctaaaataccctaaattccctaaaataccaagctcatagtcaaggcactattagtagaaacagtatcaacaacaagaaacagaaatgagacccacaattacaaatgtccaggattccttggcaaaatgcctgattctcagactgggacaggagatatattagatgagcctgaacccttttgtggtgccagaaagtaaagaaaaaaaaatgcacagggatggggaatatgtcaatggaacacagggaccaagtaaaaaacttcccagtggctaaagctgggacagtttctgtagtatagcaatagtattagatcataaccaaagtataaaataaatacctatgagtctgtactgataaaagtaaatgatttaataaataaatggggggaaatgacaaatctgtgcagaattctaaataatgtatgtagatattccaccatcagggaggtggaacataactcccactcttaactaatgggttgcacatagtaacttaacttccttccaaagagtgtatttttataggaagggggaaaaagaataactatatagtgaagaattctggcaaacactggctcagccgggtcatcaagatcatcatcaatagtggtaagtcatgttgatagtatgtacccttaatatgtaatgagaaatatattttaactttgaaatcttcttcccaaaaacccataaccccagtctaatgagaaaaacatgagacaaactcaaatgaaggacatttatacttgaccagtacttctcaaaactgtcagagtcatgaaaaacaagggatgcctaagaaattctcacagacctaagagaagcctaaggagacatgataattaaatgtaatgtggtgtcttggatagaatcctggaacagaaaaagaacagtatgtacaaaacaaggcaacacaaagtatggcctttggttaataataatgtaactttattgattgattcatggtaatatattgtattaatgtaaggtgttaataggggaaactgggtatggggtataggtaatcatctgtactgttgtcaccgtttttctgtaaatccaaattattctaaaattaaaagtttattttaaaaaattaatgcattctgacattaaaacaggtggatagataaatgataaataagaaatttcatcttcttaaagaaaacactttacagcttctctttggcataaccaatttgctggcgttactgctcttgcactttggggccattactaactacagttagggttacttgaacacaggcactgcagtatcatgacagtcaccctgataacccagacagctatgaagtgcctaaggggcaggtagtgtaaatgtacggacatgctggataaagggaggattcacatcctagggtgggatggagcaggatgacaagagatttcatcatactactcacaacgacgtgcaatttaaaaatcatgaattgtttctggaattttccattaaatatttttggaccatggttgactatgggtaaatgaaaccttagaaagcaaaaccacagataagggggactactgtattcacacctaatgtgtggggtttcccctcacgttaagcagttctgacactgacaacctgtacttagcacagtccccacaggttatgggttcagtcccacaagactgcccaccacttcagataccaattgcatggcttggcctcctatacttctgaccaactagctccaaattggggtggtggggagaatcccatgaccccctcctcaggtttggtaatttgctcgaatggctcagaaaacttagggaacattttcttacatttcctgattttttatgaaggatatttcaaaggatacgcacgaacaaccaaatgaagagatacatgggcaaggtatagggaaggtgcacagagcttccatgtcctctctgggcctgccatcctcccagcttctcctgtgttcaccagatgtgaagctcttcaaactctgtctgttagggtttttatggaggtgccattacataggcaatattgattaaatcattggccattggtgattggctcaacctgcagtccctgtcccctccccagagatcaggggttggggctggaagttccagccctctaaacatatggttgttcccttggtaaacaggccccccatcctaaggggctttccaaaattcacctcattaatgtaaactcaagtgcaatcagaagtgacttgttttgaataacagaccctccttgaacctttatcactcgctcttgaactgtttcaagaaccaagtacaaaaaccaaatgtcataataaaagatgcccctattgctgttatcccgttttcctaaatggaaattacaagagttttagtagttctggccaggagctagggttaaggcaaaatatgtatttattatatcacagtattacaatttacagggtatttaaatgaattatacagtgataatagtaaaaggatgctactgggacaagagactgatacatcagtgaaaatacttaaatacagtgggcacttactctatgataaaggtgccatttcagatccatttgtaaaaagatggattactcaacaaataatgccaagatgctttgctagccatttagagtatcgtgagaattttaagttgtagccctactttactcctgtcaccaaaatgcaagtataaaagatccaagtataaaaaagagatcataaaagttctggttttctgacttttctaataaatttgagcagaagaaggctttcaaggtctgacaaaatcttggagtcataaagccaaagatttgataaatgtatatattaaaattaaagtgtcttcatggtagaaaatatcataatgcaaaatcaatttataaatgaataatgggaaaacaattttaaaaaattgagaaactgagaaaaggggctaattttcttactatgcaaagagctttttacaaatcaatgacagcctaaaaggaaaacaaaggacctgaacaaaaagcttatagtaaaagaaatgcaaatggccattaaagatatgaagaaatacttaactgtcttaataaagaatgtactaagccacaaattttgttttacctgtcacaatagcacagatgaaaagatttgattatccttagtattgttgagtacatggggaaacattcatgtactcttataagactattattagaagtgcaaatttgttgcaacatttttgaaagtgtggaacaattggatgatatctaactaatgttgaaataaatattcccttttcacccagacttccatttaagggaataacagatacacagataaagttgtacctagaaaaataaaatgaagctacacataaacgcacaaacaaatgttcactgcagcatgctttggaagaataaactattggaaacaacctaaatatttagttaaattttggtaaagtaaatcagtttaatataaaatgtttgtagatgcacaaaatcttgctttgaacaagtagttttactctacttggcaggaatttttctataagaaaacttgtttaatattggttatcaccagaaagtggaactaggaggttcagagataaccgggagaactttactgttcatattaaatttgtctgcattatttgaatattttgcatgtttaatttttaaaagtctgcagttctaggtatgaaagaaatatttaaaaataaatgaaaagcagtaaatgatattttcatgtacttttatatattcggggagaattttgcaaatgttatgagtaaaattaattccattatcagaagtaaataactacttcaacttatttgacctttactcttaacaaagtgccatgagatgatggtgattatcaaatcctgttgttttataaagccctttatacttaaggaattcagcttgcttgctgctgcttctgcttctttttttttttttttttttttttttttttttttttttgagatgaagtctcgctctgtcgcccaggctggagtgcagtggcacggtcttgactcactgcaacctccaccttttggatttaagcagttctccttcctcagccaccacagtagctgggattgcacgtgtgcaccaccgcacctggctaatttttgtatttttagtagagatggggtttcaccatgttggccaggctggtcttgaactcctgacctcaagtaagccacccccattggccttccaaagtgctgggattacaggcctgagccaccgtgcccagccttcagcttgcttattttctactatcctttctgtattttacttcattcccaggctgggaggactatgttcattgaaaatactgatattagggaataaacattttagagcaatgttatctatttccttattgttttacttactgctttaatgaattctagataggccttcaaatttttgctttattctgttgccaaggtatccttcctgaaatacagccataattatgttactcgcctgttcaaaatggtatactggctcttcatttcttttaagaataaaatttaaagtccttggcctagtgttccaggccctgtagaatttggccccaaataacctttgctaccttactttcctctgctttataaatgaaataagccatacatactgaatatttgcactctcccttattgcctcagttctttcctacttttatgcttttgctcatgctatttgatgaagcaggggaaaggccagcacaactatagtatagttatcaggaagagtggtacaaaatgaggaagaaaagttatgtatacttgtacttcttgttaaggagtttgggctttgttcttagtgtaagagaaggtcattgaaaattgctaaatagaaaatgacaagtccagcttacattttaaaaagactactttgaccactatttgacaaatagattggaaaggtacaagaagggacaggagacctattagagacttgcagtattgtgacaggaaatagaaatagatgtgtgattgtttggtgaaggattaatgacaggaacaggaagaggagggagttggaactatcaagaataactcccagattttggcttgggcagtaggatgatgtgccattcacagagatgtggaagactagggaaggtacagttgtcaaggaggctagaatagagctcagttagatggctgtgacatccaagtggatatatcatgtatatagttggaactcaagaaaaatcgtagcttgaaatgcaaatttgaaaataagtaacagcatggaaatggtactaaaagccacagggagagatgagattacctagaaagagaatatagactgagaacatttcctggaaattggccatacattgaggtcattgatcatattagcaagagcacttttagtccagaagtatggctgtactctgcagtaatttgaagagggaattggggtagggagagaggtaaaggagaggaaaataggttcctctttagaagcttggctatgaagaggagcagagaagtgggccagtacctggaggaagatgtgaggattttctaaacatacatactaaatgatgttttcaagccaatggaaatgaccctgaaagatagaagagagatatgatagggaaaggaagcaaggtctggaagggaagatgagttgggttccagagcagcattggaggaacttgcctttaaaagaatgggagaggtggtgttgtctctgtatccagaaaggttatgggagcaggtggattggcataggtggcagctgcctcaggacatccacagaaagtgatccctcagcccagaatgttcttcttcctgtttgtttgtttagctctcatttttacttcacatctcatcctcctcagagaattcttctctagctaccatttcccagtaaaatttctcttatatcagcttgtttttgttctttgtagcccctaatttagaattatatatttgtttgcatttgttcagtgcagaagctgcaatctcaagaacctgtagaatctaaatgaaatctcccaatttttaaatgttgctagataattctaaaattgtatagtctacatactttaggtataaatgcaggccctgtgtgtcccactctactctggggaagtccgtagggattcctagagtatttcatgaaaactctgcttgccagtaatctatagtgtgggtgaaaaggatcccatcattgcatgtgtgtatctttgtttctgcccatgatgtagaactctaaaacagtgttttgatgtcatatcagagattagaattagggtttatgattgtgtcttagctcattcctgctgctgtaacaaaattctgcagatctaagatcaaggcaccagcagattgggtgtctggtgagagcccagtctctgcttccaaaatggtgtcttgttgctttgtcctcacgtggtggaaggcagggaaaggccaaacaggagccttcaggccaaagggcactaatcccattcatgaaggtggagccttcatgacctaatcacctcctacctaatactattatattggggattatgtttcaacatgaatcttagagggacgcaaacattcaaaccatagaaaattgtaagatattacatctaaaaatgtcaaaaaatgaagatagaaagtggtaaattttatgtgttttttaccacaataaaaaaaaatttggaaaaaaagtcaagatggtccacagaaaaggaatttcaaagggctctaaaacatgtaaaaagggttttttaaaaaatttatccatttaattactgactatgagaatgaagtgtcaggtttcttagctgaatatggggttaccaatatctgtcaggtttaatagcaggattaattaaaaaaaaaacagatgcagagcatatgtcataacaccctacacagaacaggtggtaaatacatatagcagttgcttttatgatctggagaactgaagtgccttcctccaggtcacgtagccggtcagtggcagagcccaggccaaaattcatgtctcttaaacttttactgtaccagcgaggctactaagaacaaggcatcagtcttttgtgcaggcagtgaattttctgataccttatataaactattctttcctttagtctttgttctgtatctaaagaattgtgaatagtatttctaaacagaatgctaattttttaagttctttcaaaatctttttttctccttttcagagtccgaatgtcattcagaatttgaaaatactacccgttctgtcttcaggtcagcaaagttttacattcatcatcccgtacacctaccaagtgatcaagatatttgccatgaatctttgggaaagagtgttttcatgagacattcttggaaagatttctttcagcatcatccagacaaacatagagaacacatgtgtcttcctcttccttatcaaaacatggacaagactaagacagattataccagaataaagagcctcagcatcaatgtgaatttgggaaacaaagaagtgatggatactactaaaagtcaagttagagattatccaaaacataatggacaaattagtgatccacaaagggatcagaaggtcaccccagagcaaacaactcagcacactgtgagtttgaatgaactgtggaacaagtatcgggagcgacagaggcaacagagacagcctgagttgggtgacaggaaagaactgtccttggtggaccgacttgatcgtttggctaaaattcttcagaatccaatcacacattctctccaggtctcagaaagtacacatgatgatagcagaggggaacgaagtgtgaaggaatggagtggtagacaacagcagagaaataagcttcagaaaaagaagcggtttaaaagcctagagaaaagccataaaaatacaggcgagcttaaaaaaagcaaggtgctttctcatcatcgagctgggaggtctaatcaaattaaaattgaacagattaaatttgataaatatattctgagtaaacagccaggttttaattatataagcaacacttcttcggattgtcggccctcagaggagagtgagctgctcacagatactaccaccaacatcctttccggcaccacttctactgtcgaatcagatatattgacccaaacagatagagaggtggctctgcacgaaaggagtagctctgtttccactattgacactgcccggctgattcaagcttttggccatgaaagagtatgcttgtcacccagacgaattaaattatatagcagcatcaccaaccaacagaggagataccttgagaagcggagcaaacacagcaagaaagtgctgaatacaggtcatcccctagtgacttctgagcacaccagaaggagacacatccaggtacatggctacagattccatctggcaatgtgactgccctcttcatggactttttagttaagctttgcacacaggtgaaaaaaacaagccatttgccctttcctctctataccatttcttaccaactggaaaagagtgagaaagtgtagtacagtgctattgtgagttgtcattattttcatcaacattcatttacgaattaccttttgaatgaagggctttgctgctagatccttcacagtctgcaaagtttacccctgaaatgggggagctttgaggttagaatgatctctatcctgaacaatattgctgggtttatgtttatttgggttttttttttttaattcattcctctctgtctttcaggaaatatatttgaggttcttttaaacacacacacacagacaaacacataaataatacagggtttttttttttgtaattgaagaatggagttgatttgaaaaattgaagctggggtgagctacaatatgattttttaaaaatgagtaaataaggaattgtgaataatggaaagacaagtcaaagccaggaggaagataaataagccttgtggatgtggtcgctagaaaagagctacaaatttggctttatgttttctagcacttagtgttgctagaattttgtgatcaataacattcactttttaatataaaaagagaacaaaatttttagaaacattacagatttctgataagagacctaaaataaatttctctcatctgtcttcttaaagaaggcaccacagtgcaacaaagagtatcctcctataaggccattatcacattccttagtttagggtgttaataagggagatctcaaggggtcaataaatgtaggccattgctttaacccaagaggaaaatttcaagtatcactagacatgctctccaaagaaggatgcttgcaaaatggttcagtggagtatggaacgaaaaatatttgaatttatattcattttccccaactttttaaaatttatatttttgtgtatattttatgagtacagtagtgacataacatataaataaatatctattttgacaacttgtgctaaaaaaatttttgtcagattacatgatcaaaagaaattggagaccactggtctagagaaagggaggcatgagatgttcagacaatttattataaatattatttctcctcattgagcttttggcagtgtttacatatataaataatagagtatgctttttttctaaagtaagtgaagaattgggaatggtacagagtaaggcttttgttccataggggagatagataaatggatccaggagagggtttgtgtgtgtgtagtaaaatacacatgacataaagtttacagttttgatcattttcaagtatacaattctgtggcattgagtatattcacagtgttttacaaccatcaccactatctatttccagaaatttttaattaacccagtggaaaccctgtacccattaagcagtgactctctgttccctcttctcaccagcccccggcaaccagtaatctattttctgtctctgaggattttcctattctggttgtttcatataaatggaatcatttaatatatgaccttggtatcaggcttctctctcttagacacagtgttttgaatattcatccatgacataacatgtatcaatacttcgttgctttttatagctgagtattattccgttgcatgtatataccacattttgtttatccattcatttattgatttgggttgtttccactttttggttattgtgaatagaattgatatagaacgtttgtgtacacctgtctgcaattcttttgggtatatatctaggaatggaaatgctgggccatatggtaattctgtggattagcttattgaggaactgccagactattccatagtacctgcactattttgcattcccatcagcagtgtataagggttcctccaaccctcctccttttttccacagcgactgctttagtttatattcgcaccagcagttcacaagggtttcaattttattgcatccttgccaacacttattttccattttttaatatataaactaaccatcctgttgggtgtgagttagtatcattgtggttttgatttgcatttccctagtgattattcatgttgcacatctttttatgtgcttatttaaccatttgtatatcttcttttgaaaaatgtcttttcaagtcatttggccattttaaatctggctgtttgattttttggtttttgagttgttgggattttctatatattctggatattgatctcttgttagatacatgatctgcaaatattttctcccattttgtaggttgcctctttcacagtcactctgctgaccgtgtcttctgacatatagaagttttaaattttgatgtagtccaatttagctattttttttttgttttttgtgcttttggtgtcatatcttagaaatatttgccaaatccagtgtcgtgaaagttttcttcttaagagtttaataattttagcttttacttttaggtctttgatccattttgagttaatttttgtgtatggtgtaagataagggtccaccttcattcttctgcatgtgaatatcccgttttctcaacatcgtttgttgaaaagactttttttccccattgaatgttcttggcactcttgccaaaaatcgtttagccatatacgtgagggtttttatctgggctctctattctgttagtctatatatctctctttatgccactactgcactgttttgatttactgtgtatttaaaatgagttttgaaagcaggtagtgtgaaacctgtaacttagttcttttttcaaaattattttggctgtttggtttcccttgagatttcatgaattttagtaaatattttattgtttttaatactaccatatgtgcaatttctttcttaatttcatttttggattattcattgctaatgtataggtacataaataatttttacatactgatcttgtatcttgcagctttgctgaatttattaactctttttttgtgtggatttttaaggatctctaggatttcatgttgaggaagttcccttctttttctattttgatgagtgtttttgtcatcaaagcattttggtgtttgccaaattcttcagcatctattgagattactagttttttctttttctttttctttttttttttttgagacagagtttcactcttgttgcccaggctggagtgcaatgacgtgatctcagctcactgcaacctctgcctcctgggttcaaccaattctcctgcttcagcctcccgagtagctgggattacaggtgcctgacaccatgcccagctatttttttggatttttagtagagacagggtttcaccatgttggccaggctggtcttgaacccctgacctcaggtgatccacccccctcagtctccccaaagtgctgggattacaggcatgagccattgtgcctggcctgtttttttcttttattctgttaatatggtgtatatttattgataatcatattttgaaccaactttacattcctgagataaataccacttgatcataaaattctgttcatatgctgctggattcagtttattagaatttgaagaggactttttacatctatattcacaaggaatatttgtctatagtttctttgtgatatctttactgcctttatatcagggtactactggccttatagaatgagaaagttttcccacctcttggtttttgataatgagtttgagaaggattaatgttaatgattgacgttaattctttaaatgttggtagaattcaccagtaaagccatctggccctgtgtttttctttggggaaattttttttcattactgattcaatgtcttttaagtctatttagattttgtttcttcttgagtcagtttctgtagtttgtgtttctagaaatttgtttatctttttttttaaagtctgtttcatttatctccattgaatctacattattctgcttgctttggatttagtatgtttttttttcttctcatttcttatgattcaaagttaggttattcatttgggattattctttaatgtaggcatttgtagctataaatgtctctttaagccttgcttttgtagataagttctgccttcattgcttgccataagttttggtatgtttgtcttctttttcattcaaaatgtttgctgatttcttctttgaccattgactgtttaggacagtgttgtttaatttctacttgtgaattccccacctttctttgttattgatttctggttttactccattgtgatcagagaatatattttgtattatttcaatccttcatttatgaccttgcatatgatctgtccttgagaattttatgtgcatttaagacgaatgtgtattctgttgctgtttggagtgttctctattgtgttaggtctagctggtttataatgttgttcaagtcctctatttccttatcagtcttttgtccagtttttctatggctatcagaagtggattattgaagtctccagctattactgtggaactatctatttctccattgaaatctgtcagttttttgcttcatatattttagggctctgttgtcagttgtgtgtatgttcataattgttatatcctcttcatggattgatccttttatcagtacaaaatcctctttttgtctcttgtaacaatttttaatgtaaagtctgttttgtctgatattagggtaactaccccagctctcttttgggtaactatttgcatggaataccttttttatccttttaatttctaactctttgtgtctttggatgtaaagtaagtctcttttagacataacatagatggtcattttttataagctattctgccctctctgccttttaattggcgagtataatccatttacatttaatttcataagaaaggacttactttccccgtgctgtttgctttctttatgtcatatcttttttgtttttcatttctactgccttctttgtatctaattgattttttgtagtgtaccagttttattcccttttcattttttttttaacatttcatagttattttcttacgggttacattgaggattacaattaatatcttaaacatgtaacagcctgatatgaaataaaaccaacttagcttcaataatatacaaacactgttgttaatacatctctattcttccccttaactttaataatacacaaaaactgtgggtagacatctccatcccttcctctttaattgttatagtcacagattacatcttcattttgtccccactaaaatagatttataattattttatgcattcgttttttaaatcagataagggaaaagggaagagttacaaaccagaagtataatagggactttatttttacctatgtaattgtcttacccttatttcttatgccttatttctatgtatatgccttaagccttatttctatgtatacttcaaggtattgtcaaatgtcctttcatttcaccttggagtactctctttatcattccttatagggaaggtctacttgtaacaaatttacttttgtttatctgggaatgtctttaatttctcctttattctttttttatttatttttttttttgagacggagtcgtcctgggctgtagtgcaatggcacaatctaagctcactgcaacctccacctcccgggttccagcagttctcctgcctcgacctcccaagtagctgagattacaggtgcctgccaccatgcctgggtaatttttgtgtttttagtagagatggggtttcaccatgttggccaggctggtcttaaactcacgacctcaggtgatccacctgccttgacctcccaaagtgctgggattacaggcatgagccactgtacctggccttcttttttttttctttttaagatggagtctcactctgtcgcccaggctggagtacagtggcgtgatcttggctcactgcaacctccacctcccgggttcaagtgattcttctgcctcagcctcctgagtagctgggattacaggtgcacaccaccacacccagctaatttttgtattttagtagagacgtggtttcaccgtgttggccaggctggtcttgaactcctgacctcaggtgagccacccacctcggcctcccaaagtctcctttattcttaaagttttgctggaggtagatttcttgtcttacactttttatctttcatcatttcaaatatgtcatttcactgcctattgtcttccatggtttctggtgagaaattagcaattaattttaccgaggatcccttctgtgctcgcccttattcttactgctttcaagattctctgtctttggctttgacattttcattataacatgtctcagtgtggctctctttcagtttatcctactaagagttcattgagctacttcgatgtttagattaatgttttccccttatcaagttggaggagtttccaaccattatttctccaaatattccttctgcccctttctttctctcttcttttgggattcctaatatgcatctgttggtaagtttgatggtatcctacaagtctcttaagctctgttcatttttcttcattctgttttctttcattttctatttttttagagtagggtttcacactatcccagactggagtacagtgatgtaatcatagctcactgcggcgtcgaactctgggctcaagaaatctttctgcctcagctttccgagtagctgggactacaaggcatgcaccaccacactcatctcattctgttttctttctgtccctcagagtacgtaatttcatttcacctatcttcacctatcttcaagttcactgatctttcatctgtgtgatcaaatctggtattggactgctctagtgaatttttcattttagctcttgtacttttcagcttcatattttctatttgattcctctttgtcttcattgatattctctttgttgagacattgttctcatttcctttagttctttatccatggtttcctttagctctttgagcacatttaaaacagttgatttaaagcttttgcctagtaagtctactgtgtgttcttcctaagggacaatttctatttatttctctcctctaacccatgaatgggccatactttcttgtttcttttcatgcctcataatgttatgttaaaattttgacattttgaatattatgatgtgataactctggacatcagattttcctccccttctctagggtttgtagttactgcttgttgtaagttaaagttgttggtttatttagtgacttttctaaattatgtttgtaacgactgtactctttgttgttgtgtgatatttctgttcctttagcttagtagctggctacttgtttgatagagattttcttaaatgcctggggccgaaaaaagcaaaagaaaaaagaaaattccccaagtctttgcagattttctgcattcggacactccttcaatgcttagccaggccattcacaactctctgccttagccttgcttcctacttgtactgagcctaaaggtcaaccagtggtgaaagtgtctggtcttctcaggtcttttctgaacatgcatcttgctctgtgcatgcactttctagtttccctggtatacatgggaaattttccaagcccttatgccccaaagattctcagtttttctttcctgcttttagtatgtctattgtttcccttgaactgttaatttttgctccaggcagtagtgccttgttcatttggttttcagtattttcaaggaacattcttcccctataaaactactttttcactctaagagagttatgttaggtgaaactaaggcaggtcccttgtgtcagtccacggctaatactcagacatgtcaaaacaaacacaattccttgggaacaaggtactactccgtgctgtctttgggagcaggtacctacatcaggaccaagggctgccgtctttaagaccaccatgctgggtaaggggatagcagaaggctaagttaaaatgctacaaagttcttctaccttgtgctgatggcctttctcctggtttagcaaacacttggttactataaacctttgactatcttccaaagttcagataaggttggctttgacagttttccgtattttttggtgtttctagagaaggcactttctcccttggaggtctctactctaccatttttgcttgtcgttcccaggtggagttgtgtgtccctctgaccatcaaaataactagagtgacatcaattattttttcttttttttttttttgagacgtagtctctattgcccagcctggagtgcagtggcacaatctcagctcactgcaacctctgcctcctgggttcaagcgattcttctgcctcagcctaccgagtagctgggactacaggtgtgcaccaccatgcttggctaatttttgtattttagtagagacagggtttcaccacgttggtcaggatggtcttgatctcctgacctcgtgatctgtccgccttggcctcccaaaatgctgggattacaggcgtgagccactgtgcccagcctgtgttacatttttaatatctttgcctttgattttacttcatccagtacagttttttttaaatttgcatttgcactattgctctttgcccatccttttagccttttgagtcactttactcaagtgttagtaacatctgaatttaacttttttcccacccaatctgaaggtctctcttttgaaacaaatttattccatttaagtttactgttgtaaatgtttggtttaaattttattattttggctttttttcattctgatgtatttattaaataaaggtgtgttcaactaaatttcatttcaaagtaaggagaggggtgaatttcttgtgcgtggtaaaaaacacataccaaaaaattcccttcttaactgttcttaagtgtacaagtcaataatgttaaatgtattcacactatgttgaaaccaatctccagaactttttcatattgcaaacctgaaactctatacccattgaacaacaactgcccttgtccccgtcccccagctcctggtaaccactattctgcttcctgtttatgaatgattaccttagatacctcatatgagtgtaatcatgcagatttgtctttttgtgactgacttgtttcacttagcataagatcttaaagattcatccatataatccatgtagcatgttataggatttcctccctttttaattctgtatgatattctactgtttacatataccacattttgtttttctgttattcattgatggacatttgggttgtttccaccttttagctatggtaaatagtgctgctgtgaacatgggtatgtaactgtctttttgagaccttgctttcaattctttgggatacatacccagaagaaggattgccagatcatatatagtagttctatttttaactttttgaggagcctcaacactgttttccctagtggttgtgccattttgcaatgccaccaacaatgtacaagggttctaatttctttacatccttaccaacacttgttttttttttttatagtagccatcctcatgggtgtgaggtaatactgttttgatttgcattgctcttatgcttagtgatactgagcatttttttatatgctttttggccatttgtatgtcatctttagagaaatgtctattcaagtccacttttacttttttttttttttagaggtggggtctcactgttttgtccatcctggtctcgagctcctgggctcaagcagtctttccccattgacctccgaaagtgctgggattataggcatgagccaccatacctggcctgcccatcttttagttaggtatttgatttttgttgttgttgttgcgactgctttatattttctgtatgttaaccccttctcagatacatgatttgtaaatattttctcccattcaataggttgtctttcactctgttgattgtgtcccctgatgtacaagtttttaagtttagtgtggtcctgtttgtctatttttgctttcgttgcctgtgattttggtgtaatattcaaaaaattattgccacattgaatgtcatgaagctttttctgtaagagttatatgggtttaggtcttacatttaggtctttaacccattttgagttaatttttgtacatggtataagataagggtccaatttcattcttttgcatgtggatatccagttatccaagcatcatttgaaagctatccttttcccactgagtggtcttggcaccctcgtcaaaaatcatttgaacatatatgcgagagtttatttctgggcatgttttcttatttcattggtctgcttgtttgtctttatactaatatcacactattttgattactgttcctctggtaatatgttttcaaatcaggaagtgtgaatactccaacattgttcttgtctttcaaagttgttttggctattcaggatttcttatcatttttaatgatttcttgctatttccaatcttttttgttgattgctatgtaatgcatgtttcttcgagttggttttttgataacttagcaactatgtaatctaattaactaatatgcttcaaccactttctcaatctgtcagtgtcagatatgaaactatctattggctctattatatgaaaaattaagaaactgattttacttcttcccacctatcccccacataattttccccaactaaccaatagtggttatattttgtgaattttgtctcagctcatttatagtagtagtattactatattgactagcttctgtttcaagaattagaacattttacttacattttataagatcatgagttattttacattagttgtatttaaatatagggtcagtatttaccaggagtcttttcacatacctatttatgagtttgttaatttcaatctgttgtttgactagactgttaaatgttcaggagtgatcatcttttatgttcttgcaaatttgagactattacctttatgtaccagaacaacaactgagttggatataaaagttttgattaacagttcttaattcaaaactgttaattttgctcctcttttctggattaccagtatttaatgtttcatatgcttgcttgctttgtttctttctttattatttccatagtttggagggaacaggtggtttttggttacatggataagttgtttactggtgatttctgagattttggtgcacccatcacctgagcagtatacactgcacctaatgtgtagtcttttattcctcaccccgctcccacccttcccccctaagttcccaaatccattatatcatccttattcctttgtatcctcataacttagctccccgttataaatgagaacatacaatatttgattttccattcctgagttacctcacttagaagaatggtctccaactccacattgctgcaaatgccattattttattcctttttatggctgagtagtattccatggtgtatatgtaccacattttctttatctacacattggttgataggcatttaggctgcttccatgtttttgcaattgcgaatcatgctgctataaacatgcatgtgcaagtatctttttcatataatgacatattttcctctgggaagatacccagtagtgggactgctggatcaaatggtagttctacttttagttctttaagggatctccatactgttttgcataatggttatactagtttacattcccaccagcagtgtaaaaatattcccttttcaccacgtccacaccaacatctatttttattttttatttttttatttatggccattcttgcaggagtaatgtggtatctcattgtggttttaatttgcatttcccttacaattaatgatgatgagctttttttttttttttttttgagacagagtctcactctgttgcccaggctagagtgcagtggcatggtcttggctcactgcaacctctgcttcccaggttcaagagattcttctgcctcagcctcccaagtagctgggattacaggcaggtgccaccacgtctggctaatttttttgtatttttagtagagatggggtttcactgtctgagccaggatggtcttgatctcctgacctcgtgatctgcctacctcagcctcccaaagtgctgggattacaggcataagccaccacgcctggccgatgatgatcatttttgcatacacttcttggcctttttttttttttttccccgagacggagtctcgctcttgttgccctggctggagtacaatggcacaatctccactcactgcaaccactgcatcccgggttcaagcagttcttctgcctcagcctctggagtagccgggattacaggtgcctaccaccacgcctggccaattttttgtatttttagtatttaattttttgtatttgtattttgtattttagtagtggtttcaccatgttggccaggctgatcttgaactcctgacctcaagtgatccacctgcctcggcctcccaagatgctgggattacagacatgaaccatcgcacctagcccatttgtatatcttcttttgagaattgtctattcttgtcctttgcccactttttgttgggattatttgttcttttcttgatttgtttgagttccttgtagattctgcatattagtccgttgtcggatgcatggtttgcaaatagtttctcccattttgtgggttgtttgctgattatttcttttgatgtgcagggcccatctatttatttttgttttttgttgcatttacttttgggttcttggtcgtgagctctttgcctaagtcaatgtctacaagagtttttccagtgttatcttacagaattgttatggtttcaggtcttagatttaagtctttaatccatcttgagttaatttttttgtaagggtgagagatgaggatccagtttcattctcctatatgtggcttgctaattatcccaggaccatttgttgaatagggtgtcctttccttactttatatttttgtttgctttgtcaaagatcagttggctgtaagtatttggctttatttctgggttctgtgttctgttccattggtcttggtgcctatttttataccagtaccatgctgttttgttaactatacccttgtagtatagtttgaagtcaggtaataaggaggcctccaggtttgttctttttgcttagtcatgcttcggctgtgtgtgctgttttttggttccatatgaattttaggattgttttttctagttctgcaaagaatgatgatggtattttgatggaaattgcattgaatatgtagattgcttttggcaatatggtcattttcacaatattaattctagccatccatgagcatgggataggtttccatttgtttgtgtcatcaatgatttctttcagcagtgtgtttctcattttccttgtagagatctttcacctccttggttaggtatattcctaaggttttgtgtttttttttgtttgtttgtttatttgtttgttttgcagttgttgtaaaagggattgagttcttgatttgtttctcagcttggtctttgttggtgcatagcagtgctactgatttgtgtacattgattttgtatcctgtaactttactgaattcatgtgtcagatctaggaactttttgaatgagtctttaggattttctaggtatacagtcatatcatcggtgaacagtgacagtttgacttcctatttacctgcttgggtgctctttatttttttctcttgtctgattgctttagctaggacttcgagtacagtgttgaatagcagggatgaaagtgggcattcttgtcttgttccagttctcaggggaaatccttttaaccttttccccattcagtataattttggtgtgggtttgccatagatggcttttattaccttaaggtatgtcctttctatgccgattttgctgagggttttaattataaagtgatgctgaattttgccagatgctttttctgcatcttttgagatgatcatgtgatttttattttaaattctgtttatgtggtgtatcacatttattgacttgtgcatgttaagccatccctgcatccctggtatgaaacccacttgaccatggtggattatctttttgatatgctgttggatttggttagctggtattttgttgaggacttttgcatctgtgttcatcagggatattggtcttttggttctttgaaaagataaacaaaattggtagaccattagtgagattaaccaagaaaagaagagagaagatccaagtaaactcaattagaaacaaaatgggagatattacaaccaataccacagaaatacaaaagatcattcaaagctattatgaaaacctttacatgtacaaactagaaaatctagaggagatgattaaattcctggaaatatacaacccttctatattaaatcaggaagaaataggaactccgaacagaccaataacaagtagtgagattgaaacagtaatttaaaaaactgctaacaaaaaaaagtccaggaccagatggattcacagctgaattctatcagacattcaaagaagaattggtacaaatcctactgaaacaattccaaaagataaagagggaatcctccttaaatcattatgtgaaaccagtatcaccctaataccaaaaccaggaagggacataacaaagaaactgttgactcgctctttctgtgtttctctctgccccgtgctgtctcccctgcagtctctgcagtccaggccctcttctctctctatgatctctttgcactctgtctgtttctctgttctgtctgcctctgctcacccacacgtgcacttgtgccccacatgccccaccctcgttctctctggttcccactgtgtctgttgtgtgtctctattcttcttctgattactctttcctcccccacccttatctctttaatgttattgctatgtttgtctctgtgctttctctgtgtgttttcactctttttctttcctgtctcccttctgcagttctgtttcttggtgtctggttgtcttctggtgggggagaagggatagtttactattgtcagtacaaaaagtgaagaaaaaaggtcattcagtagttttcctttatgaagaaaaagctgaagatggtgaatgatttctctgtattttagatctctccttatttatattagctcatgtttccagcaggtgggcaaataaacaacacaagcaaactaccaaacagagagacctccatgagaaaagaaaatgagagctttatgtccaactaaatgtttattaatgtttcatatatttttgtaaaatggagttcatatcagactttacatgcctatatacgaagagaaattacactcaaaagcagcatcctgaaatccaaagcgtaaatttttttatacgtttacagagaaagagttaagatataaaactatgtatacatattataatccaaatatacatacctatgtgtatatatatatacgtatacatatcagtatcaccggaacaaaatatatgtcatacatagaacaaaaaactgaaattattataaaaatatgaattatgattttttcttttatatttttgtctattttttacaagaattatgttctaataagaaaccataaaagttgtttttgtttaacaataatagaataaggtaagccagattgataaacacaaaaagttataagcttagaaggtgaattcccaaatttctcattgacttctattttgggtgtaaaagaccattttgagcttcccaaactagtcataatgaacccttctagaagtatagtgaaataataggattagagaactagtatacatggtttctgtgtcatgataaagtacagttttcttttaacttccagtgccaagggttgagttaaatgtactcctcagttcatgacccctctttttaaaattttatcaccatatgccatcctcatttctgtctccccataggaaaccagtcttatgtaaatatctttcaggttacatgagttcttacaaaatacatattttttaagtatgcatgaactttcatcatatataaaaggtgtaccattatttttgttatgttggctaagttttgtattttcaaagtctgcctacattgctgtaagtatatatctacattgctgtaagtatatctaatcacataatgctccatggagtgcatctacccacttacgcatgaacacccaggagcacccaggttcctgtcagttccccagcaccacagaacatggcagtgctgtctttgtccatgtccccttatgcgtctgtctgaaactgtctttagcatatatacccagaagtggaattcttggcttacaggctcgtatacttaatttcctacattagtaccaaattgctttccagttcatattcctacctgcagtgcatgaaaatttccatttctacttctctgccaattatttctaatttttatcagaacactagtaaaacaagtttctataccatgggaagataggtgttttttttttttctttttaatgagatgatacttgtcttgaacatctagagtatctctttaatttccgtgggaagagagtttttcatataatttacagtgctttcaaccagaatacattcgtttgttcattcatccaaacataattatagaattgacaaaagcacagagtgacatactttaataagcttttctcagatttatatatatgagtgagaaaatatatggaaaatttttataacaatatttaaaaacttgatttaaatatctggtaaaacttcattgtcaaaacacagcatccacatttgttccaaatacccatggaatatttacaaaattaattgtacgttagacaaaatattgatgaattctcaaagcagaagttttataagtaagcccatattctgtaactgtaatgcagtaaaattgaacttaacaactataatttttaattttgctaatgctttaaattgcatttctattaggtttcagatttgccatttacatttcttactttgagaattacctttgtgtatcctttgcctgtttttctctgaaggtttttttcctattcatttttgtaaacatatttggagaccactgtagttgctgtttttttaaattctgttttattacttttttttttttttttttttttgagatgtctcgctctgtcacccaggctggagtgcagtggaaagatctcggctcactgcaacctccaccttgcgggttcaagcgattttcctgcctcagcctcctgagtagttgggattacaggtgcgcaccaccacgcctgactaatttttttgtatttttagtagagacggggtttcaccatgttggtcaggctggtctgaaactcctgaccttgtgatctgcccacagcctcccaaagtgctggaattacaggcgtgagccaccgcgcccggccccttttttttcttttttagagatgtggtcttgctatgttgcccaggctgatctcaaactcctggcctcaaccaatcttcccacctaagccttctgagtagctgggactacaggcatgtgccactgtgcctggcttcctattgatttttaagcttaattacattgtgttaatattggaataaataatattgttatgtatttctttatttctgtgttcatgctaaaaaagatcttccaacctcaagatttgtttttaaaaaattatcctgctttacttttgatactttttgagggatatggaagctttaagctttaatttaagcttaagcttttaatctacatggaatttatttttgtgtgtataggtataaatttatttccaaatggtagctagttgccaataaagatttttaaataaagtaatgtcaataaattaatttattagaaaaatctaatgttcttttgttaagctagactccaatcagttagaattggtaaataattggcatggttcttttgaaatttccgttcaaaacaactgaaataacatatggacaccttataaaaattgacagacctgaagaggaaattaattctgactgaaacatgaaggagttttatttattaaacttgaagttggatcagatcatccaagtgaaaatatctaacaagctagatggatctgaccccatgaggatatcatgagtgagatgaagattttagagtcatccatgtaaaggtggtggtaattcttatagttattaaagccaagaggaaacatatttgggagaatgcaaagaataaataaatgtatagggctacttccaggctgtagtttttcaaagctgatagaaaaacctttgggaaacatgctgtctcgctctatcaccctctacaaaattgtatgatcatttgtcaaccttctggttttcctgtgagttaattgagtgttttagctcttgattcattttctttctgtccaacccaaagccctaccattatctgggaaattttattatcccattagagttttttttaccttagttgtaatgatcattgactgtaataatttccactgcattttagccatacattctcttaactattgtttgaattttggattcactcaaaattatttgttctctgcaatctttacttcttcacataccaaaataaatttttcaagaacctgttatgcaggcacagtacattgttaattttctgaggaagattttccatagttttctgatcaaccacactggcagaaatagataactagttctaatttccaaaaggtaagtaatagatagttaccacctgagtttctgcttctgcaaccttttttcactaggaattaaatgtatgtcacagcattattttttggacagacacttggtcattgtgtcaccccttggtgatgagtaaattttattgaaaatatacttgctgtttgattgacacagttctataaacttttcacaagaaaagacagtcttttggtgccatagactatatttctcattttgactctgactgttttatcaatgtgtgtctctggtcctaagcctgagtgattataaatgaattagcgtaaacccatgcctctaaaggaaaagcatctcccagcaggcacctggctagctgaaggccagcagtaccaatcctcctgcctgaagaatagcagtgtagggtcatatcagaaaacatggcccttttcctatgttggatatgtttttctaagatcagtttccacctaacaagtaattttttaattgaaaagcttttatttctaggtctgtctcatgtctttaataaatacgggaatgagtctcatttagttcttaagctaaagagtactacaaaaaccctgaaacatctctgagatggtacatttactttccattgttactcttgtataagacagcaacaggtgagtttgctctcatagtggaaattaaaacagaagcagccagccagcatatatttccttccaagattgtgtacaagagaaagcctaacccatggtggctgataatgccatttaatatatagtcacctaaatctttatgtgtcagctccattgcagaggactcagtgggctactccacacccaagcctgagggatgaggagatcattagagatgcgtgggactctcccacggactaaggaaagtgaactgttttggtttactgaccgcatatataaatggattcaggaaaaaaaaaaaaaaaaagttccatcccatgatgggtcctcagcacaaattgtgggacatgagtgcagatgtgtgcattgtgattattgtgaatccgtggatggattcaacatcacatggcacggttctgacagtttgtgcttggcccagctttagagtagtgctccatcactcctatagcatccagtgcccacctttttttaggattgtttgttgtttattacatgaaggcaacactgtttatcactttccaaggttgatctttttctgatttcggtaacataggagatgcagaactatagagtataaccttttttctccaaacaagacttcatagtccacatttttttcagttggcatacaataaataagtgcattttatgcctttcttgacatattttccatgccgtaaactttacctgtttaaagtgtacagtttaatgggtcttgatttagtcacagaattgtgcaaccatcaccgtattctgattttagaatattttaaacaccctccaaaaaaatcctgtaaacattaacaatcaatcttcatttccccagcctcccacctctgccacagcctgcaggcaaccactaatgactttctgtttctatggatttgcctattctggacctttcatataaatggaatcacagtctttcgtgactgacttcattcacttaacatagtattttcaaggttcgtacacctcatagcatgtgctcattccttttaatggccaaaggacattccattctatgaatataccacattgtatctattcatcagttcatggacatttgtgttgtttctgttttttgtctattatgaacaaaactgctatgaatattcatgtagaagtttttttgagggcatatgttttcatttctcttgggtatatacctaggagtggaattaatcatatgacaactctatgtttaaccatttgaggaactgccagacttttccaaaatgactgcaccattttacattcccaccagcagtatgtgagggttccaatttttccacatcctagtgaacagttgtttttgtctctgtctttgattgtcatcttcctactgggctggataattatattgggttgagagagaatttattcttagacttttctatttttaaatgtttacctttttataggcaagcattactaaatgaaaaagaatttgaaatgaaaacggaaacattccaaggctcctcatataatccagtgtaattgtgtgttttttcacaccctgtggtgcacaccatgactacttgtgtcctttggaagtgcaggatgttcacagaacctcagacttggaagggaccactggagtcctgtgaatcctacccactcccatcaacacttctgctgcatctgcaccaaatgacaggccaccctctaatagctccacctctcacgtgctacttatggggcagccagttccatttgcctaaggcttcagttatcaaaggctttaacttaaatccaatatctccttgcattggaatacctggctctgctcccagagctgctctctgaaggcacaggaaacagacctagccctctgcctctcggacccccacctcctttcctgatgtgttttttctcaggtcttcactccatgaaccgttccacatgggctgtggtatctactctcctttctgagtttggcagctttcctgggtataagtttgttggtatcttgtttttaaatatgtccctctcagctaagcttgttgtgcttcaggtagtgagagcgtattgaccaacacaacttaccaccttccattcagtgactggaccatgtctgtggcctaacgtatgttattccttttgaactccttaaatcttttctgccacacccttccccacaagtttttgtttattctcatttcttgaactggtaatacagtacaaccacatgatacaaaatatttgatcaagagtgtccttcctactcctgttccccagcacccagccctccttcgcagaggtatacaataaaatttcatccattttaagtgtacagttaacttttagtaaatttacagagttttgcaatcatcaccaaaatccagttttagaacatttctgtcgttaccaaaaggtgcccttgtacctctttgcagtcaatccttgttcccagccccaggcaacctctcatctgccttctgtctcttctggagattttatgtatatagcatcagatgtggtcttttgcatctgcctttttttgttaacatcatgatttcaaggttcatccgtgctgtagtatgcatcagtggttcctttttgttgctgaatagtgttccattttatggatataccacattttgcttatctttcagttgatggacatttggattgtttgatttttttggatgtgaatgctgctattaatacttctgtaaaagttttgtgtgggcatacattttcatttcttctgggtttttactcaggagtgaaattggtaggtcatatgataggtttatgtttaactttatcagaaattgcctaagtgttttccagagtggctgtatcattttacattctcgcctgcaatgtgtgagggtttcggtttctccacttccttgtcaacacttgctattgtccacctttttatttatagccattctagtgggtgtgaagtggtatcttattgtgagtttaatttgaatttccctaatgactgatgatgttgaacattttgtgtgcttattggccactcttacatcttctttgatgaagtgtctttttaaatctttttgcccattttaaaattaggttatcttcctactgagttgaaagagctctctatatactctggttacaagtcctttatcagatgtattttttgtaagtaacttctcccaggctgtggcttttgaattgcaaatggttttaatacagtaatgatgaagtcccatttaaactgtttgtcttttatggattgtggattgtacttggggtgttatattcaagaactgtttgcctaaccaaagtcatagagatattctcctatgtttttcattaaaagtttattgttttaattattatgtttaggtctgaaatccatttttagtgcattttttgtgtacggtgtgttgtctaacttcatctctttgcatagggatatttaattgtcccagcatcatttgttcaaaagagtattattttctccaattagttgctttggcccttttgttgaacactaattgatcacatatgtaaggcttcatttggaattttcattctgttccattgatatgtctgtatctttttttttttttttttcttaagacggagtctcactctgtcatcaaggcgggagtgcagtggcacaatctcggcacactgcaacctttgcctcctgggttcaagcgattcttctgcttcagccttccgagtagctggaactacaggtgcgtgccaccacacccagctaatttttgtatttttagtagagaccgggtttcaccatattggccaggctggtctcgaactcctgagtttgtcatctgcctgccttggcctcccaaagtgctgggattacatgcatgagtcactgtgcctggccaatctagatctgtccttatatcaatgccacaatgccttgattgctgtaactttataagatttgaaatcaggaaatataagccctctacctcttttttttttttttttttcttttttttttttcagtaactttggcccttgtggtccttgccatttctatataaagttgagatcattttgtagatttcttgaaaaatgcttgctggaattttgatagagattgtgtagaatcaacagattaatttggggattattgccatcctaacaattttgagacttccaatccatgtatggtgagtgtctcaccatttatattgacttctgatgtctcccagcaatgttttctagtttttaatgtgcaaaccttgcacttcttttgttaactttattcctaaatattttattctttttgatgctattgtgagtgagatagttttcttaattttattttcaggttgtcacttgctagaatgtagatatacaattgatttttttatcttattgatcttatattctgcaacctgggtaaccttggttattagttctagttctttgaggattccttagtattttctacaaagaaaatcatgtcatttgtaaataaaaccagttttacctcttcctttcaatctggattcttttctttcagagacattttataaataaaaaagcaaacacctacatatacttttttagtacctaacatgctttcttccccttttttatagctgcagagaaggtataatgtatttcatatcagtcacttcttttttatgttcccttttttaaggagaaaataaaaatatattttttaacatcattttagtctctagttttatatcagtgttttatattttaccatctaaatcatctgttatttctaaaatgcagatttcgtttccttttctagatggggaaactgacacaaagaggttatggcttgcctaaatagagaccgctaataaagggaagacctgaaactggcctagctgtttggaatcctgacacagagcttttttttttttttccctgcatcaaagttgctgccattcctcctgcctaatgagcaggactttacaattgcccctactaaacatgctctgatttagcccatcattcctgttattatttgggatcctgacagaggccctctctctgatgagtattgtatgtaaattctcctgctttccatatctaagacatttatgtctaaaatcttaagaaggaatagccagcaccaaacccagtgattgcacacagtaattgcttagtaaatatttgttgtcaaatgcaagatgtaccactcagtaaagacatctgttttgaaattatatttggataaggttggttcaatcagttatgattctatcaacttgtattatcatccaacccatataactccatcttgccctcaaagatgctattaaatgttttggcattttgttcaaatctaggtatggtatgctatgtattcttttggttagccagtaaagtgaccttatgtactagagaaaacaaggctaacctggcagggcatgctctgcctgcctgactgagcctggcttaaatctgctcatcttttttttcaccagttccttgcaaattatctgattcgtgatgcatcctaaattttacatgtcatcagtgttcagcccactagtttgcaatgcctacctttccgaaaatcaaagtatttcctttcttcaagtgtctaacatagatcttcctccccaaaattctgttacaagtttctttgtgactctggaatatggtttatctagttcaagggatcagatatgctcagtttcctatccttaccctggctttaatttacctccaccagacctgcctaagtagaaaattccctaacatttattcaaaatatagattaccagacccctcccctagagattccaattcattattctgggttagcctccctctgtccttattaacgatggagatattaacaatgaacaagtttaagaagcactattttacactatagtatttgttcagctatatcttgttaatcattttgtcatccaccgacattccaccatcagctgcaatccctgaaattgccttcattgctctacttgctctgaacgtaatttaaaaggcctttgggactctctaatactttttgcaatgctctactcatcaggacgtctcacgagccttgtaggtctttggtgtttgtcttagtatacgtgtttgagtcagctcttaattggagagcgctctcttcagttcatcactctttttagctatctccaggcctctttatctcacatgaaaattatgtgcaggtgtcacttcagaatttcattctgaagatgcatcagactaatgtttggctagcattctcttcagagtttttccaagcccagtgaaaatagccaggcttttttttgtcttaccaccttataacagcttaagtcctatccacctacaacattctccctatcacagatacaaggcagcaagttcacagtatctcaagcttcctccaaatgcatctcaacagtttgaattggattagaaagaggacttgttggcttgcttatcctgtggataactgtgacattgactgcaggtaataataacaagatctcttttatttttctaggtagcaaaccatgtgatttcttctgactctatttcctcttctgccagtagtttcctgagctcaaactctactttttgcaacaagcagaatgtacacatgttaaacaagggcatacaagcaggtaattacttgaatctaaactttttcattgaaatacattgaaatggctcttaaacatgtaagatactcaacctcaatcataataaaggacatgaagataaaactatatccaactgccaattttcatcttgtcagattggcataaattcaagtttgatggcaagtttgtgggcaagagtgtagggaagcgggttcccttgtatatttcagtgggagtagaagttgattcactgtgaaaggcaatttgaaagttcctatcaaaattactttcactcagcatttttacttttgaaatgtctgctatagatatactatgaatatgtggaatttaacctatagatatacttgcatatgtgcaaaatagtgtacaaaattaaccactaaaacattgtttatagcaggagattaaagtgaatttaggtgttcctcagtagctgaatgattacataaattattgtatgtctagataatgaatgaaattctacatagaatgaggaagctctctctgtactaacatggaaagatttccaaggcatgtaattgattttaagaaaaggtacagaacagtgtatagcatactacaatatgaattttttttaataaaagaaagaaaggagggaagagaattgcttaaatgtgcaaaacgaattctctggaaccatatggggttgtgaacagaataaatggagaccagaagtgggaaggaggatttttagctattgcctttctataccttttggtttcataaaataaaaataaataaactttcatcttgatttgtttcttcccctcaaatcctgtcttctgtcagcctcttccttacctgcgtgactaccaaaaggactcttaagtatttattgtctttctaacttgggatcagagttgaaatcctttaccctttgaacccatattcattcttctttccctctcatacctaaaatgagttacaaataaaaccctttcttttttctttgccctctttttccctcctactctcccctgtccttctttctcttcctctctcttcgcatccctccatcccacacaaagggattgtatttttgaaacattaaaaagggttcacgtactcacttgaataaatctgtcaactcagcctcaaggttactcccagagacacctatgatccttcccctcaggtaacttggagattgtgaacggtgccaaaaaacacactcgagatgttgggataactttcccaactccaagttccagcgaggctaaattggaagagaacagtgatgtgacttcttggtcagaagaaaaacgtgaagagaaaatgctctttaccggttatcctgaggacagaaagttaaaaaagaacaagaagaattcccatgaaggtcagtttctcattccagatcttgtagtagagaaactagtgaatttcaagtcccctgcgatgctgactctgtgtttccaagtgactctatgtggtccccacctacccccagccacaaccttgtcaggttttcagagtccagcatggcagttacacagtcatccctgcagcaaaaccagactcaagggcaccctgtggcctctgacagctgagacccctgagaacctgtattatatgcatatcctggataagagctgggtggggctgtaaaaaagtgaaaaatctgtgttccttctaaaaactgtttcctgtaggagtttcctggtttgttcctgtggaaaatgtggagtctagatcaaagaaggaaaacgtgcctaacacttgtggccctggcatctcctggtttgaaccaataaccaagaccagaccctggagggagccactgcgggagcagaactgtcaggggcagcacctggacggtcggggctacctggcaggcccaggcagagaggctggcagagacctactgaggccatttgtgagagcaacccttcaggtgcagtgacgttgacttaactttaatgctacgtgtagggagaagaagggcaaggcgcagagaagctggctctgtgacttggtgagctgaggtgtaggcctgagacgctcttttccagcacctccgcagttcacctgttttcacgcacgagggttgggtttctcatcatctgtcaaaggctgccttactcctaaccatagatggtgcatcaccgtcgggatctggggacaaggccgcaggagggaggatttgcatctctgcttattgggcctgtgggtccctgtgtgtggagggcccggaggcctgacgcttgtgcggcctcatgtgtgttcctccatgtccgtagctcctgtttctgctccatgtcggatttaaaggaaaccaggtctcttctgatgtgtcccttgggggataaaggaaatgttattaatgatgtatttgtctgaatagatctttaaaatagcactgtgggaagagctgtattgcactgacatttcaaagagttgtaatcgccatagtcttagttcctggcctatgctgaaggcatgtctttgatccctgcggtttccaagctgcagctctcccccatagagagatgtcagaggattcttcaacgctagatactttctcggcatttgaatcagacttccccaaacctcttgggcaggtggtgtgtctccaggcatatggagagtagattgcatcattaatctgaggctgggcattttctcttttttttttcttttaggaatcgcttcagtttcacagacctgacttcatctcccgctctggggagcggataaagcgcctgaagttaatagtccaggagaggaagctgcagagcatgttacagaccgagcgggatgcactattcaacattgacagggaacggcagggccaccagaatcgcatgtgcccgctgcccaagagaggtacgccctgcccgttcactttcctgtgagtggaatagagaaggcaaggtctgctgctctgctgcagagccctgctaaaggccagcccaggccagttacctgggcagacagtgaccttttgcttgccaagactcaaaccttcttagctagcagaatctccccaacttagccgtcagcacattcatgatccaagtaagcccagttactctaagccctgtcactgcatcgtaaaccagctctgtgtctgtgagcaagttagttccaaaagtatattgatttttcctgaaaagatggggctgattccaggcttgcctacctcttaggatggtaataataataataataaacacatagtccttacatcttgcccaggcactgttcacattagcgcttacagcactctcagtaggtactattaatatatctactttatagtgagaaaactgaatcaaagggagattaagtacctctcccaagatgacatacctagtaagtaaaagctaagatttgaacccaggtgtgctcctctggagtctgcattcttaacaattatgataagcagatcttgataaaataatgaaagctgtgaaaactacaaagcactacctaattcttttatccaactttagaaaccggccagatttttaattcaaagcctagtctttgctacagagtgttaggtccttagggccttaggctgctgtccctgttaccctagtcttacactggcttgccttggtcattgctccccactcagtcttgccagctcagggtaggggcaccaagtcctagcagctccctctcccagctcttgcaccacaccctctgggttaagtcactgtccactgaaaaccctttcttctcttgcctagtcttcctggctatccagaagaacaagcctatcagcaagaaggaaatgattcagaggtccaaacggtaagaccaagaaaacaagagtacgtatacaagtgtaaaccaggccaccaagtggtcgggagctctggcttgcacccagaataaatgtattatactcaagtttaaacattatgagaaagttgtgagagtcatttctcacttatggcactgaaaaaaaaaaaagcacatcatggtatgaatgactcatatgcaaaagatgaaaaacttctcactaatttgcatgtcttaggctcctctttattagaaacctaaatgtaaataaagaatattttaggccaggtacggtggctcatgcctgtaatcccagcacttagggaggccgaggtgtgcagatcacatgaggttaggagttcgagaccagcctggccaacatggtgaaactccatctctactcaaaatacaaaaattagctgggtgtggaggcacacgcctgtaatcccagctactcagtaggctgagccgggaggatctcttgaacctgggaggcagaggttgcagtgagcttagatggtgccactgtactccagtctgggcgacagaacgagactccatctcaaaaaaattaaaaaaaaagattattttgaaataaaattaaatatgtatttagaccacatcttttattctagcaatcccatttctaggaattgatcccatagggtgagaaagaacagtgttctccagaacacagtaagttaaacttttttaaaagattaaaatttcgaagcatgtgaacactgtttccatttgtggtctttaaaaataagtatttgtgcctatgtagatgtgtgtacttttatatgcatagaatatttctggaagacagaaaaaactggtaatactgattgcctttggaaaggataacagtagattttttgactttttataatttttgaattttgtgccatgatgaacgaacattagctactcgttaattaattcatttgagtgttgaatgtggtggtacatttctgtaatcctacctactcaggagtcttaggtgagagaatctcttaagcccaggaatttgagactgcagtgagctgtgatcacaccattacgctccggcctgggtaacagactgaaactctgtattcaaaaaataataaatacaatttttaaaaattaattcatttcagatattcatatattgatcatgagaatgccagagaataaggttgacttttttaggcattcattggacacttgctttaataagaatagtttcttagttggcataatgcttctgaagtaatggtactttaaaataatttatctcatgaactttaagcattcctcttgaaatcttgtttttactctatctagtcagcccttataggcaatccaaagggatgctttggatgctttagtccagtggttctcagagagtggtctgtggagtcctggaagttgctgagaccctttcaggcaatttgcaagctcaaaactaatttcagaatgacaccaggatgttctgtgccttttttgctgtgttggctatttgcactgatgatgcaagagaaatggggaggagtaaaatcactggtgtcttaccactattcaagacagtggcaccaaactgtagtagtctagtaggcattgtatcctgcacagcctcccgccaggagtgtgatggaagaacaaggaagcagtgtaaatggaggtacacgggaagcacttcctttgcaccgtgaaggatgatgactgttttaaggaaaagcacttatgccatggtttgtgtcgtgagctgaaccagctgcctttttcatggaacatgacttttacttgaaagagtaactgacagaaaaccaattattctgacttgtgtttgtagcagacattttcttgaaaatgaagaagtgggtctgtgacttcaggaaaatgtctgacagtatctgttgccaaagaaaatgtgagttttcaagccaacaatagaaatctagaaaacttgtattcacctccatgggcttgatgacctcttagtacttagacctttctgacgagataagcggtggcattaacaaatgtgatgtttttcatgttatctaaatacatttgtcaacatttggaagatctgcacaactccctggaccaggattttccaaatgattgttgctttttgttacaaaatcagggaatagatagaagattcattcaaataatgaaagatagactgatggatttttatgtaacagaataggaaaagtttatgacatgttttcagattccaccttgcaactaatttttaagaagctaccacttgtcagccaggcacagtggctcacgcctataatcccaacactttgggagtccaaggtgggcagatcacttgaggtcaggagttcaagcctggccaacatggtgaaagacttctctactaaaactacaaaaattagctgggcatggtggtgggtacctgtaatcccagctactctggaggctgaggcaggagaattgcctgagcctgggaggcagaggttgcagtgagccaagatcgcgccactgcacaccagcctgggcaacaagtgcgaaactctgtctcaaaaaaaaaaaaagaaagaaaagaaactatcacttatcaagtttgggtgtagtatcaaagaagatcaagagttacctgaaaagagtattgcagtaacttctctcgtttccaagtacgtggaaaatctatatgtaagctggattttttaatgtatactttaaccagagcaggttgggacagcagacttaatacagaagcagatacaagtccagctgtcttccattaaaccagacattaaagagttttctaaaaaatgtaaacagtgccactcttctcactaacatttttttgttttcaaaaagtctttatttcccattaaaaatacaggtttcttatgttagcctgtcacaggcttattgttatttcaagtgaataaaaaaataaagttttgcttaatttttaattttaatttttgatacagtatcaatagataaaacctacattgggatcttcagcatttgggagtgtgaagggggccctaagtctaaaatatttttgaaccactgcttcattctaactcagtcacaaaatggaattaggggaaatcatacagggtttgttgtggggcagctactaatactctcacctcagcaagagcagtccctgctgtaagggactaggaagcttgcctacaggaagacagccaggacatctcctaaaatgtatcaatgctttcgacgagaaatatatgagtggatttagtgcccatcttctggagagactttttaaactgtttttaaactggtacattttcattaggttgcttctgttcatgtttatttcttgtgtggcctcttttcaagggagtgatctgtttccatctgagaatcttcaatatcatctagtaactcttaatatttaggaaactacaacccagagaggggaagtaacccagcaagttagggtcacagctggagttagagcctggtgtttggccttcaattgtgtcctattaaggatttgtgtctctggagcctgtgttactcatcttttgttatcacctatctctaccaaagatatttaaaggttcccgtgagaaggaaagatttcaagaggaaagaacatagctcttttatttggaagcacttgttccagagtggccttcaggagacaccttcaccttctctaatgtgtttcccgcagagccctccatgaatctagtgattttttttccagattatagaaaactttaggaaatatagagaaaagtagaaaaaagaaaatgaatatcacttatcatccttccatctaatggaggatgggaatttttggtgggaggcgtgggaattttgcagagacctgcataacacacacttttttccctcaaattgttaatcatactgcatatacaggtttgtgtcttgctttattttattcaacattatgttgtgaacctttcctatgacactaaaaattctgaaacttttgtttggtatacatgaaacatacttgtaacatatacattccattatacttcataatctatttaactgttgttttgttggaaacgtatttacaatgagagtgcatttatcaaatgcacatttgtgtttctcccaacttaaaatcattgccacccaacccctgctagaacagatcccatgtttttcacatggccacaagatcctctctgcagcccacctcaccctcacccccatctgtttcccacctattcctttacgctcctttttgggaagcctcgagtccatttttaccaacactcattttccccaccttgagtgtcttctgtccttctccccattccctttctgctcttatccatcattattatttttttattattattattatttttgagatggagtctcactttatcacccagctgtagtgcagcagtggcttgatcttggctcagtgcaacctctgccacccaggttcaagcgattctcctgcctcagcctcctgagtagctgagattacaggcatctgccaccatgcccacctaattttttttttttttttttggtgtgtgtggttttagtagagacgggctttcaccatcttggccaggctgctcttgaactcctgacctcgtgatccacccacctcagcctcccaaagtgctgggtttacaggcttcagccactgcacccagcgctcctatctattcttaagacccaacttacctataatttcctctctggagcctttccgaacctccttccaccagaccaagtttcttctcctctagaacattttataggtgtgaccattttagtacttttccataatttcacttgtgtttccaaacacaatagtaacgctgttcattatcttatattgaaacagtccatttttgcatgtagagcagaaagtagaagttcagctctccttcatttatctcactcctttcccccctttatcccacttctttccacatgtaagcactattaggattttattgtgtttgtatttatctccccttccagattgtgagccccgggctagggttttctgtgctggagtatctaacggggcccagggcctttctgagagggatgagctcctggagagtgggaggtatagggagggatgatgagaggagatctcatgactctgcaccctggtaacctccccgatttctgtcctttcactggtgccatttctaaggatttatgagcagcttccagaagtacagaaaaagagagaagaagagaagagaaaatcagaatataagtcataccggctgcgagcccagctatataaaaaggtcagtgggtcctctgtctagagtgggatggatcaggtttattggcggaaagagaaatggagaaaacacgttgcctgttgagtgtgaagtcagaatgaaccgcatttgaggaatgaacttagaatgcactggaccagtgttgaaatttggaagaaggcatctgtaattagacttcaaatcaggtttaactccccatccataatggtgtaaggccctttccatgcattcgtttgcagtgaaaccaaatttcacacacaggagttcattgacatatcatggtagaaataccagaattatcaggtttccattccagagtcccaggtggtgatttcatgcccctcattggtgagtcagatacctttagaactgttaaactggaaaatgtgtaactgcggcataagagttgtccacttggatggtcagaggcctccaacttgtcaccatgccctgcccattgtcccagtagagtcagcgttgctgcaagtccaagaacctcacggggcagggttggtgttaccagttaattctctgagaaaccagaccggctcctatgcctgaagggccatatacttcactgtagttgtttccttctcaccctgtcagtcaccagactgatgtgggatgggagctgcttctggagcaggccccagaacccaggcgggtgcctcaggtggaggccccaggcaccacaccacctgtctggtgtgtcagcatcgcagggccaggcctctccttatgctactgtatgtgggaactgatggattatctgtgtctctatagaaataatagatattgattacagatcctctttcctgaacctttcgtgaagtattttttatatgacgaccatagtttctgaagcagagtaaaatgaacaagatttgaataggaccacactgattctccttggtgacatggatgcagggaggagaggcatctgcctctgatggcagtaatatctaacttctttcctgcctttcttttcttctacagagagtgaccaatcaacttctggggagaaaagttccctgggactgacacaagtttattttcctcagagccttggaattctattttatgaacctagagaagcagaatccttacttttgtgagtctggttgaataaagcttattctttgtccatgtgtattttagaaatagtaacttctaaagagtctggaacaaagtggtgattaaaattcctaatggtttgggagcaatactttctgcatagtggccttgtccaatggcctgtgtgttacaatgatatgatcatttctcaagaataagtccctttttgtatgtgtttttatacttttagaaaataaaaactttagattaactc

SEQ ID NO: 61509 - DNA, 5901 bp, Homo sapiens
gagctgccctgaagagtcagccgaaagagctggaggcttcttccctgtggttgcgggttcctgcattctctgctctaaatcccagcctgcccttggggctgcccacgcccccttcagatcctttgctccggagagagacctgtccgagcagaggcctggactacatctcccggcgtgcctggcagtgtggtggcctctgtgcgccgtctgcactcgttgcaggcgacgatgcagagggctgtaagtgtggtggcccgtctgggctttcgcctgcaggcattccccccggccttgtgtcgtccacttagttgcgcacaggtgggatagagggtgctgatcttggagggtgggggagggaagcggctgggggctagggccctggtggcactaagcccagccgcccacaggaggtgctccgcaggacaccgctctatgacttccacctggcccacggcgggaaaatggtggcgtttgcgggttggagtctgccagtgcagtaccgggacagtcacactgactcgcacctgcacacacgccagcactgctcgctctttgacgtgtctcatatgctgcaggtgagccaggggagcacactggccatctgatcaggccttcctccctgtttacagtggtccactccttggctttgtttgctgtgaactggattccaaggacagccttctcagaagagctagaggtcatgggggtgtcatggataggtcaatggccccaaggaaatgagctcagagggtctcatcatctcatccttctagcttgcccccattaaatggtgtgccttaatgtcccgggttttccagggctgacacccactctcatgtattgggctggatgttggtttgaaaaggggttatttcaggaaggtgctaggtcctgtccagttccctggcagtccccccacacagagtgactgggggaggtcaggaaatcagaaggtggtcctttgccacgtgtagaaccaaaagactggttagtcactttgggtgggctggactgcactgtggatggcagggaggatgcatccttgcttagtagccttttggattgtagctgttgcaatggcctgaggctttcaatctcttccccagaccaagatacttggtagtgaccgggtgaagctgatggagagtctagtggttggagacattgcagagctaagaccaaaccaggtgggcccttttatttctgctctatgagttttcttagtcatgagccagcaaatgggctgagtccctacctcaggcttaggggcacagagatgagtcaaacacagcttctcagggcttgcagtcttggacagaatccctgagtcatttccagagacacagacatttgtagggaggggaatatcccagtcttactacatcaggctaggaggccagaaaccaaggttaatatgctgctctctggccatcccttctgcttaacccctctctattcaacatgtggtccctggccaggcgacgtgactcaaacacctgtaatcctggcacttggggaggccaaggcgggtggatcacctgaggtcaggagttcgagaccagcctggccaacatggcaaaacctcgtttctactaaaaacacaaaaattagccgggcgtggtggcgcgtgcttgtagtcccagctactcgggaggctgaggttgcagcaagctgaggttgcaccactgcactctggcctgggcaacagagtgagactcagtctaaaaagaaaaataacaacaacaaagtgtggtctctaaaccagcatctttggagcttgttaggaatatagtctcaggcactgctgcagacctgctgaatcagaaccttcattttaacaagatccccaggtgattcatgtgaccccctcaacctcaggctttttgtccatccagtggggaggctaaggaagttttttgggggcattgctatggagtacttaggagagcctgcgatcatcaagatgacctttgaagcttttgtcctgtgggttgccacatgggctaagtcgtcccaggtttgggtaggtgaagcagcaggtcctaggtgtcatagattaagtgtcagatgggactctcagtacagagtggggaggggtgcagaggttgcaccagatcagggaagcaccccaaggtagggaggggatgaaaacttacttgatgcatgaggatcaaagaccttggacttgggcccagacttgtaccttgcacaccctgagtccttcacattagggttcataaccttttggtaactaagtgggtccagggttgtgtctggctcacccttggccttgccctcctggacctggaagccaaaacgctccactttggtcctaggggacactgtcgctgtttaccaacgaggctggaggcatcttagatgacttgattgtaaccaatacttctgagggccacctgtatgtggtgtccaacgctggctgctgggagaaagatttggccctcatgcaggtataccccctctgtgttctagacaccttgtcttccttgttcatagagcagtatccttgttgtccaagacagggttggcacagacaagggacctggaaaatggctctttcagtgaatgaacagctatgagactcaagagcaggccctctctggagcacgccagggtttggtggtgggggattaccaggcatggggagggggtcttggcccctctggtgtgaggtggcagaactgggcttgggtcatctctatcacttagtagctatgtgaccttgtaagatgggaaccagcctactacctttttttttcctccctcctcctcctcctctccactgtcctactactgtccagctctgcagcgtccagcccatggtagctgctcagtaagtggccccagatgctcttgtgtttctgtcttttaggacaaggtcagggagcttcagaaccagggcagagatgtgggcctggaggtgttggataatgccctgctagctctgcaaggtgagagggctgggctggggttggagccaacctttgccttcctggcttcattgactgcttagcacagaggccataccaagaagaatgtgtggaaggtgtgatatttgtgtgccataattttaagttttgtatcttgccctcctcctacctaccacaaggctccatgggctagggacaagggcatcttctcccacttgcagagtaagacatgctcagggcttgttctggtccctgaataaggctttagtccagctttgagggatgctgggacctggatacttggtcactggctccctgggcccaggccccactgcagcccaggtactacaggccggcgtggcagatgacctgaggaaactgcccttcatgaccagtgctgtgatggaggtgtttggcgtgtctggctgccgcgtgacccgctgtggctacacaggagaggatggtgtggaggtgtgtcaagaagtggtgtgggggcagtacagggcacaggatgcatgtgaggggttgggggtatgtggtacagggagcttcccatctgccctctggtgtttcatacagatctcggtgccggtagcgggggcagttcacctggcaacagctattctgaaaaacccagaggtgaagctggcagggctggcagccagggacagcctgcgcctggaggcaggcctctgcctgtatgggaatgacattgatgaacacactacacctgtggagggcagcctcagttggacactgggtgagctgggccagcactaaaggatagggtcctggaggtcagggtgacccttgataagactagccagcccatgactcatccaaaggttatgtagcctgaagccttcctgagcctcccttccctgaaggtgccactgtgcctttgcccattagaaactgcagatgttggccggatgcggtggctcacatctgtaatcccagcactttgggaggccgaggcgggtggatcacgaggtcaggagatcaagaccatcctggctaacatggtgaaaccccgtctctactaaaaatacaaaaaaaaaattagctgggcattgtggcgggcgcctgtagtcccagctactcgggaggctgaggcaggagaatggcatgaacctgggcggcggagtttgcagtgagccgagattgcgccactgcacctccagccagggcgatagagcgagaccccgtctcaaaaaaaaaaaaaaaaaaaaaaaagaaactgaagatgctgccgggcatggtggctcacacctgtaatcccagcactttgggaggccaaggtgggtggatcatgaggtcaggaattcgagaatagcctggccaacatggtgagaccccgtctctactgaaaatataaaaattagccaggcgtggtggcgggtgcctgttatcccagctactcgggagactgaggcaggtaaattgcttgaacctgggaggcagagtttgcagtgagctgagatcgtgccactgcattctaggcctgggcgacagagtgactccatctcaaaaaaaaaaaaaagaaactgaagacgctcggcaggtgggcagcatggcctccaggggataggaggtggttggttggctgacggcagtgaagggaggaatagagcctggagtagcccaagcaaaggggccttgatgctagatagtgtgttacttgaggacctcataaggacctcctgtggccagggcttctatgggctgtggcttatgtctcatgtgtcattctccagggaagcgccgccgagctgctatggacttccctggagccaaggtcattgttccccagctgaagggcagggtgcagcggaggcgtgtggggttgatgtgtgagggggcccccatgcgggcacacagtcccatcctgaacatggagggtaccaagattggtaggtggaccagggaagctgggaaacccttgtctcttcccaggagggtgggggcactggcagggtggtgctgatgcgtggcttatgcttgcttgacaggtactgtgactagtggctgcccctccccctctctgaagaagaatgtggcgatgggttatgtgccctgcgagtacagtcgtccagggacaatgctgctggtagaggtgcggcggaagcagcagatggctgtagtcagcaagatgccctttgtgcccacaaactactataccctcaagtgaagctggctcagggtggggctgtcccttccaggagttttgcccctacaaggggttagtcaagaagctgaggcagaactcactgggggtgggcagttaaggtggaggctgattctaattgtctggttgaggggccacaccacctattccccccacctaactcatgccattccagcttccttcaggaccctgcttctgagtgacggaccagctcacacaatgtcttgtttcagtccatgatcccactgacctactcttgcctgctggagggtaatgagaagctttggttctgccatctctcccactctgccaggtgctggctgtggagcaaaggctcacctttgtggagaggataaaacctgcccaacctacctcaccatggtttttcacattgcaaagggtaataacatgggcagtgcggacttaggctaccccctccagtttgctttccgtaaatgcaaattgtccttactgcaagtcaggaatgattgctgactcacagtagggctgctatgcctgtgtgtaaacttggggatggctgagggaacatagactcactcttccacattcccaagttggtctagtgtgctgcccagtagcaaaccatggcagactcaccacctattctgagttccagggctgctgtagggcagggtgggcttcctcccagacttgccttaccctgggctgatctttgcccctggtatgcattaatggactccactgaatcctgaaaaaaaaattaaacttccttcttacttgcca

SEQ ID NO: 61510 - DNA, 25770 bp, Homo sapiens
gtgctgcggctcccgggccatctttgtgcggggccgcgcttccgccagcgccgcagcggggaatctgcagtaggtctgccggcgatggagtggtgggctagctcgccgcttcggctctggctgctgttgttcctcctgccctcagcgcagggccgccagaaggagtcaggtgggctccgggcagtgccgagcctgccccttgggctcggggtctggccggagtcccgaggcgctcccccgcgcggccggctcccgggaagatgccgtggccgctgtagctcggagctgggcagaaggcaccggggcgccttgcggcggagagtgaggtgccggggtctctgctcctgctctggaccctggagagtaacccattccccggaattcagaatgacagggaggagagggaattccccgttcacccgcaggaggcgtggcccgtgcttggctactctggacctgcctgaaacactgaggggtcggggatgggggcaaatgtcgtgcgcgcgagcgtgtgtgtatatgcgttgccagaagagaagaggggtttaatgtctgtagcttttaactgatcctctttgtggagttcaatttgattagtagaaagtgagagtccgcgtcactatccatagcattctgagggttgagcattaagcttgggaattttccagtttcttggacacctgacagccggatagaggaacagacttgacgtgagcgtgggagttgcacacacaaaaattcctccctagcgtttcgtttccatcagtgggatgggaaggggatttctgaaagttttggtcttctgtttcttctgttggtgtggtgtcagcaaataacattcaggaaaatttttttaactctcatttacttcactttttaaaggttcaaaatggaaagtatttattgaccaaattaacaggtctttggagaattacgaaccatgttcaagtcaaaactgcagctgctaccatgggtgagttcttttctttgatgtgtctttgagagtttagttgctgtcacaggaagtattctaacatccttgagagattttggttgcagtggtcagaaaggcaaggatgtttttctatttctggggaataaaaatgctctcgcatgggaaaggctcaggtggtgtcaacctaaccactgactcactgcgggattcagtgcatgtgcatctgtttttcccactgggctgcaagcttcctgaggtcagggtctgtgtcttatttgctgttgtctccctggtgctagctgtcagtgcgtgctcgataaatattgttgaggaaataaacccatctatcgctgaatctagtcctaaatttcctgatggttatctttagaaaatgcacatcaggctgggcatggtggttcatgcctgtaatcccagcactttgagaggccaaggcaggtggatcacctgaggtcagaatttcgagaccagcctggccaacatggtgaaaccctgtctctactaaaaatacaaaaattagctgggcatgatggcacgtgcctgtaatcccagctactcgggaggctgaggcaggagaatcgcttgaacccgggaagcagaggttgcattgaatccagatcatgccactgcaccccagcctgggtgacagagtgagactccgtctcaaaaaagagagagaatgcacatcagggccgggatgaggtatggtagaaagataactctgaaaacagacttgggtgttggtgccggtactcccactggttacccctgtgccgagccacttcaactcctctgggtctcagattcttcatcagctaaataacagggtcttttaagctcctttttatgttatttttgactcctcaaaaaattccttggatgcttatgatacttattgaaaacttactatgcactcactttaaaaggaatacaaaatagtgtaattttggttactgctgtcacgctaccagagtaagggcttgtgggggagagtgtggaccagacagaccagaacaagagagtcagtgctagactgtaaggcgtaaacttcacctcctgtgggattgggaggagatgccaggaggactgaagtgactagaaggacacaggtgtggcatgagtagcgaaagagaaatacagaactgccaagggaggggcaatccagatggaaggaggaagaagagacattgacccgctttttactttttattgctttattgcatttgatgtttcagattacctacagggcttctagggaagagctgctcattctcactctcgattctttccttccacttactgtgttctctaatacgaaacctaaatgcacttaggaagtaggtggaatggcaccactctcttggcctgctttccttgatgactcccattctttcccagtgtcatagaagaggatctaactcctttccgaggaggcatctccaggaagatgatggcagaggtagtcagacggaagctagggacccactatcagatcactaagaacagactgtaccgggaaaatgactgcatgttcccctcaaggtaagagttaacgaggtagatatatcttctgactttattacatatgggcttgatacccttttatagaggagccaattcatgggactaacaagcagatccctcctcacatttcaggcggactatgaaatagtgacgagctcttctccttgcctgggaatttttcttgcgagctcctctcaaagcctgtctcctctgtgaggcttggttcatcactggttgtactggtggtggctctgcctcttctgctccttccctgggatatagtagcggcaggacacaggctgatgaggcctagcaggcctagcaggagggagctaggctgaaggaggaagaggaattggttgaatgtctgtcatcggccagtgtagttctagatactgaatattcaaggggaggtggtagagtcaagaggagtaactagatggggtggtggtggctcacacctgtgatcccagcactttgtggtggattacttgagcccaggagttggattatggcaaataatccggcagtggcaaataatacaacagagtgagaccctgtctattaaaaaataaataaataaagaggagtaactagtgctgcaaattacactagccaggacttcagaacttcaggtgtgagacctgaggtaccatgtcagtgggctgaaggcagggtggtaagcagggagggtcatgggctgagggtggaggttgggtttaggcagcattgcacacaccaaaagataaactttatttttggagtttgttttttttttttaactcagatctttataaaattagaaggtacaaaactcagagggcataatattcccttatgtaagagcatctttctaaacaatccctattctgtcattaaaagtgaaataaatgtgcagagttgcaaaaaattatcgattcgttcataaagatttgtattatttgtatttaataacaactttgtaagaatttaatatttattcttataagtatataaacaaggccgggtgcggtggctcaagcctgtaatcccagcactttgggaggctgagatgagcggatcacttgaagtcgggagtttgagaccaaactgaccaacatggagaaaccctgtctttactaaaaatacaaaattagccagctgtggtggcgcatgcctgtaatcccagctactcaggaggctgaggcaggagaattgcttgaacccaggaggcagaggttgcggtgagctgagattgtgccattgcactccaggctgggaaacaagagcgaaactgtctaaataaataaataaataaatgtaaacaagaaaacaggctgggcatggtggcttgtgcctataatcccagcacttcgggaagtcaatgcacgcagatcgcttgagctcaggagttcaagacgagcctaggccacatggcaaaacctcatctctacaaaaaatacaaacattagctgagtgtggtggcatgtgtttgtagtcctagctacttgggaggctgaagtgagtggatcacctgagcccaggaggtcaaggctgcagtaagcctgagccgtgattatgccactgcactccagccagggtgatagagcaagacctgtctcaaataaataataataaagaacaataaaaaagaaagattatttaatatctcactaccctgaggaaatcagttaccctttggctatcagatatcggaggaaataaggttgtagaggaaaaaatcgttaaggtattttaaacagacatttgtttcattatttggaactcaataatagagactttaagtacaaattgtgagtctaggagaatttttgatttccacagatgagaaataaaataagaatatagacattgttggactttgaaagcttacccaatgtttaatagtttgctgaacaattgccaaatgaaatgaaatgctttcaaagtttctgaaaggcacaattctcttcttcctgagctcagaacattttggtcataatcatgagcttagaaatgttctgaagggagtacaggaccttcattagcaataaaataatatatatttccaatgacactgaaagttccctatcctagctacatatacaactaaggaaaacagagagggacaaaatacgaatagaatgcagtattccaaaacacaatcctgaatgaaatgcacacagtcgtatgatatctcaaagattcccatatagttagaaataatatctttctacgtctagatacttttttttttttttttgagagagagaatctcactctgtcacccagtctggagtgcagtggtgtgatctcggctcactgcaacctctgcctcccgggttcaagccattctcttgcctcagcctgctgagtagctgggactacaggcgcccgccaccacacctggctaatttttgtgtttttagtagagacggggtttcacctcgttcgtcaggctggtctcaaactcctgacctcatgatctgcctgcctcggcctcccaaagtgctgggattacaggcaggtctagatacttttaactcatccagtttcagaaatctatgtgacattttaaaaactcagttttgaataaaataaaatataaactccacatttcaaggatgagcagaggaaccagaggtttatctaattaatgctagagacaagtcatttcaaagatgaggagtaatggtattttttaataacagctttattgaggtgtggttaacataaattacatataaagtatacaatgtaaatgttcccacaacaaaaaaatagtatgtgaggatatgttaattagcttgatatactcattccacaatgtaaacatatatcaaaacattacattgtatcctgtaaatatgtacaattattatttatcaattaaaaataaaacctacagtgtacactgataagtcttcatgtatgtttataccaagataatgaaccttccatcacaaccaaaacgttccttctgcctctttgcattccctctctcctgcgtctccctgtctccctctcctccccatgccccaccttcaggcagccgctgactactttctcgaattatagattattttctagttttctataaatggaatcatataagagagtatatttgaaaagccaaatgtggccgggcatggtggatcacacctgtaatcccagcagtttgggaggctgaggtgagtggatcacttgaggtcaggagttcgagatcaccctggccaatatggtgaaaccccgactctactaaaaatacaaaaaaatttagccaggcatggtggcaggcgcctgtaatcccagctacttgggaggctgaggcaggaaaatcgcttgaacccgggaggcggaggttacagtgagctaagaccacgccattacactccagcctggtcaacaagaaagaaactccatctcaaaaaataaaaattaaattaaactaaattaaaagccaaatgtgaaagaaatacgagcattttagctgtaatgtataaattgtactgcaatatttttttacattttttaactagttttttttttcttttagtgtcaaagagtattacatacactttggatatgtaaaatatccaaatattttaccatgctaaaatatttggatacctccaaaagacattcagtgaaaaggaagtttctcttccacctcagaccctcagactgctagtccctgagacctcttttcaaaagacaattagaattctgtgtcttgtatatccttctagaaatagtctgtacatttacaagcatctagactcatcaacaaaataaaacatgctgtcttctgttctgcacttagatttcttttccatataacagtagattttgagattgttccataagagtccatagagaatgcctcactttttcatggctgcataataacttattatatggatttctttattcagccctctatcagtggacatttagattatcccttaccacatcactttgctttttggataacgcaagcaatgctgcagtgaacatccttgttactgtgaacactcatgtaaatatatatgtaggctaaattcctaaaagtataataactagggcaattaatgtcattttaaaatcttgataaataggctgggtgaggtggctcacgcctgttatcccagcactttggatggctgagacaggcagatcatctgaggtcaggagttcaagaccagcctggccaacatggtgagaacctatctctactaaaaataaaaaaattagctgggcatggtggcctgtgcctgtaatcctagctactcgggaggctgaggcaggagaatcacttgaaacccgaggtggaggttgcagtcagctgagattgcgccattgcactccagcctgggccacagagcaaggctccatctcaaaaaaaaaaaaaaatcttgataaacaggctgggcacagtggctctcacctgtaatcccagcactttgggaggctgaggtgggaggatcacttgagcccaagagttcaagatcagtctggacaacataccaagactgtctctccacacacacacacacacacacacacacacacacacacacaaacacatacagagttgccaggtgtgttggcacacacctgtagtcccagctactcaggaggctgaggtgagaagattgcttgagcctaggatttttgaggccacagtgagccatgatcatgccactgcactcttcagcctgagtggcagagcgagagaccctgcctcaaataaaaaaaaccttaaaaaaagagaaatcttggtaaatagaatctaattgtcctacaaagaggctaaacacttccacaaccgatatatcatatgctgtgaatagatctcacacccttaccaacactgcactattggactttttgatctttgccaatctgattggtaaaattggtatctagtttcattgacatttctttattattaatacagttgagcatcttttcctatgtttgtgaactgttgatattttttgcagttatctccctatataaaaaacactttttttttttttggctagaggagctcactacattgcctactgtgtcactatgttgctggtctagaactcttgggctcaaataacccttctgcctaagtctcccaagtagtaaaacaatattttaaatcagttatttccatgctgccagaaaattttgatcaagcctttgaatattgcccctagcatagtgctggtcaggacctcagaggatgaggcagaaacaagctaaactgtcagtgtatcttctttttctttcaagaaatccctgatttcccagggaatctagtcagaaagctgtgttacactatttatgattatgtatataacactttttctggcttgcagaactgattttgataatgttctttattcaggttgaaggtaatgaaaggttttctatctgttctcataaactaggagacttaattataatggaaataaaaatggtgtctttgtgaggagcaaagccaaaggaacacaggtggaaaattagctatttcagctattacgagagtttgtatcttgtctactaattaaactattccatataagggaaataaagaaaagaactggaatgaataaagtggtagaagtagcaataatactcccttcaaagctatgacgatttatttggaaaattttattaagtattgtaagctggagcagcttagctatgagtgaacttgcacaatacaaaaaagcagaatagcccctttagaagcattgttttcaggagactttgcagtagactgatgatatggaacactggaacactggcttgtcttactttaaaatgtgaatgggacctcgccttgtcctagagcctgcaggcactactctgctgaatttatggtatgtctggttgacaggtgtagtggtgttgagcactttattttggaagtgatcgggcgtctccctgacatggagatggtgatcaatgtacgagattatcctcaggttcctaaatggatggagcctgccatcccagtcttctccttcagtaaggtaagtacagggagagccacatgggtggatggagagtggtcctctaggatatgagcatgagatctttgtccggtgacatagtctgatggataatggtaaggatgaggactgaggtccagaaatgggtctgtgtctctattagcatcacagtgattgagcaaaaagacagaggagatgaagttgagagctggtaagtagtgtaagattgcttgagtgtctatagggctagagatggaggctagggcgtgagaggcctgagaaacctacaggaattagaggtgggtcttgaagatcttacagagcatgggaggaaggggtccaagaaagcttggagttagggaacaccttcattccaaaagtttgttgagctcctactatgtatatattcagccatagtgctgggtatcagctgtcccatctgtcaccatattccgggggcccagggtggctaaaagtgaacctgaaggtgccagataactccacacggtgtgtgtacaagccgtgcattgaagggataggctggagatagcctagagggctatgcaagggggtgatcttttagactcatcatggaagattggagtagctaggatacacctgtgggcttggggaattgggggcaaggaatgtcttgtcagtgctcaggttcatgtaaatgttgtatcggcagggatgggccttggttccctagagacaaggaaagcatttgggggtgaaggcaggaaggctagaagagagtggatggaagattctatggggtaagagtgaattgaggaaaaccccatgaaatttgggaaaaggaacactatttctgatttggtttgtctaaagcagagggaccttttatccccactttttctttatcatagtttactttctccctagacttgttttatttcctgtgttgcaagtgggcagaggccacatttgtgttgcatttcccatggtctagcctcatttctcgaaagtgtttggttccattgtttgtcatgaaactcactcagaagaacagatagaggctcccatgtaagtcagtagggacttcgtgtttgttatctatctgttgtttctatggataataaagtatgaccgtcggtatactaactttccgttcatctttacttcccttctgttttttaaatcagtgacttctagtttccaagggagagttttactctgtcaactttatagttaattgtgcagcttctattgaatagctgttatgtttaaggtgcttgatgaatcacattttttacatatttgagagacagcaaacagcatattgcacatgtatttccagtggaagaaatagtagagttagaggtttatcagtggccagatttttaacagaagtaaccataaaaagggaacaaatggaggccaggtgtagtggctcacacctgtaatcccagcactttgggaggccgaggcaggtggatcaaaaaaaaaaaaaaaaggggggaacatatggctttaaacttttttcttttttttgaggcagagtctcactctgttgcccaggctggagtgcagtggcgcgatctcagctcactgcaacctccacctcccaggttcaagtgattctccacctcagcctcctgagtatctgggactataggcacctgccaccatgcccggctattattttgtgtgtattttttagtagagacagggtttcaccatgttgaccaggctgatttcaaactcctgacctcaggtgatctacccgtctcggcctcccaaagtgctgggattacaggtgtgagccaccgtgcccaacctcaaacttctttcaaaagatatgtgataacaccccttctcattttgctcatccatacttctgaccccgatcagtgaataaccaagaatttattgaccaatcaatgtgagcccaacagtgccatagtatgagataacactagccaatatttatcaagtatgtacaatgtgccagctactgttctaagaattttacgtgtatcaactcatttaatattcaaaataaaccttttagttagatcatattattgatattattgtttcccccattacagtgataaggaagctgaggcatagaaccattaagtaacttgcctagagctgtaaagaggtggagtcagaatccaaacccatgtgatccacatcaggagcccacactcttaaccattgcatgtatttcttggctcttactctcaaaaaaacccattgggaaataaccaaaaactggtaagacagtgtaaactcttaaatgtaatagttaaacaatgagagagctctgtgattattcagaattgggcatattgtttccttaaattggaaatcttaacagtatatatcctctagaaaaacagaatttgggggaactgaaaaagctgacctttaatgtgattctgaattctggaattcagtgagcccatgacttttaatccatagtcacttttgccttttaatgtctacaggctagactttggaaaatagggaaaatatatctttgacaatgtgacactaaaccaaggctgtccagatcctgtggcatgattgcagttgcctcttttcactgttccaagactgatttaggacgacctgtctgtttttgttgaagacatcagagtaccatgatatcatgtatcctgcttggacattttgggaagggggacctgctgtttggccaatttatcctacaggtcttggacggtgggacctcttcagagaagatctggtaaggtaggtcctttaaagaggttttattttttctctttctgggttttcttgaaataagccatagaatataaccaattatttactttttttttttttgagacggagtttcgccctttttgcccaggctagagtgcaatggcgtgatctcagctcaccgcaacctccgcctcccaggttcaagtgattctcttgcctcagcctcccgagtagctgggattacaggcatgtgccaccacacccggctaatttcgtatttttagtagagacggggtgtctccatgttggtcaggctggtcttgaactcctgacctcaggtgatctgcccacctcagcctcccaaagtgctgggattacaggcgtgagccaccgcgcccagcctatttatttttaagtgactaatttttaagttaaaaattaaagacagaaaactgtagtgtaaacaattttgtacgtgtctaataatatttacatatccatagaaaggggcagaatagtctatcctaaactatcagcaatgcctctttgcaagggattatcagagacttttgttttgtattttaaatttttctttctttttttttttttttgcgacacagtcatgttctgtctcccaggctggagtgcagtggtgctatcgcggctcactgcaacctctgcctcccaggttcaagcaattctcttgcctcagcctcccgagtagctgggattacaggcatgtgccaccacacctggctaattttttgtatttttagtagagatgtggttttgccatgttgcccaggctggtctggaactcctggcctcaagtgatccacccacctcggcctcccaaagtgctgggattacaggcacgagcccctgtgctcagtcagtattttcaatttttctatacttaagattctttaaataagagtgcattctttcatagtaagaaaaaatgaatgacctcgtcataggggggatagaaaattatttggaagaatataaacatacttggcaattgagagctaagtagtttaggcagggctgagggagcataaatgtcccataagcatctcaagtacaagcttattccagatcctctctgattcatgactgagacatgccttggcctgttgactccatcctgctatcatttcagaatttagattgtgtagctcatccaagctgtaggtatttcttacctagctacattttacatcatgattcaaacaactttggtgcttaattagagaacttccggaaacacagtcattataggccttctctcaggtataaggaaagcaaacaattcaaccttgtttccataaatacctatcacctctcccaagtgtggctgaagattcaaagaggattaaggtaatattcccttcctgaagaaacgtacagggctgcagtcctcagtggtgggtagagccctttgttaaaaaacaaacttctctagtgggtataatttggaaattttaaaaaataataacttagtctcatattttacagaactggaactagaaattgtctttgtccagccctttatttcagggataagggaatgaaggtacagaaaggtttagtgatctggtcaaggtcagaagcaaatctaggcctaaagaccaggtttccaagtgcattatccaacctactttactggttaatattccttgtgttttcctgacattgagactgtcatttcttgtttatttttgggttttgaacataattttgagagggggggaaaaaggtgtggtttttttgtttcttggttgttttttaaaattttttgtagagacaggtcttgctatgtttcccagcctgatctcaaactcctgggctcaagtgatcctcccaccttggcctccaaagtgctgggattacaggcatgagccaccacactaagctggaaaaaaggttttaaacttttttttccctaagttattcttggccttggccttaattttctaatcctttccccccctcctcaggtacttgcaaatacccttttcacattcttctttttgtagctcttttcccacctgccatgcagctgctttgttttcaaaatctttaaaaacatttttactgattatgaaacctatatatgctcataaaattttacaaatatgtataactcaggcaactttccccctaacttattggtgtatctaagtaatctttccatgtctttgtttcatgtcagtacatatgaaagagtcactttatttatttgtttgtttgtttatttttaaaaggcaggatctcactatgttgcccaggctggactcaaactcctggggtcaaggtgttatccagttactccaccgtgtagttattaataccattttcccccaggtaaactagtaagcaatttttaggcagatagaatgttttaaagtctaatcttatatgaatacttttttcttttgataccttcccattttattcaattgaatttattcatggttatagaaatacaattttgttttttagaaccctctgtttagaatctctaatgatgttcatttgttaccttgaaaatttaataatctgcttgtttatccatctgcactgatgtctgcctgccactgttcattctatttttctgatattttgggagtttgtgcccactgatttatatttcactctgtagaagaattcattgttctttacagatcgaagatttcatttgttactgtcagagagggtttaaaaaagagggctggggtagcaccaggctgtggtggccaccgttagcacttgcctggagaaacaagtcctaacctaggtcttttgagggaggatgggtaggttaggagaatgaaagagagagaacagtgatacacagtttgggtttgtgtatatgaaacacagcttccccaggagccaaggaaataaagagaagtaactttgagtataaattgatacatgttttgttagatagtttgacaatatgtatcaaaattggaaatgtatactgtgtatcctttgacctagctgtttcatgtctagaatgtatcctaaggaattaatcagatgaatgtgcaaagatttgtgtacaaggatgtttactaccatgttgtttcttagagcagaaagttggaaactacctaaaagtccatcaataaaggatgaagtgaatcataacatgactataaaatggaatttttgcagtgagtctttgccagagattataaaatggaatatcgtgcatgaatggaaaggcagtgtaggttttaaaaactctgggttcaaatcctggctcttattagctgcatgactctgtgcaagttgcttaacctctaaaggacctcatttgtaaaataggggtgataaaacctacctcttaagattgtgagaatgattttttatttacaaagcacttaaaacaatgtctgtaacatagtgaagtgctatatagatgttggctgttattattatttatatttcctattaagattgttacctaacagtatgtatggtgtgacctctgttacatagagcaaagtttctcagtactagtgttgctgacatttggggctggataattctttgtcctgggagctgtcctaaccactgtaggattgttcagcagcatttctgatctttacccactaaatgccagtagcagtcccctagtagtaacaatcaaaaatgtctacagacatggccaaatgtcccctgggtgggagggacgggcaaaattacccccagttgaaagctactaatatgaataaatgattgcaaggaaattctcggctaaaatgttacattgttacctctggacagggagattccagacgacttcttacttttatctttatgctttttcatgagaactttgcatgaggagcatgaaacattttccactaaaaacaaaacaacaaaaatccagtgctatagtgtctctgcttgggcaggaagaagtatggggaaaacaagatagttctggccttagactggagaatcaggtaaaggtgatccatccagaaaaggccagaggatgagccacgttggctgagggtggaggtctgagggcctggaaaatactgagcagcgttctcagctgagtgaaaatgagcagcatgacattatatgtatctgaaaaggacctgtgcctagaaagtttatatcctaagtttctccgttactgtaatccagcccatcaatccctcattaacttcagttcagccttcccttcctttttcagagaagatgctgtgcagacttctgtgcagggagggttcctacgaagcaagttaagaatgatgcatctgtgagctagcagtttcagtaaggaaggctggtcatggtaatgtgtactgagatctgactttcaaggacttcatctttatagagcacttagtctggctttaagaatacaaaggtgcttttcaaatatcaaactaaatctgatgacacttcccacctatggaaaacataaaatcagagagtgatttccctttcattccatttctgatgcttttttatttttttgcagttctgtacacataattaatttcatcagtagcaccctacttaaagtacagaggaaatccacatttgccaaattataaacagacctaatcatgaccttcagggtttgggggcttttctttcaatgttgttaacttgttaatggggagtagatttgtagatacaactgggtagcacctccagagcaatgaaatggtagcaaaaggaaacaaagtgtcctttagggctttttcttttgagtgactttgattagacttacttagaaatatgaagctctggccaggcacagtggctcacgcctgtaatcccagcactttgggaggccgaggcaggcggatcacgaagtcaggagatagagaccatcctggctaacacggtgaaaccctgtctctactaaaaaatacacaaaattagccgggcgtggtggcgggcgcctgtggtcccagctactcaggaggctgaggcaggagaatggcatgaacccaggaaggggagcttgcagtcagccaagatcgcgccactgcactccagcctggacgacagtgcgagactccgtctcaaaaaaaaaaaagaaatatgaagctctgaactaatcttcagaaatggttaaagcacattcttatatagttgaaaaagatatattgaaactaattaaattctatattcttaggtcagcagcacagtggccatggaaaaagaaaaactctacagcatatttccgaggatcaaggtgagttattttctgacattttacaaagatattcttccaagtaatgtaaaatgtaagtaactttgagggtatgacaagctctgtagttcaaagggaaagctaagataacaaagaaagaaatgtggaatcacaattttagattcgagaataattcacattatttgccgaaatcgccattgattgagttgatattcaaagaagtaaagttcatccatttcagtcatttaacagatattttacatagtgtcacaaatgtgtcggtcattgattatgtgatgccaaacacaacagatgggtgtcttcttacagtccctaggagtagcttatgatcatgccacggtactctgctggttaatgcagagcaggactcatcaccatatctcttgactgccttttttatcacaccctgtggctgccaaatagtggttaagagcacagactgagactgctgaaaatgaagaagggagcagggaggaaagagaagagaaaaatggcaaaggtagtaggaggaccctgtgttgttcagctccatagtcccaaggccaagaacagttcctagcatgtcaatatatgataaatatctgtggagcagatgaatagaaaagaccatgaagggagcagggttttgtagttttagcaagtgagtccttgccagagattatactccctcttcaccctcctcttcacttcggagctagactttaggaggtaaatggattatccagctactatgtcctgtttcttaccaacttctctgattcttaaatcttgaagtcacaaattaacttggggaccatgtctggacttcaagagttttaggactcccttgaaattatgtgaggatatgtgcatttttctgggaaggagagagggttggttcatagttcttaacagattatcaaggaatccatgatgcctcacatgtcaagaccctctgctacttggaacatcactagaaattcttccacatacagtcgtcaggtttttaagccctttggtttttgtgcattttttttaaattaaatattatactgggctgtacagagcatacataacaaaggtcatgtagctgttttagtgagtcgtgactacctagcctcacagttatgagcaccagtgattatagaagccacatgaactttcctaaaagggaaatcattccctgggatttgactatagtgacctgaacaacatacccttcaagaccaaatgcaagcaaagaagggccaagtaccccccaaccctaaaggtacagaggggaccagccctggatgacctagatgctgcagtacccagtatacccctcctccgctgtcacgtcaccagtgaattgtccacttgtgcagagtcattgcattgggtcctagtcctgctcacctttcagggattgggaacagttttctaatacaggccacacagttttatgtcacgtgtttcttttataggacaagtccagaacgagatcctctcattcttctgtctcggaaaaacccaaaacttgttgatgcagaatacaccaaaaaccaggcctggaaatctatgaaagtaatcaccagtcatctgactagaactacagcagtgaacattctcactcaaagaacattgccacctgggtagaatttgagattaggtttcctgtcagtggtgaggtgaatgtaaagaaagttccatgaaccagcattagcatatatgtaaattctcctttttcaaacttacattgcttttctggccatattatgactagtatattgcactactttgaaggtttaaaccaggggtcacaaactttttccaggaagggccaaatagtaaatgttgtaggttttgcaggtcgtatggtctctattgcagttgccaacagacatgggcagtttgtaaatgaatgagcctggcagtgtttttattaaaactttattacggccaggcatggtggctcatgcctgtaatcctagcactttgggaggcgaggcgggtggatcacttgaggtcaggagttcaagaccagcctggccaacatggtgaaaccccgtctctactaaaaacacaaaaattagccgggcatggtggtatgtgccggtagtcccagctactggggaggctgaggcaggagaatcgcttgaacctgggaggcagagattgcagtgagccgagatcacgccattgcactccagcctggcgacagagcaagactccgtctcaaaaataagtaaataaaaataaaaataataaaaaataaaaactttatgggcactgaaatttgaatttcatgtaattttaagttgtcataaaatattattcttttgcctttttttttaaccatttgaaatgtaaaaatttcttagtccatgacaaaaacaagcagtgggtcaaatttggcctgtgggtcgtagtttgccaacccctggtttaaatcaatggtctcaaccctggctgtgcaatacaaccagagagcttaagaaaatgaatcaaatgagtcagaatctctgggaatggtgtccaggaatcttcatttgtttaaaacttttcaagtgattctaaggtgaagccagaaatgggaccgttggtttacagtccactctctcctcttaactctatggctttttgccttaatcaaagaaattaaagccctaaacttcctttatatgaaatttccatataccatatgaggatgctatgaggaaaagctttagacttcttgggagaaaactaagtaaatctgaggtgcatgtattatttcatacagttttaatcaggagcaagtgagcttaagaaactttgttgaataataaaaatatgaaaaaatgtgttcatttagaacaaaagttgttagcatctactgtgggaggctgcagaagcaaacaaaacttgtcccctcatcaaggagtttaccatctgctaaggtggatggaatgtacctggggatgtcaaactcagatgtccccaggggccagcaggtgatgtcaagaggtgagcaagagagaatactaacagttccaaatgttaataagagcccagtttgccagatcttcctttttattctccaagaaagactggaaatctggatttttgcaagaaatatcctaccacctgtaaatgttggcaatgatttgatttaaaaaaaaaaatactttgcatgcccaacaaaatttgagcatgggctatatacacccctaaggccatcagccagcacttgggaccttctctgcatacattatttacacagagtgaagtgtgctgcaggctgtgacatctgaattcaaaggagggcaacatggctttaggtgtgcttaaactttaaaatcagacgggccctggttaaaactctgtcttctatttagagccacactgaccttgagcaaatctcaacttccaaagccttggcttctgcatttatataatgggaataataatgtctcctgagtatattgattatgaagcttaaatgaggtaatgttgatgaaatgtttaacaatgcttgctgcacagtgatcacaataaatgctgttgctgttaatactaataacttcctttccacttaaaggataccttaggaaagccagctgctaaggatgtccatcttgtggatcactgcaaatacaagtaagatttgcaggactcctcactttcttggtttccatactgcttttgaaatagcttcactttgggtgagaactttaatataaaggcccagctggagtaaatgaaagttgcattaattcatttcactggcttttcctcagggcctaaatgcactgacctgagttctgtggcgactgtagagaagaatggaacatggttcctgcttccaaacagctgcatgctagctagtaatcacagtaatggaattacctctccatatgccccacccacccaatcattgaagttagaataaatatttctcagttaataaatattagaattattatcctggtgtgctggcatgctcctgtagtcttagctactcgggaggctgaggtaggaggatcctttgagcccaagagttcaagaccagcctgggctacatagtgagaccctgtctctaagagaaataaaataaaattctgggactaagaattagatgaacaggtaaaaccaggtctagaggagggcagtggtggtgggggtggctcagagttaggagtgctaatgacacgcagagtaggagctatatggtgaaagcaactctggttggcgacaggtgcgtgcataagaaatgctgagaagaagacagctttttttgttttttttttttcccctgtgggcaatctctgaaaattgattaggttttcctcattctcctctctacaccaggggtccccaaccccctgccatggtactggtctattaggaaccaggctgcatggcaggaggtgagcagtggggaagcgagcattaccgcctgagctctgccttctgtcagatcagccttggcattagattctcataggagcacaaactgtattgtgaactgtgtatgcaagggatcaaggttgcgtgctccttatgagaatctaactaatgcctgatgatctgaggtggaacagtttcatccaaaaccatctcccccacactacccatccatggaaaaattgtctcccatgaaactggtccctggtgccaaagaggttggggaccgctgctctatactttaagagaagagggtgatgtccaggaagcagtggagaccttcgaccagatggggtacactagaggaaaaacaaggctttgggaggccatgactagttagagacattaggcctagaaaagcttgtgaaatttttttcactcgttttattttatgtttaccattgaacatttattttctcagatatgttccaaatctacaagctgtcatttccttctgagccctgtatacactctacccggcacccagctcctgaccctatctagtgctgtctggagaaaatatcccctatttttcctcaccctgccattcccagaacaacctgtagtcctagccctggtaaagtggctgatagaaaccacttaggaacatattaatgtgtccttgaaaactcaaagtggaaagagaatggagaggaatcataaaaggaaagaaggggaggggagaataagcataaaaggtcatatttgtggcagcaggcatatagtatcaaatgtattttgttcttttttccccaggtatctgtttaattttcgaggcgtagctgcaagtttccggtttaaacacctcttcctgtgtggctcacttgttttccatgttggtgatgagtggctagaattcttctatccacagctgaagccatgggttcactatatcccagtcaaaacagatctctccaatgtccagtaagcagttatcccccaatgcagagtttctaaagacccttccaatctgcttttaaaaatgccttaatgccttaaaaccagtcatgtaagacatttagtcctacgatttttttccattgaaagctttttttcctcttggtttgcatatatagtattgcattattatccaagtaggctataagtggaatttaatttgaaaaagcgctttaatactggtttcaaatgaaacgttcagacaaaatgaagttaaaaagctctaatctctccaagactaaagatagggatattcaatcttattatattgtcaaaaggattttcagatacagcatgagaattgactcaagtgaagcttcagcaaatttcctttcatgacaggaggagctaggaagaagtatagagaagggccagagttatctgaatattgttatcatggtgatatctgtgtatatatattttttttctatatataaatatatttatatataaatatgtaaaataatataaatatctaatataatatataatataaatatacaaaatatatgtaaatatataaggtaacttctgtattttctcaaatatgtcccaaatctacaatagggtatctttaatcagtgtgtgggggtttttttttgttattattttgttcttgagagaaccctgatatctttgcttgaaggaaataatccaccatccacatacctaaaattatccatagacctcaatctatatcgtctttctgacttagtgccaatgaagttggtctatatttcacagtctaaaattcttttcattttagagagctgttacaatttgtaaaagcaaatgatgatgtagctcaagagattgctgaaaggtgagttctgttcattttcccttttccactttactttttgtcatccccattatgccctagccaaagttatctgaatattgttatcatggtgacatctgtattttatcctcattatatggagataattcagaactaaacctgtcctgggggaaaacatacacacatgtctacatatgcttgttttaaaggaaaaagatgggccgggcgtggtggctaacgcctgtaatcccagcactctggaaggccgaggtgggcggatcacctgaggtcagaagttcaagaccagcctagccatggtgaaaccccatctctactagaaatacaaaaaaattagccgggtgtggtggtgcgtgcctgtaatcccagctactcgggaggctgaggcaggagaatcacttgaacccgggaggcggaggttgcagtgagccaagatcgcaccattgcgctccagcatgagcaacaagagcgaaactccgtctcaaaaaataaataaataaataaataaataaaggaaaaagattgttaagttgtattgctacatgcatgtatgtggatatgattgccatagggttggttcttgaggctcaaatgaattaatttatataaaatgctgaataatgcttggcacaaggtgagcactcaaatgcagactgctattatcattaaattctgtgctttaacattttcttgttaaatcttgtctctaggggaagccagtttattaggaaccatttgcagatggatgacatcacctgttactgggagaacctcttgagtgaatactctaaattcctgtcttataatgtaacgagaaggaaaggttatgatcaaattattcccaaaatgttgaaaactgaactatagtagtcatcataggaccatagtcctctttgtggcaacagatctcagatatcctacggtgagaagcttaccataagcttggcacctataccttgaatatctgctatcaagccaaatacctggttttccttatcatgctgcacccagagcaactcttgagaaagatttaaaatgtgtctaatacactgatatgaagcagttcaactttttggatgaataaggaccagaaatcgtgagatgtggattttgaacccaactctacctttcattttcttaagaccaatcacagcttgtgcctcagatcatccacctgtgtgagtccatcactgtgaaattgactgtgtccatgtgatgatgccctttgtcccattatttggagcagaaaattcgtcatttggaagtagtacaactcattgctggaattgtgaaattattcaaggcgtgatctctgtcactttattttaatgtaggaaaccctatggggtttatgaaaaatacttggggatcattctctgaatggtctaaggaagcggtagccatgccatgcaatgatgtaggagttctcttttgtaaaaccataaactgtgttactcaggaggtttctataatgccacatagaaagaggccaattgcatgagtaattattgcaattggatttcaggttccctttttgtgccttcatgccctacttcttaatgcctctctaaagccaaaaaaaaaaaaaaagacaaagcctcttaataaatttaatggaactatacatagaacagcagctcttcctcaccctttgcatacctttaatatttttccttcttaaattggccacagcaggggtcattcacactctcactgtcttgcaggaatcacaagaagtcttcatatgtgaacgtgccattcagttggtagttaagagcattcaacttcaaatatatagaagatatttgttttagtgcaaatccatgatggagtgcctcccttttccttttttcactttttgaaaaagatgttttgggtagtagtttaatatctcagggtgctctttctaacatagtaaaaaatgaagaaaaatgtttagattaaaactctgtagtctgatgacttagaaccatccttgacccttaggcccaacctttccacagagaaatcacctctcttcctttgtcttttaagaactatttggtattaactagtttcagaattagtaaatgtgagattcagtcacataattatcagacattccatttgtcagaaatgtatttggctttttaaactcctttccacaaaagtttaagtctaatgaccttcttagagaagttgagcatgcctggcaagatcatttcatggaataagcagatgtttaaagttggatttttttttttttttttttttgagtactagcaatgcacagggaccgtgttcttaggttcttagtctgtgaatctagcaataggcagtccagatttctgagtcgtactatggttttgccttgtcactgtgaggccctactaggtgtaagcattctctctgaattttaatttcctctcattaaaataggaacaaaatttgctatcctttagattaggagctgaagattcatttccctgggaatgtttcccatttagcttcaagtttcagctcaaacatcaccttctttctgactcctttcattcattcctccaggcagtaaggggctaccatagtactttgtttatgcctgtattatatgacatcactgtagttgcttgactgtttctcctactgttctgtaaacttattaatgggtgagaatctaattttactcatcttgatggcttcatgatccagcacagtgcctcacacaaagaactattgggtgggtggatggatggatggaggaatggagacagttggcttaaccagatcctatatacagattattactggctccaaaggatgagtagataagaccataagaattggatcaatgtaaatcctcacctgccctttgaagagccaataagggcatctttgtctttaaatacagcaaatgttattcagattttgtacttgtctatctgtttacctcagtgtagatgatatgaggatggtataactatgtaaattgtttttgaaaataatttgtttccccacaacttttgaaggttttatttgttgttgttattactagttcagtcccaaacttaccctttccttttcagagagctaatggccatgcttttcttcaaggaaagaataatttatttgaatgaagtgggatacttgcataacacaa

SEQ ID NO: 61511 - DNA, 6274 bp, Homo sapiens
cagaagtggcccaggcaggcgtatgacctgctgctgtggaggggctgtgccccaccgccacatgtcttcctacccatctgctccccagagggctgcctgctgtgcacttgggtcctggagcccttctccacccggtgagtggccagcagggtgtggggttatgtgagggtagaaaggacagcaaagagaaatgggctcccagctgggggaggggcaggcaaactggaacctacaggcactgacctttgtcgagaagagtgtagccttcccagaatgggaggagcagggcagagcaggggtagggggtggggtgctggtttctgagggactgatcacttacttggtggaatacagcacagccctggctggccctaaggaaaggggacatgagcccagggagaaaataagagagggagctgcacttagggcttagcaaacacagtagtaagatggacacagccccaatccccattcttagctggtcattcctcgttagcttaaggttctgaatctggtgctggggaagctgggccaggcaagccagggcgcaaggagagggtaatgggaggagggcccactcatgttgacagacctacaggaaatcccaatattgaatcaggtgcaagcctctttgcacaacttgtgaaaggaggaggaagccatgtggggggtcctgtgaaggaaccggaaggggttctgccaagggggcagggaggcaggtgtgagctatgagacagatatgttagtgggcgcctaagacaaggtaagcccctaaggtgggcatcacccagcaggtgcccgttcctgggcagctggtctcaggaaggaagtcccagaactgttagcccatctcttggcctcagataatggagtatttcaggacttggagtccagagaaaagctccagtggctttatgtgtgggggtagatagggaaagaatagaggttaatttctcccataccgccttttaatcctgacctctagtggtcccagttacagctttgtgcagttcccctccccagccccactccccaccgcagaagttacccctcaacatattgcgcccgtttgccagttcctcacccaggccctgcatcccattttccactctcttctccaggctgaagccacaatactttccttctctatccccatcccagattttctctgacctaacaaccaaggttgctcagaatttaaggctaattaagatatgtgtgtatacatatcatgtcctgctgctctcagcaggggtaggtggcaccaaatccatgtccgattcactgaggagtcctgacaaaaaggagacaccatatgctttcttgctttctttctttctttctttctttcttttttttttttgagacggagtttcactcttattgcccaggctggagtgcaatggtgcgatctcggctcaccacaacctccgcctcccaggtacaagcgattctcctgtctcagcctcccaagtagcttggattacaggcatgaaccaccacaccctgctagtttttttgtatttcgtagagccggggtttcaccatgttagtgaggctggtggcgaactcctgacctcaggtgatccacccgccttggactcccaaagtgctgggattacaggcatgagccactgcacccggcacaccatatgctttcatcacaagaaaatgtgagagaattcagggctttggcagttccaggctggtcagcatctcaagccctccccagcatctgttcaccctgccaggcagtctcttcctagaaacttggttaaatgttcactcttcttgctactttcaggatagattcttcacccttggcccgcctttgccccaccctactctgcccagaagtgcaagagcctaagccgcctccatggccccaggaaggattcaggggagaggccccaaacagggagccacgccagccagacaccccggccagaatggagctgactggtgagaacacacctgaggggctagggccatatggaaacatgacagaaggggagagagaaaggagacacgctgcagggggcaggaagctgggggaacccattctcccaaaaataaggggtctgaggggtggattccctgggtttcaggtctgggtcctgaatgggaattcctggaataccagctgacaatgatttcctcctcatctttcaacctcacctctcctcatctaagaattgctcctcgtggtcatgcttctcctaactgcaaggctaacgctgtccagcccggctcctcctgcttgtgacctccgagtcctcagtaaactgcttcgtgactcccatgtccttcacagcagactggtgagaactcccaacattatcccctttatccgcgtaactggtaagacacccatactcccaggaagacaccatcacttcctctaactccttgacccaatgactattcttcccatattgtccccacctactgatcacactctctgacaaggattattcttcacaatacagcccgcatttaaaagctctcgtctagagatagtactcatggaggactagcctgcttattaggctaccatagctctctctatttcagctcccttctccccccaccaatctttttcaacagagccagtgcccagaggttcaccctttgcctacacctgtcctgctgcctgctgtggactttagcttgggagaatggaaaacccagatggtaagaaagccatccctaaccttggcttccctaagtcctgtcttcagtttcccactgcttcccatggattctccaacattcttgagctttttaaaaatatctcaccttcagcttggccaccctaacccaatctacattcacctatgatgatagcctgtggataagatgatggcttgcaggtccaatatgtgaatagatttgaagctgaacaccatgaaaagctggagagaaatcgctcatggccatgcctttgacctattcccgttcagtcttcttaaattggcatgaagaagcaagactcatatgtcatccacagatgacacaaagctgggaagtaccactaaaataacaaaagactgaatcaagattcaaatcactgaaagactaggtcaaaaacaaggtgaaacaacagagatataaacttctacatgtgggccgggggctcacgcctgtaatcccagcactttgggaggccgaggcaggcagatcacctgagggcaggagtttgagagcagcctggccaacatggcgaaaccccgtctctactaagaatacagaattagccgggcatggtagtgcatgcctgtaatcccagctacttggaaggctgaagcaggagaatcccttgaacccaggaggtggaggttgtagtgagctgagatcatgccaatgcactccagcctgggtgacaagagcaaaactccgtctcaaaaagaaaaaaaaattctacatgtgtaaattaatgagtaaagtcctattccagctttcaggccacaatgccctgcttccatcatttaagcctctggccctagcacttcctacgaaaaggatctgagagaattaaattgcccccaaacttaccatgtaacattactgaagctgctattcttaaagctagtaattcttgtctgtttgatgtttagcatccccattgtggaaatgctcgtacagaactctattccgagtggactacacttaaatatactggcctgaacaccggacatccccctgaagacatatgctaatttattaagagggaccatattaaactaacatgtgtctagaaagcagcagcctgaacagaaagagactagaagcatgttttatgggcaatagtttaaaaaactaaaatctatcctcaagaaccctagcgtcccttcttccttcaggactgagtcagggaagaagggcagttcctatgggtcccttctagtcctttcttttcatccttatgatcattatggtagagtctcatacctacatttagtttatttattattattatttgagacggagtctcactctatcccccaggctggagtgcagtggcatgatctcaactcactgcaacctcagcctcccggattcaagcgattctcctgcctcagtctcccaagtagctgggattacaggtgcccaccaccatgcccagctaatttttgtatttttggtagagatggggtttcaccatgttggccaggctgatcttgaactcctgacctcaggtgatccacctgcctcagcctcccaaagtgctgggattacaggcgtgagccactgcacccagccttcattcagtttaaaaatcaaatgatcctaaggttttgcagcagaaagagtaaatttgcagcactagaaccaagaggtaaaagctgtaacagggcagatttcagcaacgtaagaaaaaaggagctcttctcactgaaaccaagtgtaagaccaggctggactagaggacacgggagtttttgaagcagaggctgatgaccagctgtcgggagactgtgaaggaattcctgccctgggtgggaccttggtcctgtccagttctcagcctgtatgattcactctgctggctactcctaaggctccccacccgcttttagtgtgccctttgaggcagtgcgcttctctcttccatctctttctcaggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccaggtaagtccccagtcaagggatctgtagaaactgttcttttctgactcagtccccctagaagacctgagggaagaagggctcttccagggagctcaagggcagaagagctgatctactaagagtgctccctgccagccacaatgcctgggtactggcatcctgtctttcctacttagacaagggaggcctgagatctggccctggtgtttggcctcaggaccatcctctgccctcagcttcctccacagggcaggaccacagctcacaaggatcccaatgccatcttcctgagcttccaacacctgctccgaggaaaggtgcgtttcctgatgcttgtaggagggtccaccctctgcgtcaggcgggccccacccaccacagctgtccccagcagaacctctctagtcctcacactgaacgagctcccaaacaggacttctggattgttggagacaaacttcactgcctcagccagaactactggctctgggcttctgaagtggcagcagggattcagagccaagattcctggtctgctgaaccaaacctccaggtccctggaccaaatccccggatacctgaacaggatacacgaactcttgaatggaactcgtggactctttcctggaccctcacgcaggaccctaggagccccggacatttcctcaggaacatcagacacaggctccctgccacccaacctccagcctggatattctccttccccaacccatcctcctactggacagtatacgctcttccctcttccacccaccttgcccacccctgtggtccagctccaccccctgcttcctgacccttctgctccaacgcccacccctaccagccctcttctaaacacatcctacacccactcccagaatctgtctcaggaagggtaaggttctcagacactgccgacatcagcattgtctcgtgtacagctcccttccctgcagggcgcccctgggagacaactggacaagatttcctactttctcctgaaacccaaagccctggtaaaagggatacacaggactgaaaagggaatcatttttcactgtacattataaaccttcagaagctatttttttaagctatcagcaatactcatcagagcagctagctctttggtctattttctgcagaaatttgcaactcactgattctctacatgctctttttctgtgataactctgcaaaggcctgggctggcctggcagttgaacagagggagagactaaccttgagtcagaaaacagagaaagggtaatttcctttgcttcaaattcaaggccttccaacgcccccatcccctttactatcattctcagtgggactctgatcccatattcttaacagatctttactcttgagaaatgaataagctttctctcagaaatgctgtccctatacactagacaaaactgagcctgtataaggaataaatgggagcgccgaaaagctccctaaaaagcaa

SEQ ID NO: 61512 - DNA, 86066 bp, Homo sapiens
gtcgccagcagctggagcggagttggaggaagcagcggcagcggcgagggcggcaggctagctgtcggagacggcaagcacggatcgggcacggccggcgggtcgcagccgggctggaggccggtcggaaccgagcgggcaggaggccaccgctgcagcgcgggccccgcagaggaaggaagccggcgggcggggtaggtaggcagcagcagccccgggtgtgtgtgctcgggcgggggaggcggtgcatgtgtgcacggctgccgcgactctcttcctgtcactggcagcggcttctccttctgcagagccccgccggggggaagcgggctggccaccggccctccccgcctccggcatctcctggccgccgggcagcactacccccgcgcgcggccggcgtcctgtgagatccccgccatcctgactcccgtttcccccgtcctcctgcgagctggtcctgcacgccgccggtcgcatttgcccccggagttgccgacgagctcgggcttcctcccaccctccgtcaccgcacacttcggagggtccccgctgtcgccttgctgcagttttccggggcccctcaccggaggagagcgccctggccgctgccttcgtgttgcgggaaggagcgctcccttcccccgtggccctccagctgcagccagggtcgctgcccgggcccttcccggggcgggcgaggcggcggtggtccccggagctcgtcccctaacccccgccttccgaagtttgccgccctcctcttccggggtgggggaagtgcgcctcggggcggttggtcgctggggccctaactcagcgtttattgccagccaagcttgggcaggttgttggaggcatatttagtggggtcttggaaccgcccggaaatccagcttttggaacgtggggcgaggcgggagggacctgcccagcaatatggagccggctggggagagccagggagcctgcaacccggagctaaaatatcgtgggcaattctctggaaaccacagctctaacctaagctcagaaactgcccctcagatcacaagacaaagagaacagaaaacctctggccaggcactcctgtacagaaatacactttgataaccagaattggagcctgaaatgcaaggatatatgcagaatggctgttacgtgttgaatgcagaatgtgtgtcaactgggtttgggggaattcttctgtttcccggggcgctattaatatcggaaaggtctcacttccaccgttaatcccttgagctgcagcgctgttggtgtccgagtgtgagtctgctctttatttgggggcttcatgattttaggttttttttcttttttctcttcttttcctctttgtcagccagtgcgaagtaccaatggataaagcagttccgggttttgaatgcaacataagattgtcattttggtgtgatgaggctcaagttttagtaatcaggagggatattcacagagcttattggtcaaggcttgatgtggagttatattttaatgcttcattagttctgttacgttttggcaaccttaaagatggttagatattagctaggaagggttggagtgggcagacaggttcatttcttaagcaggttattagaatattagattgtcacagtttgaattactaggaatttggtgacttctgcacagaaggccacaagtatcttttaacattgaaaaaggaagaaaaagcaactcactagctatacaactttttgacagattacactgttcttgaaaaaccgtttagaagaaagcagataagagttttcttaggtgcaaaagttgattaaactttaggaagcaagtgtttttgaccagtataaagaaaataagagtaatgtgtgggggtgtgtgtgtgtgtgtgtgtgtgtgcgcgcgcgtgcctgcggctaaagtttgggaagaaatgttggttcagagttaaggtttaagttggaaaggccagtggaggaggctccctgccttgcagaactgctgggtattgtcactgcttgcctcttcagcttttatatgcaggtaggtactagataatcatattactttttccagagaagtggatagatttttatgattgggagaaagtttaatgtatctgatactggcttgcaaagtgtaatgtgcatttacttttaactttcatcttgacttgggacctgttcttagttgcataacagaactctgcagtgtacacactgctatttgatgttttatctgctttttaaaaataatgatatcagtgagtctcttcctatccatgatgctgtatagtcagtgtaaaaagcattttgtttcccatttattgaatgttttttctttagcgatttcttgagtttaaatatactaagcgcaggaaatcctcacagaataaagttggttctgggaaacagaagtggaacaataagttataggaatacatattttgattatagacagtgatgatggtggtatgcgtttatcttttggtaatgtcagtttcacctaacgtgatttttgaaggactttgaattgtaaatgcaaacctactcaaactaacccaaattttgtactgttaaaagttttggccatttctttacatttttccatgactgtcatataatttttaggttgatatgttgattgaacatatcaacctaaattgatatgttcaatcaacatattggtcgttcaggggagtattgtaaaaaggcatctactctgaaagattgttcacatgatcattaaaataggaacaattctagttcagcttttattgtgtttgcattttgtgatttgcaaaatacatgttttattgaataaagagatggtgaatgagcaggctgaaaaaaaattgatttttatgctcaagtagaatatagccagttgagataatgtttgtgttgggttttggaattctctcacgtcaaggcatacacaatgcaaaagatattgtatgtttcatatgagctcctccagctctccctcttgcagggcacagggtttgcaagtgaaggcaagagaatgaagcattttaatgaagccctggaagactagaaagttagttatcaatggaaggaattatcaagttagtttttactttagaaagcagaatataaattatatcacagctttttatcaaaacctaggttttaattaattttcaaagtattcatatcatttactgcattttcccatgcctcctttacgtacaccctaatgccctaatgtgattacttgccatgattctgccaatacttgtatggagttacttgcttaaaagagtggcaattaacgaccatttcatgtacattaagccacatgagctgaaaaaatagactatatagttacttataaacttgtctgtatggcctttatttatcccctaggtgttaggtgtttatttatttgaaaggctagagtgattgtagtatagtgttattggaaaaaatgtctactgtagaaacatctttggagattttattctgctagcattgttttccttaaagtaaatcaaatacatatccacaggcacctgtagtcaaaatagttgtcaggttaatgatcatccaagagagtattgaagtcacaggagtctggccacagtgtgaggaggctccaccagtgagtgtagtgagttaataaagccaaggcatctggaccagccattccttgcctgttgtcttcctccccggatgtcccagtgtcccagcctggggttctgccccaggatcaagggctgtaccatgaggacacagctactcatctctaaatcctggggatgcacacacacatgtacacatcccttggcctctcccaggcctcctttgtcctgacctctgtagagccgtcctctacctcaggtaaggagagaactacatgggcaaagtccacactcagcctttatctatttactccaaaaggggtttaagacagcgggagttttattttagctagattcaggattcacttagaactgtttgcagagttaagaggcaatgcagaagaaaatccctcataaatgtttgttcctctgttaaatctgaattgtataaatggcagtaggtgacattcaatactaatagaaataatagtaatataatagttgcaatttactagctatgtaactttaggcaaaatatttaacttttatctgcttgttttctcatctgtaaaatagagataattgttgtacttagagtgattgtaatggttaaatgagttgatatatgtacaactctgagaactatgtgcctggcacatagtaagtactatgttggcattaattatcctaagctcctattatcaagtatggagcgaagtgctttatgtatgtcattttgttaatcctcataatgactctgtgggctgtaggtttgcttatagctgtctcacagatgataaaactgtgccacagagaggtttaagtaactttcctgaggttacatatttaggcacaatctgactggggcagctgcctgaatctgaagctcagtgttcatactaaccttgccaagaagtttacagaatagcatctttttttcaaaagaagagagacttgaagtcatccccttcagtcctctcattcctgccccctcaggtcctcttcattgtgatgatgcagagaaccggaatggtcagcctcatggccttttctgggtgataggatctgtctgtccctcaggtcccagaagctacgtcaccctttctcccagcctccgcgtaatggctactgcgtgcctaagcgttgctgtcacctgggccagggtcattcctctgtgtttcctgcagtaccttcccctcatgttggctgctttctgaagagccctagctccttgttgtgttacctgggcttgtgctacctgttctcctctccctcgccccacaaacacaacaccaaaagggcttgtaggcgagaattacagcctatacagcctgtttacccacaccacacacccagccctgagcatggcagcatgcaacacattctatttagttggttggtttggaaatgaatttgatgtctattatttggggttaatctcagcccattattttcattttattttaattgatataaagtccacataccataaaattcaccctaaattcatcatttcaaattgaaggcaatttattatgtttactaggtgctctgggttgaatgtgtcccccagagtttacatgtcagaaatgtaatccctaatgcaactgtgttgggaggtagggcctaataggaggctgtgctctcttgaatggattaatgtcattatggcaagagtagattagttatcttgggaatgggcttgttataaactcgagtttggccctgtcttgctgtcttgcccttgcaagaggacataagatgaaggccttcaccagatgctagtgccatgctcttggactttccagcctccagaaccaaatatacttctgttgtttataaattacccagtctcaggaattccattataacaacacaaaatggactaagacactaggatattttaattttgttcgtcttgattttcatgatttctgggacaccatgatttggaaggtaaaccatttttaaataatgatttttttaaagactgtatgaatttaggtgaggagcttgacctagactctgaactagcacactgaagttaaaaagatggactgtagagagatatgggctgtgggcccaggaacccttccataccctcctgccttggttgaagacccatttcgtgctgccatccaatgcctaactgctaatttcattgggagatagaatcacatgacttggatatattcttgattaatttaatgtgatttaaaaatatcctgtattcctgcctgtccatcaagttctccaaattcttgtcatttctaaatggagaatggagtaactcaacaaagtcagagagggcttttttgtttggctctttgccaaaatgcctataggttagagggttacacagaaaatctactttacagcagttgtacgttaagtagctgtggattgctatttgtcaaacatcagaaacaattttattttggggaatagaaagagaatttctctgtatgttagcagggacagaaaatatgcttctgattaatgggattgcaggcagtcattagaaggattgaaagactggagaaaaattccttaaaattttgaactgttgcatatgatattatataagagtaagttagtttacttgttcgtaggattcctttataccctttgttacaataacttatgcatgcactagcttggagcctatatcacaaaactgccttggttatttgaaaatattacattgtagataatgttatctacatataaaaagcctttgctatgtgaataatcatgtcagaactgggtaaaaatagtttagtgggcaggtatatgtagcaaaagagaatagaggcatgatagagtgaatctgaggaaaaatcctgttgatttggatagtttaggctccaggtcgatctcggtaggggtggtggttacacaggtattaccaaatacctcaggctgctgggtcttctgcagtactgtgaagaatttgaggatgagagaaaagagaacttcccagtcctctagatgtgacagtccttgtggcagtgccatatccccctaaggaggagctgggttattggaaattgttcagtggaggggcctgggatagtggcaggaggcagaggtgctaaggatacaggtggcagaagcgaagctcatagagcagaaataggcaggattccagaagtgggcagccttccagaagtggtgtgcccagtattcttttattcactagtttatggacttctttcgcagggacacattttaatgaagtctctttggaagaaaatttgcatggctgagatgctgggttttggagttgatggaactgccgagttaaaatagcttttttgtgtgtgcaggtagtgtgaaagagccacatacactatcagtaaagccgctgtctgagagagttaaagaggcagacagacagttaaggttaattggagtgatcagcttgtgcaggccacgaacctgcatcatccacaccaaagcaagttgagttcaggcagtagatgctggaggtgttaaaaatgggacttacagagctagactgcctggatctgaattctagttcctcttcgcaattgctaagtattatcgtgacagagatattttctgtcctatgttaagtgagactactgatagtacctgtttttatatagttatctacacacacacacacatacatatatgactatatatatgactatatatatatgactgtatataactatatatagtcagcatcatcatatcatctaatactaattgggagctatatgtgtacaaactcaatcatcatcatcatcatcatcatcatcatcatcatcatcatcatcacccaatacttaaccggagttttatgtggattaacccattcagtcctcaagaatgacagacgtcaaaatggacatggcagtcaggagaaagtgtacaatgtgcaaaagagtaggggtggctgccttctctgtctagctaagggctctctacatcttatcaccatgctgtccagtccccaccccaatgacttgactgctctccttttttttttttttccacaacattgccctcagaccacttaattgacactgactaatggctggccttgaattaacgtctgcatcaatggatggatgccctgtttgtatccatcttcctggccttactttggggtctcagaagacagaaatggtgtgttctatttaccatcctagagtcatagaagatttgtggttctttttatcagatgaggacccagagttctgcacagggttcttcttacccacaaagtaaggttcttcttacaggtggcaagggagagagaatttgtagagacctttagttctctgtcacttcagacagggattgcctctctggtgtctagcctctaaaagtcatcatgttccttaggtttctatttccctttgcacaaatttagcctcaggcagactcaagcacagcttttaggtttgtaaaaccttgacaagtcctggagccttttcttaatacagagccccctggcaaggaacagcttcagaggtaagctgtgagcaggggcttgcttgatggttcctggaggattgaagatggggaagagtttgttcattatacttcccattctattaagaatcccaccaaactggcccactgggtggctggaataaaggaagtgttaggaagcagctggcataaagatctacccagcctactggttgaggatttttttttcccccctaaaagacatacattgccaggaaaagctaacaaaaatttcaaggcagatttggaggaattaaattattcttaggcacattgcctggtttctaagcatttagggatatgtaaatgttcatgttctttagaggtctctgtctcttttgtacagagtacattagtactaaaaatgagatttgctagttctacattttcatgtgaatttatgcagtgaatattcaatttgattctggatctttcaaaaggaaaggctttctttaaacaaataatatagcttatttttctgatatgctctattggttgctttgatttttttctccgacaactgaaatgcgaagtagagtactatccccaattaatattcttgctccacaaagacttccagtgtttgtttttgcttcttttaatatgtaactctcctaagtgtgttattgtattacagctaagaggctttacccatgtaaagttgaatactttacacttctgaatgccaacataacaattaatctatgattagattttgcttcttaagatgcctccactgacgagtgcctgtaatattaaacttctaaagtgttccactctttaaaacttataaaagctctctttgatatagcccactgaaattgtgtggctattgtttttattgctttattgtgcagccagcttaactgaaacctttgggtggcttttactctttataataaagataacattgagaaatgcctggagtacaaagtgtatatgtgtacatgccgttctcagccatctactctgacttagtaactctctaattcccttgcctccactatgtttaagaacaaaaaagaaaaacacttacatttcacatttcctccatcaagctgtctttatagagtggtctgtagcaaccattgctacttcctctctaatattttttaactccttaagatgttgttgctgtcctcactgctggactggaatctgcgtgatgattccatcatgggcgaagccccaaattatttagccttgactcagtctctcctgtctggatgcctttgcaggatttagtcttagggatcacattttcctacttgaactcttcttccttgtttttgggatgttgtctctaaaccttgactttccttcctcagttacatacattgaacttcactatttggcccttggatcatttttttttttttttaacttttgatttgtccttgtgagctcttccattccattgaattcagccttgcctaattgtggccgattgccaaatccctagcatgtttcctcttctgaatcacagaccagggtttcatcagccactagcacacttgcacaggggtgcccagaatcaccgtcagcccatcaggtcacctggcttctctttgcctgatagtgctccaaactctcattaatgcaggatcaggcaccctttgctcctctcgttctcgccgcacatttaagcatttgccacatcccacatgttctttctctgcagtgtttatttcactcctcccctttccacacctgctgctgccaccctggtttgtgtcctcactacctcttggccagacctctgcaacacacctttctcgcacactgtggttagattgatattcctggagtgcagctctgatcccgttgctcacttttcaccaagccctttccgtgttccacactgtgggctgaattactcacaaactcagcatgggcatgcgtgatgtcctacagcccctacctaaatctctaaccccaatcccactgctccctctttggctccagacggattggactgcctgttctagctcttctcagaatatgacattttcttggtcacttctgtaactagcgtccgaccacacatgccattctgtcttcagattcctgcagttagtgtgctttctccctcgtttgaaccctgcagtgtttagtttctgcctctcttatgacatgtactagtgttgtggctctgtgtactctgagccacattatcagcgataatgtcacattatcgctaagacattgcctcatgccgacactcctcccctctgcccccgcccggtgttcttagaaggcagggactgccttactaatctctgttgtgtcaagcaatagcacactggcctgtgtctgtctgccaaatcgattaagtacttgttgaatggaagtagaaattccaattaacacagatggcaaagtgtgctgttcattcttaagtctcgtttttttcattcctaggtgaagctcgtgtgtggagtgccacggtacaatcagacgacagatggacagtgtgacaaaagtgtcagaaaggattgggcctcgctgtgagagtcagcctggattcaaagtgttgacaagttgctgaaaaggaagccagtgagaggactgtggcacgcagaggaagtggagccctgtcttcggtcacaccattgatggaggacagatggacagccgtatggccagtcacctctcctcttaaacctttggagagtggtcctttgtcctctgctggacacataataggaattctaacacattctctgaattcacttttcataaaaacgtaaaatcagactgctctgtacaaccaggctcaactgttgcatggtagcagatttgcaaacatgagtgctgaggggtaccagtacagagcgctgtatgattataaaaaggaaagagaagaagatattgacttgcacttgggtgacatattgactgtgaataaagggtccttagtagctcttggattcagtgatggacaggaagccaggcctgaagaaattggctggttaaatggctataatgaaaccacaggggaaaggggggactttccgggaacttacgtagaatatattggaaggaaaaaaatctcgcctcccacaccaaagccccggccacctcggcctcttcctgttgcaccaggttcttcgaaaactgaagcagatgttgaacaacaaggtcagtattgataagtggttgcttaatgactccctttctttttctttttaaggaaaagtcttaagtttgggttgagtcgttatgttctgggcagaagttaccttggcaactgcacctgaattgatgtgtggtgcataaaagcttggtcaatcattacacaactagaaatttgtgtttgtggggttggaagttgttataaaaatagggacacagtatccgagaacctgtttagtgagtgtcgttgaacactattattatagttgtcattgaattaaacatctactatatttcttatttttgtaattggcattataggcggagtattcctagtctgaaaatatgaaatctaaaatgctgaaaaacccaaaattttttgacacccaaaggaaattctcattagagcattccagaattcagattcagtggtcaaggggtataatgcaaatattccaaaatccagaacaacatgaaatctacaacacttctggttccaagcatttcagataaggaatactcaacctgtgtatatctaataataattttgggaaagtggagggtaagtctaatataagtatatttaacatgatttgtatggaaaaatgtagagagtaataaaatgaccacagaactcggctgagaagaaaccattgtttttataacctggtatctacctcttggtttcctctccaggatcgctgtggccaaagctgaaacccaatcctatagttagtataaaagtaaagggatttcacttcctttgtgggtagtgtcatttgtagcattaatgcctatagtctggttcgccttcatgagggggaagaaaaattcactgaatactttgcttaaatggaaaccaccttcattcaaaaaccacttattgcttattggagatggtccatacttgcgcttcaggcacagctgtgtctttaaggtttatcttctgttcggtttcacacagagacaagccttatgctcagctttgctgttatcagctttgtcaaataccggtttcctcactagtaaatcacacgcatttttcttttttctcttgtgtagtcttctttcttagggtctaagaagggaatgggaaggaatggtttaagatgggtgggcctaactgcagtagttatatattgaggagacctgactggcatcacaggatatttctggaagagattctgataccactagtaagctattataccttctttaatgttgccttattctaacacaagtgaataagacaatgagaacagagaaacagaatgcaagggtaagagctgcctttcagtattgagtagtaatagattgggaatattgtgttaaaatcaaggaatttattaatgatacctgaagggaagcccttttctttcccatacccagcccaaagggatacttatttcataaatgttatactttataatgttcaaataatatcttttattatattgttcaaaagccaaagttaatttttctttgcagatcaatcaaaaaaccatgactctccgcacatacataagtgattttatcaaccattgcagcacttagcagattgaagatacatacgtaatcgtttttctccaccaagttatatattttcaccttttattttttttaagttaaaaacgctttcttcagtagcctaattccaaaggaaaagtgatttaatttttccgagaatacagagctttacagaatcataaaaatagttgaattagagaagattatttaaaaggtggaataagggcaccttgtcaagattagttacaaaacaattttataaaagcagtttctaaacaaaatttgcatttgataattgctatcaggtgcaagtttctttggctctggtgtacagaaaagcaagtctttccttataggaaaagtcattttctctttttatatcctaaactattttataatgcttgctttctcatgtaatgtgatgacaattgagatttttagcagctttttcatttttctttaatacatggaaagatggagtgaaatgaaaatttttagcagaattcaagaaagagacccatgataatgtgcataaaagtattagagcctgaatataaatgagaaattagtaataactgaaagattgaaaggagagtgttgggggggggtcatgtggggagtataatactaaacattcaattttctagaagtgttggtcttgtattctcatttaaatattcctatgaagcgagaattcaatagctcctatgagttgcatgttgaattcatatggaaagtagttataaggacaaattttatatgttagaacctgtgagactagtttcttttgcctccgtttgtatttctttgaaaagcttttgcagtgacaaattgtgtgaaggcaagaaatgatagttctgttctattcttaccataattgaattctttagttcttttctttttttttccttttaacaccctccacctccacctgacttagccagtttttcatgttatgctgtgtttattgcatttagaaggttattcctcaccaacccccaccccaggtctaggaaccacatgcagttttgttttgtggacttggcacacctcgttaatgggcagcagggtagacagagggtgcgaggacagcctgcatgccaattgtgtgtctgtgtcctgctgagccttgctgccctctctgtttttaaaaggaaattgtccttagactctggccaagagtacgttctgtgagagattcctccctgtacgatagtgtcttacttttccactttgcttgtatgttcttggaaataaagctgtgatatttaactttttgagagaaagagtcaaaaacccattaggaaatcttatatacggcactgtactttcttccaatacattttgcatgcagtttttaggaagccctggcatatagattgaatgaattgttttaattggataattttggatgtttttggacttaaatacattcagtaagcatggtctgagtccttattttgtgctggaaagcaaagataaaagatgaaatcaaggctcaagagccagcatgccctgagatgctctctcatgcctctcttccacctttggagctgtgctttttctcctctgctagtacagctcttcccctagacatctgcctgactgacccactctcacttctctgctcaaatctttcgtctcatggagtctggctctactcacgctattctatgctgggacctacctctctgcttttgcaaatcattgattacttaacccacgatatcgtttacttattacgtttattgttcattgactgttccctctgttagattttaagctccataaggggagagatctttgtggtcccccattatcctaagtacctaggacagtgtggtagtttcccaacatgctggtaaacaggtgctgctgcagctcatcctacagctatttcactttctgcattgcttttgaaattgaccacgtgctctgaatgtcatgtgcagtcatacaaagcttaatggcccatcttgttttagaaaataacagcttatttgttatccacatccttcatctgaggcatcctgccttggccttaaccattgcctggtatgtctccagaactctttattttcttcccagggcctgggacaggtagttctgctggtgggaaagtgcattaagctgatagtaccttcagtcacttaagccaagtgagtagaggggctgtcatggtcagcgaatatcctcagggcaaattctgtgccctttctcccatccttttatctccttccctttgcatgggggctaaaattgccaatatgaggatgacgttttattttatttttctacaagccagtagagccctatgttatgttcttcggagagaacctcttccatgttttgtttggataaagagtgtgctgggtgtgcaaggtgggtgttacatgtcctcgggtgaggcagctattgaaaggcaatcttatggctctttctgctttagcttgctcagatcctggcatcccatcccgctacaccaaccccattcagccagggtcctgtattttctcttgtacacaacgaaatgagttgattgaaaatggggatatagggatatgggaataaaaatatattcctctgtcatatgtaagccatccagtggggctatttctcaagacagtggttttaactcatactttgagatcctttaattaaagtcatgctaatgcagaatatttagacgggtgagagtctgtgcccatgttagtttgtgcagtgcagtgaaacctgctaacacaagagattacttactgcatacccacctccatcctgacctgcacaaccctccctggctcctcctgcagcctctgacagtggatttcagctggtttcaaacctaagacataaagcatgcatttgacatggcttacgctaaattttgatcaaaatcccttttaaacagaaagaaaaaggccaccattggtgttggttttcatggtttcccaaggcatgttattgttaaatttttcacattcagcatttgagtgtcccttcatggttgttgttccctgtccagaaagcagggctgcaataaatcacaaacattgactacactgtacagaggtcacagaaaatagtgacctgatcccaaattacacacctctgctgagcccgttggtcataacctacgctgtctccttgaggcaaatagtgcttgtgcaagtaatttgctttgcttcacaaattcctgcctttacgaattctgttttctttcagaatatactttctcataacattcttcactcttccttcctacttaagtctttgctgtgaacttggaggtttgtcttgttaagcccaagtgatggggaaaaccacccaatttatggtgctgactgctcattctgcatctatcgaccactctgtttttgcgagaaagttgggtcagttacaggatcttagaagataagggcctttgagctctgtctctaacttctgaccacaagaaaagttcatcaggacattatggagatttttacccaggcatgaaaatttaagtgtttgccctctgtgtttcagtaggaaatgaaatatatttctactgaaatataattgattaaagagtgtgtctggaaaaaacaaatgtgctaattattttgaataaaatcagattagcctaaccacttagggtcacagaatatgtcatttgcatattaaattacttattgcaacacagttcaccctctcatgagcatttatattctcaatacattcttgattttttaaaaacattttttctgttaactttgtttccctaaaaatgtgtaagagaaaggaaagtagccctaattagcgatttgtgtatccgtggttttttgaaaatgaaattgacaaaaagagacaggatgctcacttttattgctttttgcaggagggttcttaccctgagctggcctggccactttaggaattcacaggcacgctctgaggggcctgtgagtagggaggctctcttacccagaggggagaggaaggcatttctccctccttccctcagtctgttatttgaagggaatcacttgaactgctctcctagagctgcggtgacagttaagtccagggttgcagaataagacagtatttgaggagaagaagctttctgccaggtgtctgtttctgcctctgtcctttagaatcacagggttatggtaggcaagttatattttcttatttaagtgaaatgtttgttcagatgcttttgttaaggcttctgttctatacacttctttctgtgttcttttttcaaaaatgggaaaagggtccagtgtccttatatgtatatcctaagtaaagccctcacacacctctgattcaaataggagttatttaattagagggagcatattttgttttctggcaactaagttaatgttgatattctaatacaattttctttgttataaatatggaactctctatttaacttgtcaatagattctttgataaatttgatgtcagtcttctctggtttctaggtgatgcatctttgtctacaacaagagacattctgattagtaagaatttcttctctgagttagaaaaaaaattagaaattctgaaattcaacaacaaatgctgacttacatctgctaagtagcacccaaaaaggggagaattttttacctatggcaaataagagtgccaaatgtgacatcatttacatatccatgttttgattagtaaaaaccaaacagatgttagcagtacagctggctcttgcatatatgtgtatctttgttgctaacagatttccatggggaaggatgtagcactggtctgaagtctcagataggagaagataacatggtgtgatagcttgaaatgaggagcataattgcatgatggattatatctgaatgttttgaggtcttgagtttatagcattcgatatcaaagcagtccttaggctttcaatagaggaggacacatggagggggacaaagtgaactagaaatgggctttatttcaattgcttgggtatagtgtacctaaaatgtcaagttgtttaacagaatatcagactactttataaatgtgttattccttcttaccaatttatgtaatattttatttttactatgaaaattccatgcagtatacaaacagtacgtggaattgtagtagaaacattgttaaaatataactttgaattaaaaacaaaacatggtatacattgttatataatggataacatagtgtatacattgttaaaatatatccttgcaattaaaaacaaaacaaatcagctgcaaacctttgtttaattatgtatgcagaactttctcccaatggctttataccacctaaggcatggctgtgattttcaggaataccctctctggactgtttcttgcttggaggtgtttgcgatgtatttgtatttgtctgtctatctattctcagttggtagattatgtaatgcctatagattattctgtcctgtcacagtttgattcattttgaagttataactgtgaatttattacagcgtattgcaggagacgtaatttgatgatcaaatctgatatccaagatcgtaaagaatataggcataaatgaaatataaatctgtgatatattatttgaatcagaaattccacattgctttgctttctataaattccttaacgttctagttccagtgttctctaattgtaagatgagaagctaaatgctgtctcttttgagtttcagcagtttttgttttaatccttctcttcccaatcagaagaactgtcggagaaataagacccagaaaaattggttctcactagtagtgtttccccaataatgcaacccagaagccctgtatatgagaataagggaatgtagtgagaggatttatgcagagaaacaacctaggatggttggaaagatgtacttacatgacctcattgcacgatctgattggagactggtccatggattgtatgggattattgcttatgaaagtgcccacctggtatcaagtttttgcagatgcatgcggtgtatggttttaagacatgtttcaccagtgtgaatatttaggctctacttctgttggtgggcagttagcaattgctggtatctaaactggtttgagacttactgcctcatttgaacagtatctgtgcagtagcgctaaactcgttgacatgatctgtactgagagttcctacagatttgtttcatatatatttgttaaattttccaaggtaagtagagagtgatggttataacatttgtttattcagacccctctaaatctacctaagaggtaacatgttagcataggcattagacaaggctgcattgtgaagtcagagtgactgtctggggttgtcactgtcatcttccaagctttctcctaaagaagaaaattgacataatgctctcagacttggcacatgggaccagtgccacagcaagcactggttctagcctgctactggtttttggtaaaatgcagttttcagaactactcaagggtgtaataagattaatttttatgatattagatataatatgttaactttttagctattgttaatcttaaacactgatggctttatttttattctatttaaaaaaataatttttgaggccaggtgcagtggctcacacctgtaatcccagcattttgggaggccaaggtgggcagatcacttgaggtcaggagatcaaaaccagcatggccaatatggtgaaaccccatctctactaaaaatacaaaaattagctgggtgtgatggtgcatgcctgtaatcccagctactagggaggctgaggcaggagaatcgcttgaaactgggaggcagaggttgcagtgagccgagattgtgccactgcactttagcctgggtgacagagtgaaagtgtctcaaaataaataaataaataaataaataaataaataaataaataaataattttcaatgcttaagaattttttatcagtaaacagttcatttgaatttttttttgcattcttgtttcccaactatagaaacatagctgaatatttgtggcatcattaatgcataatttcaaagcattttacacattgttaattaaatctcaccatgttctttcaggtagcaaaaagtaagtttatttttgattcagaagtatttgaagaagttagaacaagatgattttattgctaaataataaggaatatctgtggagtaccaaggaatgagatataatgaatttggttagagtatatcaaagtacatattatagtttttgtcttacacttccctgtgggtctgtttaactattgaaaatgtcttcttcaaaatgaaccttaaacatttgcaaacttactctttgctaattattctgccaggcatttttttttttcttttttttttgaatcttgctctgttgcccaggctggagtgcagtggctcaatctcagctgactgcaacctctgcctcctgggttcaagcagttctccagccacagcctcccaagtagctgggactacaggcacatgctgccacgcctggctaatttttgtatttttagtagagacagggtttcaccatattggtcaggctggtctcgaactcctaacctcaggtgatccacccacctcggcctcctaaactggtgggattaccagcgcgagccaccacgctggccctgccaggcattttatagacatttttcatttgacgctcacaaccaccctgcaaagatggcatattataacctttttttgtttgtttgtttgtttttttgagatggagtctcgctctgtcgcccgggctggagagcagtggcacgatctcggctcactgcaagctccgcctcctgggttcacgccattctcctgtctcagcctcccgagtagctgggactacaggcacctgccaccacgcccgtctaattttttgtattttttgtagagacggggtttcactgtgttagccaggatggtctcgatctcttgaccttgtgatccgcccacctcggcctcccaaagtgctgggattgcaggcatgagccaccacgcctggccctataaccgtttttgagatttaaaaactgaaggtcatgtgattgtgtaaatatttaaaaagtgatcatattaaaaaatatcatagtgatggcacattgataagattcaagaacattttgggcaaggcaggcagtcatgaggatctccttaagcagtctcttgtgaagtgatcggtaactgaattttgctttttgggtggtcttcaattatgtctgctttatctgttaggtttcactagctattacattcatgcaactccagaaatttacctccaatttatatgtgacttacaacattttcttatgtctggtaaatatttgaaaggattgaattacaaagagacggataaggccatgaagctaagacaaagttttgggtatgtgcatgtaaatgcaatttttctcaggaagaaatacaccatgatcagataactcaaaagttttataaccttgataaatagatttaccttcgtttctgttgtttttgaagaagttaaatgtctgctttaaatgtttccctgagtttcaagttttcttatttcagactcataattatatcattttgattaaaatggagcacagactggagttattacttgcttaaaagccaaaaacttgagggtatccagcataagaattgtgtgttttggtctgtggatagcagctgcttgaagtccataaaaacaagaaacctgaagttgattcagatgaatctgaagtcttgtacctgaattatgtcaaggttagcagtaaatgccatttaaaaagactgagtacaaattgccaaattcctttgaatgccaaaccatatttctcaggaaagttggccactgccaaatttataacatttgtgtttctgttacctgaattccaagggcagaggggtgattgagggggtaagggaaaggcacaggtgaattttattttcagatgtctaataggacagtgtgacattgcccagagatagtctctcaaaggtagtgagtgccagcagaacttctcgaatgcgaagttgagaaattttacttatttacttattttcccattgaaaaaaaaaaaaaaaactttaaatgttttctgagttaaaaaggcctctgactggtagtcctgacacagcttcttgagagtctccgagagagcctcttctcagtacaattcctaagaagataggaagaaaaaaaaaaatattcttaacacataaaactagaattagtgggaagaaatgcctactgtaaactcaacagaaccggggttaaaaaatataggataagttttgactacctaaaagtagcagggcagacccatctcttccctaactctgtccataattcagaaagggcccagggaactgtcctcaggaatgctcttcccccctcttccttgtcctctccgacagagcctttctaatcagtaggaggtcacaacttagaaaataaccagagagagctggaatggtaagttaggggctattactgttatattctgagaatcctgatccatgaaaataaagtgctgaaggtggggtagagttagaaagacctgtgttcactgagggttttgagtattacaggctctccatcactcagagcatcagaaagtcaggcggtgaacgcaggagatttttctctcaggctaaccaaaaccatgttgaaatgaaaaccaccttggaactggccttttcatctcagactgccaaataactagcacccaagtggatcccttagctcagagcagtcaccaggcatgggtaggtctttccttgtttagtgataaacaggaaaaacctaaccgagcctactgaaccatgtccatctataaaagaaaaagggagatcatactggagatttgaaagaagagtagacctccagaactgattgattataatttatttctgttatagtatttccacttagtattatgatttatttctgtccctcatgaaagggacagaaagtagtcaggcggttatgagatgaaaagacagtaagatgggatgaaatcggagtgaaacaataaaaaaaagactaagttaaaaatgtaatagcatattaaaattcatgtgtaagggggtaatgagctgaaaataaagtctgtgttttgaaggagaaacaagataaagctctttggaatccaaaggataaaaacataaaatgagggagaagatatatagagagaatatctaacaggagaattacaagtgttgataaacagggaaccaagtgaaatagaacaacatcattataagaagttttcatgcacgtgtgcagatttgaaagtgttgccgtatttttcatgtgaaatcaatgaaaaatatgtttgggcatttctatttaagaataatgttaaagtaccttgccaaaatatctggcaagatattagctaccagggaacaaagttgtttttcttctcctttctagcaataaatgccaaaaaaaaaaaaaaatagtgcattgattttagtagagttttgaggagaaaagatggtgacttaagaacttactgagcttcctccttatatgttatgtggaaaggcaattgagaggcattcgttgataagcaggagctcaggaaagatacactaaacctcttgttcacgtgggagtacctaaaggttgcctttttattgttaagctttataatttaaaaaggtgtaaatttaaacttaattcattttggttaacttcagtaattatcaaaataataaaactataaagtatgtatcttctaaacacctagaaatatatattccaaaagataggcaacaaagaaagaataaaaataatacagggaaaatgtttactatatatgactactttaaagaaatacagacattaacatatgtatgtacgtatatacacatacatatatacatataaaattgaccatatacatatatttgtgtgttcaacacacgcattatttttcaggtactgcactaaccttttattccattgacttgttacttttcctaagaactctgtgacactggccttattatacctgttttaaagataaacaagtttagttagagatggcccaaggtcacacagctagtggaggagctgggatttgaccccaaacagtctgactgttgacccaatgctcttaagcaactgtgcaatacagcgaaaggggcgccgggggttaatgttcacactgcttgatgctgctgacttccgaccagccacaaggcaccccggagccaaaggcagatgactccctggcttgccagtgacgtgtgatgcggtctgatatgacaaagtgagttaaacaagcagatttttcctctcaggaaacagacacaagaacaactgaaaagaataaagcagatgtgtgagttactattccttacagcaaaagaacctcatcagaaccgcaggctggaaagaggtgattacttttaaagggcagttcattcctcctgcatgttggaaactgtggctcttaactggctaaaattttaactttcagtgtagccctcacttggcttgtgcttcttaatgttgtagataacattatagatttatataatattcaacttttatatatatattacttatatataaatgtttatgtataaatatatatttgtatataatatgtattcgtatatgatatgtagtaaatgttatatttaaaccatcatatagaaaagccattattgggtacactgtacaaatctgcctttataattgagtgtactgttctactaaaagcagctttagagaaaggattgaaagccagctctttctacttcactagccttcattgtttggattggcattatgtgtacagttatattgtaactgtcacttgtggtctaatcttccccttaggggaaacttgagaaacctggtcagctttaacatttagaggaagtttaaacatattggagcataaaattcacagttgtttaactgaaactccagttcttgtcagaccacatctctccagcccttctgtgattggaatcatctaactttggccctcaataaggaaaactttgacaagatgcaaaaaatgtttactcttgttttctttgccaggaacctgagtctgcagcagactctgagacctctttgcctaccccaaataagtgaattgtcactgtaactgttttttatccccataactgctttcggtgaatgccaatctagttgttacatgcctttaatattttgggtaattatgttctttaagaatgaaaatattttttccttccttcctttcttctttccttcctggttttgttatagtctagctgtgagaccagttgcctttcatatattctagaagagaaggatgaggtgagtttcacagtgatctttttccaaaatacaaaaccactgtcactctccacttcccaggcaaccccactcattctattttctagtgagggttttgcttagatgatgacgagtctcttgattcagtggactcctaagggaccatctttcaccagcaccaaatgctgtttagttcacatattgaaatgttttaaattataacttagcaattgtagttagtaatcttcacattatattgtctcacatttaatgtataatttcctaagagaaggaaatggtcctggtgggggtcaatagttatagtaactattaataatactgatgactactagttaatagtaattaaggcctcctaaaatgagaggaaaaaaaatcttttgtttataaggtttaaaaagaagagttgatacttaatagttttagtaaaaccccagtgcatgttcgattaattttgttactttattctgggcatgtagttgaataattacctgcatttttgatttgctgaaaaggtggtggttacaattttttttgttttttttttttttacagtactgtttttagttcattacattgagatgctacattttccttttcttaaatacatgcaagatgaaatgttttacctctgagatgaaaaatttgaaatttctttaatgtgactccttactaacacaattgcaggcaagcattgaacatttgctttgttccaggcaccatgtgctgtgtgctctacctacctaatctcacttagtccacttagtgctatttgcaggttgaggcttagaaagaaaaagaaacttgcccagagtccaacactagtagctggtaaagagctggtctttgcatgcagcctctctcacttcaggatgggtgcttcccagcaccacactgtaccaccctcaagacgagttgcaggaggaaaggaacctctagtggtattaactaaatcttagcaagtagttgcctgtaaattgtagacttttaaatacaatctcacatttctgtgatctttacccatacaccagttaccttcaaactaatttaagaatcttatagatattaaaaatgcttgattggccaatatctcatttctgtcaaaatcatgtactagaagcatgtatcaaatcagagacttatttatgacaatttgcacacacatttggataaaatgcatcaacttctttcaaagtttacttgaaataaaaagggaagaatacgaagtatcacaggttaaagcaatgccctcattccatttaggcaaaagtgttgtgctatttgaatagtgttagtttgagaatatggagttgtactccttatagcaattccaacctagaaaaatgtttgtgttttaattgatgggttaggcaaaaagttaatctttgcatagaggaaagaaacagctctgacttagaggttttggggctagaacatggatcaagtgtctgaagtttttcatgtggcctcaagttgaatcttggtcagagaatacacggtggtcaaacttcacaccatagtcataatgtatgaagccaaaagaaaagtcctagttgctgggtgcttccattatatcatcaacctgggtttaatgattttattggaagcacgacttccagtgaggcaaggcagtaagccccagaagagaggccttccatgggtagataggaactcaaatgctttcccaggctggacccaggagactgtgtcagctactgtgatatggcttgccaccaggacagatcattctacccgtctaaggagttagggtatccccaagagctgtgatgggaggtggaaattcacacctgtgaaatgggaggtatgctgagttgaacgggatagcccaaggcctgtccatgaactgagccatggccaaggatttcttaattctagaggcctccttcttgagcttgccttcttttgaacttggccctcagtgtctgggtaagttggagcgtgactatccagggaaagcccctggtttgtatttagtcaagttggccagagaagactggatctaagcgggaataaaatttgctgacccccatctcagaggttaacattttcatttgtgttttgcatgactcattttaaattacagtgctctacaagtatagaaagaagccttcctcttcccaccgtccccagacaccacataatggaaaaagcaagaattttctgcataagcaaggccttaaaaaaaaaaaagccagcctctgatgggacttctttcctgccagaaatcccactggtccactgtcgcaatttttacaaaaggccacgatgaaagagtaaggcccattttgagccctttgcttctgtattatgtgaaacataacttgtatgtttcacatatgttcttggtatcagaagaattgttagtttttgaacatgtaaaatctactagggtctctgactgttaaagtataattttgattaagaaaagatttgttccactgctttgattagacacataaaactttgaaaagttttgatgttctgtttcctgttttaaaaaaatatgtcctctcctatgaactctaactagatgagaggattttcctcagagaaaattcagccctgggaagaaccatctatggaggtcataacctagaaaattcttcaagggaagttgcagtgaattaaaagagggcggagttagaaagtcctgttctaccaaatttgtgctaatagttgcacctttctttctttcccagaatggtcactggagaaaatgtgtaaaccaactgcaaacaagtttatccgttgccacctttcttttcctttagtgacagttcaattcgttaacctgaaggagctactgtaccatcaagactagctcccagcccagggcttcagcataaagcagctgctcagttaattttggtggatcacgggcagaaacaagttacctttgggatgcagattctgaatagtctgccatgaaatgattaaatgaatgagagtgatgaggggctacttaattggactatgtaaaatggctccttaagcttcgtggacaattgagtaatttcagtttcctctcttcactcttgtttacttcctgctcttctagcatcaagtgttaggtattctgttctcttacaatgagaagattaaacagctgtagtttaaattaaagcattaatttggagtgttctgtggctacattaattatattttctactaagattaaattgcagatggatataagcagcaatatatgtttatccagggcaaaccagaattctgttaaccagccatccttggtgactttttatttatatataaaaacctttttaaactgaaataatgtaacttgatttttccccccagttaggtagaagaaaaaataattggatgcagaaaacagttgtatggagcgtatttgcataggtacaggacttgagtgacagaaaattccttttatttttttccccagtgggatttagcaaaaagcatgtgttgaaagtctcttgactaaatggatcataattaaagactttgggatttatttatgggtattttaattagaaacattaagttcactcagtggtccttgtgaaaacttttttctaactgcttattttatatcaagtaataaataaaatttctgtgggtatgaagatgagttttagggccgcctatttctctaggaccgcccccccgccccccgccgccgcttcagagagcttttctctttctttcacctattaaacttctgctctggacctcaaaaaaaaaaaaagagttttagctgtaaccacattgtaattcgtgctgaatatatgaatgctgctgttcactgaatagttaactggttatatcccttgttaatttgaagttttcttccttcgttttggaatgatagttataaggcaacatgcattttagaaaaatgcacttgtttgaacttctcagatctaatgtgactctgtgggactagatgttaagaaaccatatctttaactgaacatcatctatgatattccatctcataacatgttccatgagttttatggacaatttctaagaaatccaaagtagcatgcagttttatcaacctctctgcatccccttggcacaaggaataatttttctgttattgaggggcaaaacagaggggtaaaggcactcatacagttaaatgccagattaagtcaggcatccaagtcactctgctttgggttgattctctgagactcagctggctgacttcaaaaggacgaaatagatttcaacattggaaaagaatacagtatagaatatatgatgggtcttgttagctatctcttattttctaatccaaagagcctcctagttggaggaaaaacttgaactacataagtatatcagcaaattttcattatattttataattctttattgcattatacgtgaatatatttagcagtggtagtacgtcttggaaagtttaagaatttagacaaatatgctttttttttaaaaaaaaatagttgagttttaaatatgctgtttgggtccttatgagcatgtgggagatatataggagaaagagtttgttgctgatgttatagaatcaccaatgcagcattgcacttttgttcttttccattcattgttcttgcttacatggagcacttgcaaataggctggacgtctcagagttctgaacaatgcccttggctaaccgttagtcctaattgctgtgactaatgtgctgtgtgacctaaagacggtaacatacttaaccttggttttctcatctgtaaaatagaattgatgacctctaccaagccaaggatttcagtgaggcactcaaaaataaaaattaaaaaatacatttgggacaaacatgaaaaaaattactttttagacttaagcaatgcatttaaacctgacgaaaatgaaaggaattgaaattgtttagccacagaaaataaagaccaaggaccaatttaaacagttgaaaattatatgaagcagtgttttatggagagtagtaatgaactcttcttcaccttttttgaggctgtccaaagaagaaatgaagttagattattgcagaattacataagttagtaagcatggactgaccagttctttctaagacacatacttgagtatttattctcttcagttgcaatgaaggtgacagtgaatttgctgaatagctgtgtacatgtttccccaaagagaccactggaataaagttttgtttcttgagacagtttccattgcatttataagtcttgtcccttgaaggatgttttctggtaaacacctgtattctttttacattatatatcttcattaccgtacaagtttggttgtgagccattccaaagtctttagtatgctgtatgggtgtattctatactttataccttatttggaagtcataataatgtcaaaactatgcctagccatccccttccctgcagagtctcttttgctttgtccacttggtgtgtatattttttttttttttttttgagacagagttttactcgtcgcccaagccgcagtgcagtggcgcgatctcggctcgctgcaacttctgcctcccgggcccaagcgattctcctgccttagccccccaggtagctgagattaccggtgcccgccaccacgcccagctaatttttgtatttttagtagagacagggtttcaccatgttagccaggctggtctggaacgcctgacctcaaacggtccatccgcttcagcctcccaaagtgctgggattacaggcgtgagccaccgcgcccgtccatgtgtgtcttttttattttttgttttttgagacggagtctcgctctgtcgcccaggctggagtgcagtggtgcgatcttggctcactgcaagctccgcctcctgggttcacgccattctcctgcctcagcctcccgagtagctgggactgcaggcgcctgccaccacgttgtgtgtctttttaaaagatttccaggacttctttttcctttacaaatccaaaattgcagtagcttaataaataacaaatattttggttttatgattactgtcaaatagctcattagtaagagaaaaaaaaaaatgctgagccttaagaggggagaggaaaggcagtctttctgaagctgaatcctttgcctaaattgtcttagcaataaatcttgccacctattggtaaaaaggaagaactaaaactaaaaggtgtttgccgttctcacaggtagttagtagtgtgatcgaaatagaattctttcagcggtgcttttggataaggggcttggaaatatgtgatttgatatggaacttttccctgtgctttgaatttatcatggctcatctctaagtcataatagttttttgagtagaggaggtatgctgctctcatggtctctcttaaaattatattttttgagatagaattccattttaatagatcagtggattttaattggacacattttagaggcttgattgattttgaaaacatttttcttttttctttctttctgtctttctgcctttctttccaccacggctaactgcagtctgaacctcctgtgctcagttgatcctcccgcctcagcctcctgagtagctgggactacaggcgtgcgccaccatgcctggctaatttttctgtagagatggggtttcaccatgttgcctaggctggtctcaagtgatctgtctgcctcagcctcctaaagggctaaaattataggtgtgagccactgcacgtggccttttttttttttttttcttgagacagggtcttcctctgtcactcaggctggagtatagtggcatcaacatggctcactgtagccttgacatcttggggtcacctgatcctcctacctcagcctctggtgtagctgggactacaggctgaaaacatttttctaactctgttgttagtttgggctttccttcattccagcctctgaaatccattatttcctgcccaacgggacaggccagtggtgacgttggcctttggtgccagggcctgtttttccagatcatgggcaccatacaaagataactgccctaaacggcatcattgccccagagtcattgaatgtccttaaggtgcatttgataaaacaaaaacagttttttgttttgaaaattctcaagtatttccatactgggaaaatgttctttttttttttttgacagggtcttgctctgctgcccaggctggagtgcagtggcgggatctcaattcactgcaacctctgcatcctgggttcaagcaattctcctgcctcagctgggaccaccggcacatgccactaagcccggctaatttttgtatttttagtagagatggggttttgccatgttggccagactggtcttgaactcttgacctcaagagtgacccatctgcctcggcctccgagagtgctgggattacaggcatgagccaccatgcctggccaacaatgttctttttaatggtgttttccccactatctggatagatatatgaattcagttactaagatgacttagatttaaatataaaacactagcatagcagtttttgattcttaatattatcttaaatccacctcccctcattgtcctctgtatctaaacacccttcaattcttgagaaaattaagattaccaaagattagtaatctatttgtgattgtgtgtgttggtggacatcctaacaaatttatgaataaagccaatactgttttgttagtgtccttattttttctttacgtctgttcatatttggaattctaaggcactacccagataatcatttgataccctttgttggcatgacatgtttggtcaattgttttggcaaaattatttatccaccactgggaactaagcactgtaacaactaaagaaagaggtcatacaagggaaattggaagaactatatgttatttgtttcaatttttatgtagtacacctatatatgtgtgcaaaaaaaatgtaaactgttacaaagcaacatattgatgaatttaaatgagtagagcataataaaagcaaaaaccaaacagaagagtggttggagtgaggccataataaaccaagagatattttctgaaggaagtgaacatgtttgcattttccagcatactgctatggatgtcagcgttaggctaatacatagtattgcagcgtgattcaaaaaggtgagatagaggggaaataagatagcttcataaatattaccaaggaatttaagacatgagcattttatgtagggaggttgaaatgcattgttataatcaggctgtgtaatttccttctgtcaagacctacccatttaccagtaatgataccttctttctcttctatttttgtctcttcctttaggaaaaggaatatatgcttactcattatttaaaattcagagtcattttcctgttccagttggttttgttcctggaaccaccaaagaagagtagaattaggtgcatgtgaaacttttgtttctgctttttctactcaatcaacttttatccctttttaatttttactctctcaaccatcagttctatatcatggtatctcttcttggtctttttgtattatatttccataaaaccagatgtacggggttgttaaaatactgcctggacatattatctaccctgcactaagtggtcctatcacaaaatccagttaaacacacattgaagtatttaaattgtttcttttttaaataacatcatattgggcattggacttcttaactaaactatttctttcactaaatgacattggttaattcaacaagccattgtaggaattctgttaacccagtagcttctactactatgttactatggtaatgacttagcttcccataaagctgcatttaaataggtgtttatagtcaccaattaccaggtatttcaagtactctttgaaaggggcctgcttgtggtggggtggggggcgttaacatagatactttctcagtcacgtagccatttgaagtttttcaggtagaagacagttgatagactatttggtgagcaaatgaataactggatgaatacccatctgggaacccctaaagaactgaagatagttccctggccatcactgttcacagtcatctattatgtgcttactctatgccaagtgttgggctggattctggggtcaccaaagggaagagaaaattttcactgccttgagggtagctaaaaacttaatggagggaagctgagagcatgagcgagcgtgccaccccagctgggtgagcggcacaccttgggaacagctgggagacccccagtggtgtgtgtcttccttcgcccttagcacttgctcctctccagctcactgtgtttcttttctctctggggtctaaggagcttaggcttcactgcctgctcctcagattgtgggagcaggagcagagagtgggtgcctgccacgggacagggggtcctagagacaggccccagcatgggaaggcagtggaaacccatgcattgctctctggcattgccacacgtcttctgctgcctgccttccagccctttgcttttccccagctccgtcagctccttgcctctgacatcagtgatgaaagtcaggcgtggggggattagattatttccattggccttgatagacttagacatataatagaagctatgataagtgagttagttttccatgtttgtttactgaagtttatattaccctttatgtcaccaaaacatgcccgtttgcagtcattgccaatgtagtcatgcaaaatcacttgagtgaaatagactttggggatctaatctcaggacctaaccaccatttataaagcttttttggggaaaatgtgttctggatttcgcacagccagcttacaaatgagctttggaaacacaatccacatgtaagttggagacttcctattattagcattcagccctgcgaggagagcccttgctttgttagcaggcctatgtgtcctcagccctaagttcctaaaaccagcactacttgaggagcttgaattggtgctcttggagttctttagattagttatgagacttcagaacctgcttaccagcagtactgagctcaagaggaagcctaattcatatccttcagaagataattttaagagagtgtgtatgttttcgttttgtgaacaaaggaaagttaatctggtgctccgtgtctgttttgtaattccccaagggagaaggaaagggagggaaatgattgatttccagataggataaaaaccagtcagcacacaatgggttactgccaccgctttctgataaggatcctacttcaactatctgaagagattcttcaaggtggaggatacagtggttatattagttactctcacccttgttattatggaaggtaaaattcctggatcctagatttaattttaaaatagtaatttaataatgtctggtggaaacctcttaaaaaaaacactttgcagcacatctctggtagccctgtgcttgagatgacttttaggctgccagttcagaagatggaagatataaactgtgttgatgagttggtttttcagtggaccctgttaggttccttttttaaaaaaataataatttttataatgagtatgtcttcgtgagccctcacaacccttgaagtttttacttgtttggcagaactaagggcactgaacgtttgtaagccgttcactaacacttacaggaagggcataaaagggtgctcaagtcagtctgtaggtggtgggggcggggtggaaagaggggattcctgtaggcctggatgaatcagccactgatttctgatggtagccccagctgcaaaaaagtaggaagctttttttatggacagaactacaactcctttctttcaagtttttcagccttttcacacttttccattcttcagactttgcaagtttttaaacaaaatgtttgtatttccccaaaggaaatcacacagttgactgcattatgagagggaaaggagcaaactctgtctcatctgaggaggggctcagatcaggagttgtgtagggccctcacccggttgggggtggtggagccttggctgtgtgcaggagtgactgttcttggagatgttctggttggatcatgagtttgggcttggaaagcactgcctcaagttcatcagcaggaatgaggtagaattcactacttgctgtcttaagacctttctgtctgccaagtgtttgagcaatccctcacatctcccccttgaactaaagagcaacaactggtcaagagcccagcagggatgaaaaaggttggccccttgcatccttcatctgctgtttagactaagggccgcattgtagaccactctcggccatgctgtcctgaacccgaggatcagcagaattacaggcccaatttcaggcagacgtgagcttgcatctgatgacaggcaagtacctacatgtgtctttcattactccgctgccttaggagatgctgtttaagttggcagatatgcttatttgaaagcaaagcttgttgctggtgagattactgaatttacaaaaaaaaaaaagtggggggatcagatgccaagggagagggaagggagtgtgtagcatttaaaagtgtggtgaagccatcaagttaacaagaaaaagtagaataaaatgtggttccaatttgttgtactgggctcaagatgataatattgcaatagtaaactgtagggatgtgtgcgtgcaaatgtgattacatgtgtgcttgctttctgaatttcaaaattgtagaagttattagaagttctaattttagttcccaatttaatttactctgatagtaaattagtaattttcaagggatttactgataatcagaacaaagatttgcaatttctaggacagatccccaattttgggggtgggaaggagctactttgtatttccctgaaaccttgagttactggggccgaacatgtagggcagatattgaatgaccaatcctaatgctcttagcaactttgctaagtaaaaccccgctgccatccagtggcaattggctatacggcatggtagctgtaaaatatgcccttttctgccttttctccctcagattccacctttctcagatgctcccagttttttttcccagatggcacctgacacagtacttgacaggaaaaattgactttatgtctggcttaggtaattcagggcaagtgtgcatttatttaccttgtctcttctcctagcaatactaatttttatctacgttgcatttttattttctccccagatttgtcataacacacatactttttccttgaatatttttgttaccttagctaaagaattaatgcattgtggtatttctgcttgtcatagttttactttagagtagatttcgcttatatctttgtatttatgctttgagctgtggtttaccaatttcctagcatgtttcatgacacttatcctacatttcagacaaggatttatgtgtcccataggattcaagctggacttggagaaagagccagctagcaaatggaattattctgacttgtgaaaggttccagccttttaaaactaggctctgagaaataaaaaaacaaatattcttgggaagaaactgggtttgtgagtacttggctagaaattttaggaaaggaaagaacatttcctctggcctcgggagcacattcaatgtgaaatattgctgcctttaaaagagccaaacttaaatttctatttggatcatttacttgacttaaaaataaagggatctatttttttttaaggttcagaaccctattttaaataaaatgacattctagtaagtcaggcaagatgcccccaacatgagctattaattaaaaacagccggaacttctggaggtgttagcaagtatctactatgagcttggggattggcgaaatctggtacaagttagttccagctgcgcacatttgccttattacagttctttatgataaattaaatgcatgcttcatacatcctttggtgtagtcatattctctcagcacttgactaagcaggtggaaagcttatttagtcataggatgactgaaaacaatgaactataaacccatgtatatccactccaagaaaagagctaataaatgtcatgttttttattttcccgtggaccccctttttttttttttttttgtattttataacctttccagaatcttgagtgatttttaaatgtttgccctttggtcataaatgcagcaagtaaatgtgagtctgcacactcgaatgttgtataaatcagttgaccagtcagtgttggagcaaacttctcaggattgctctgtgaactccctgttctctggcagttgccaaatacaaagataaaccaggagagacttattcccaagaaaagaatgattctgcatccttaacttacatataaactgttgagatgtttcattgttttgtatggtcaagccccttctcttgttctctctcttcatcaattagtatggaaaattggaagtttactgaaaagagtttcgaatcatgggattttagatttgaaaaggaccagagggatcatctactcttccaacaaataaaaaataaaacccccaaaggaatgaatgatccatggctgggacattggaatctctctataaaggagaaatcatattaaggtattttcatcttaggcctctaaccccaagggtatctttacaaagactttattttagtgaagccttcaataaacagtgacctcatgtcaagaattctaaagagagggttatggaatattggtttgatattaaagtcattgttatcttggagctggcctgaatggactaataagtggcctgtcaccagttgtaacttacttttacaattttaatgtgatttaagggaagacactcttggaaatgcttagttatggttcatacccataatcgtgtttcttttaggtcttaaaattttatataatacaggggagtagattgcatcagtacagtctttttctttttttcttttttttttttatgatgcaaacaaagcagtatcttaaattaaatcaaggtttcttaaggttccagattcttattcctaaattttccactgagtaacctccaaattcttctcctgcctttgtccctagttgacacaagtcaggccacaattttttttctgcaaatggacgagctgctgctcagaggctgcacttactggtgagagatccttcaagggaaatgaatctggaatggcctggaacatttgtctttgggttgctccagggctttattagagcttctgagatttctaagtaggtgatgaaatttagcagcatctgattttctaaaatgaccaaaggagaattgtttcagtccctgatttgcaaagtactcactttttggtcctctcaaaatttttgtcagataaagatttttccgtgccatggatataagaaataacccactcttaccgataaagggaagttagtgttgtaaaggaacaaatggtgattcaggtttgggagactttggaggtattcattctccactaagctatatcccaataccatcattatctgggtcagcctccgattcagcctcatcctgtgcttcagcagtggggtaaaacaaatgtcacttgttagctgcttcttcatgaccttcatagactatgcattaatttgaagccctgcccccaaaaatagtgcttgggggggaaatgagttagtgattttgtgaagataatgggagttgaggaaaacacttaagtttgcttttctgagctctagcttcattttacttctcagtctcagtatttaattgtctccactgttttttctaacttggaaggaaatcagatggcgaaagtgaaacatacggctatcaatgtgaaaaagctgctccctatagcactggaattctcttgtcattaatagctcttgtagtcgacagattataatatacagagtcataaatgttcttgttgtcatttggaaaattacaaattcccaaaaagtggtgattatttggggctttgggtctgcaagacgtttcacattaaaatgctgataatatcttcaaaaaccacagagccatgggccttgcaggcttggtaactgactgcctttgtggtgtggttttattctttctactgaagcacctggttgaaaggagtgggatgctgaattcataggggcgtgttcacaaaaatctttaacatcaagtatctgtttattcaaaatagtgcatagttcaaagcaaccttgattccttaaactagatgtttttctgttctttaatgaaaacagcctgaacgtggttattaatctgagtctttctccattctgaccaccccactctgtttttctctttgaatatcaaaaaaaaagtataaaaacattttgtaattttttatttatttatttttgttgagacggagtctcgctctgtcgcacagggtggagtgcaatggcgcagtctcggctcactgcaagctccacctctcaggttcacaccattctcctgcctcagccttccgagtagctgggactacaggtgcccgccaccacgcccagctaatctttttgtatttttagtagagacagggtttcaccgtgttcaccaggagggtctcgatctcctgaccttgtgatccgcccgcctcggcctcccaaagtgctgggattacaggtgtgagccaccgcacccagcaacattttgtaattttttaaagggctacataaattcaaggtattattgctgtacttcttttctgttaccttatgaagttgattgttgttgaagcaccaacagtatgcatacatgggtatccagaatgaccatctagtctcagttgtgcaaaattcactatgtagtctcatggattgagaggggcaattagcaagagtgtgagataatggagaacaaaaaataatgccaagctgggttaaaaaaaaaaaagtttgggaaagaaaaaacaagtgctcaagacaagcctcctatttttcagtttggcctagccctagccctattgaagaaggttagtacattcacctggccagttttagctaacttggttacctggcaagtggcggggatgcagtacattagtacttgtcctgtggtacagagcatgtgtctcagggtgtggccactccagggagagggaagacgtgctttatggggcctcctcagccatcactgtgatatgtgccaccaggaacccaggacctttcatggtccagtctgaggtgggagcaccacagaagcaagagctgcctggcccagccaagcccagattaccctaaaatcttactgcttttttcccttcagcattttaaattataggagcaagtaaaagtgtacataacgcaaggcaatctgaacaggtggctgatagctgctccatccagaggaagagccatgaagttcccccgacccacacatttcaccctgtcttgtctaccaaaaatcacatgaaaatgcagacataaccatggaggagtaacccatgaacaaagggctggtaattacagtttaatgctgttctttttacccctttggctggctggctgtgcaaaggcaggccccggtaattacggtttaatgttgttctttttacccctttggctggctggctgtgcaaaggcaggccccacaggggagtaatgtatttgtgacagccagttggggtggggagagatgggctgtactacactttgaatttattatgttctgctaatacttttactcctatgctggaaagttatgttttccttcctttgttagacaatttttgcagagtagtttaacattttcaaacatttactatatatagcacttttaaaatccaggaactgtcatttccaaagaagattccatgtctataatattaattccctgtcctctcctcattgcctttttcagacatccactgtagatagcctctgttccccaggaactaacatttccaaaggaaactcccttgcctataattccctgttatcttcttgttgcctctcctgaataataatttttgattcagtaccttttagctatttataatgttatcgtataatctgagtttgggaactgcttgccacttccagtttctgacacccaaaacacattttatgcttagagaaaacaatagcaccctgactttttagaagacatagttttcccttggggatccaaactggaagcagatatttgagctgtgaacacattttttcttagaagagtcaattaggagctgggttgaagcttcagtctatgcacttagagtcaggttttaggaccaagagcaagcactgtgggcacctgttgtaagaaaacatctgacagcacgaggtgctaaattgcttcaaaatcctccatagctcgtggggatgctacctttttagtaggagtttgaagcccagaatgcactttatattataaccaacacagttgaaaaataggttccatgttctataagaatggattcattaaactgcatgttctggaaaaaggatgtattagagactttgaatttgaggatcctgtgttatatacatctctgagccatcttatcaggaagaaaagcagctccttaaggtgcctgcctcttcctctaatactatgtacatatttcgacctctgccctctttaagttattttcatttgtcttgtagccagtatcagacatgttaatgaccactaactttgtaaatgaaattattgcagctcataatgtcaagatgtgaacctaagcaggccttaggttttctgacttaatagccgaaccataccagtctttccctgatcattgaaccttctgtcttctgcagtcagcagaccgtctctaatgagaggtgcacagacacttttgatgcttattttaagggaagccagtggcagatggagagccatcagatgaaactgttattaatcacaccatttctgaagctgttctgactccacaccctgcattgtgacaaacgccaggatgccaagttcctagtattgcagcaggttcttagtacataacaaacactatcagtgcccccagctcaacttcgactaaatgccttccaatagagttaagctgtttttatctaatacatgctaacagtaaaaggacacagaccctcttatttgaccctcttagcatctaaggaatatgatactttttttctttatacttagctgtgtattcaaagctaacacattctctaagtaaccaagttcacactaaagaaaaattgaaggccatcctctaaagccatgctgctcagtgcaggagccaccagccacatggtcaaagccacacagagccactgaaaggtggctgctataaattgagatgtgttatgagcataaaacaagagagaaatgaagactatctgcttaataatttttatattgattatatgttgattatattttggatatgtggggttaaataaaagattaaatttcaccttttgtttttgcttgtgatgtggctactagaaaatgtaaaattacatgtgtggcttacagcgagaccccactatttacagggcactgaaagtcattcttcctcttaattcctcatctaaactctactcattgactattttgtgtatctgcatcttttcttccaaaatgaatgatcagctgctagaaggcatgactatggaaacagtgtatcttctactgtgatttttcaagagtgaggaagtttggctatcaccatgggcgtgaggagaggggttctgttctcatttggtaaacatacaccagatatgctaaacatcccatagaatatcttagacaaagaaaattacagtaagtagagaaatggatcaaagagtggctattcttggactctctactttccaggtctttttggctagagaactctttttctaactttgttgcctggctcttggcagtcaatgtccaaagtagtgcattgagctgccccccaaaaggggcacagtttgtaaggaaaccatatgccctatgggacctcatgggatgacactcagttagtacataaggatctcttggaagggagctgcctttatgtcctctaaaccaggtcatctcttatcagttaaatcctggtgctgactagtacagctatatgagcctggacaaatcacttctgagcctgtttttcctctctgtacaatgacaatgatgatagaacctttcttataatgttatgaaagattatattttctgagataattttagtaaagcaacgtagcatagagcctgatacatgttaagtacgttgtgtatattggccatgattattattggcttcttggtaatgaaagcatcaaatactaagggcagcttttagtatattatttctgatcttgtgtgatcagaaataccacatttttgagaatgtattattttccaaagaattaaatgactctcagaggggaatggataaacccacagaggttctggaaatggagcagtttcctgtaagtatcatgacttccaattaagcccctttgtctgttttatccctgtcacttgtactcactgtgtagatcatgagctaattttgcttggactctcccctcccgccatctcttagagcccagcagtgctgtgcatgcatgggttaaaaatttcaaactgtccaaatgaattgcatttattggcaatttaatgctgaaactcaaagagggaaaagaggagaaaaaaaatcaaagatgaagtggaaagacaagggcccttggatgcagccggacagaggttgtaatatctgctctgccaaacactagttaagtgatcttggtgtagtcaccaaacctcttgagtctctttcccacatacaaaatgaggttgatgtgtttcacaaggctgttatcatgactcaaggaaataacctaaatgactagggcagtgacagttcacctctctctcttcatattgctctcaatttcatgatcttcttctccccgcaaccccatgatttatagaagccaaattacgttctctgatttatagctgttgtaactttggaatacatttaagaacatggaattagttgtcttttgttagatccacatacagaagtcacagaaatgttttcatcattttgaattttactgttcattctggcaaagtgaaaatgtataccaaaacactattttaaaccacctatcccctgggttagaaattataagttagtgtagcccagtgaagtataattaaatgttgccattctcccatttatttaacttccttccctccatatttgaagtaattttcgcttggtgccaactccagtcattctccagatgcctgtgatttcttccagattttcaacacacagtggctaaagataatatagaattattttttaagtaatttgtgattaaatgtaaatttagtaattttatgttgggacatgtgatctccttgacattttctccaaaacacagaatttaagcactagaaatgattttaggacatctagttaaaccattaccacttcactgttatgacagtgaggcctggagacattaaatgttttgcccaaagttaccaacatgttgttggcagaaaaatctggaacatatggcctcatctattgtctaaattttttctactagtgcacagtgccttttcaattgctttttatttgataatagtgacaatcataaataggggatttaatcaatactcttttaaaaaaaaaagtcacagaaagaaagcaattgtattgaaaacccctttctagtttttccagtaggttacattaaatggccccaaaaagtaatttatgggctaaaatgaatgtcttcagaaggctaacataaaagatgaccaacagggggaaacctgaaacagccttttaggtaatttgcttaacttctagcccttttaaaaaaattactcaagctcatgttagagccaacaaaaaacatctgttgttttatttatagccacaatttctaagaagcatattctatagcagatgaaaaagtagttgacagcttataattcataaagttactgaggcctaatctgatagaacaaaatgtacaaactccctcccgtggttcagaccctatcccttccctttctgctgaagacagaaatggtgcaacagaggagtggagcataggttattacggttgttaaggaagaggcgactctgagatgataatgcagaaaggagtaccccgcagtgataaatgattgctttcacctctgggccatccaccagcctgagtcactgctactttttcattaacattgtatggactttcattataggaagccaacattttgctgtgttcaatctacagattgttaacagcgtatttccatcaggaatctaaagtgttaattaaaacgactgattgaatagttccctctctgagggaagcttttagtttgccccttcctttcaccagttagctgtagtctatattgacataactttctccctgctgactcttaagcaattattagaattcactcattactcaaatatcacctctctgtatctgttggcttatttctgagaatctttttgagaacatgaccaggcttctttctataatttttatatatatatatatatacacacacgcacacacacacatacactacatatatatgtatgtagaatacatatatatatctatatatgtacatatatatctatatgtatacatatatctatatatgtatacatatagatacatagctatatagatacatatctaatgtatacatgtatacacatgtacctacatgtatacacatgtatctgcatgtatacacatgtatacacatgtagatgcatgtatacacatgtatacacatgtatctgcatgtatacacatgtagatacatgtatctgcatgtatacacatgtagatgcatgtagatgcatgtatacatatatacatgtagatgcatgtagatacatgtatacatatatacatgtagatgcatgtagatacatgtatacgtagatacatgtatacatgtagatacatgtagatacatgtatacatgtagatacatgtagatacatgtatacatgtagatacatgtagatacatgtatacatatatacatgtagatacatgtagatacatgtatacatatatacatgtagatacatgtagatacatgtatacatatatacatgtagatacatgtagatacatgtatacatatatacatgtagatacatgtagatacatgtatacatatatacatgtagatacatgtagatacatgtatacatatatacatgtagatacatgtatatagatacatacatagatatatagatacatagatacatatatatttatatatgtacatatatctacatatatatctatatatacatatatctacatatatatctatatatatatttctacatatatatctatatatgtagaaatatatatatattctacattttagttctgctatatctatagggccttctgtatatcacagttttgtgtgttgttgtttttttttaagtgcattggtttggcacaaataactatagtactatttattatcctgagcttttttgagaatgtagtgatagggttcaacatctgcccaaattgacccatctaaaattataattctaaaaccataaccagaagaagcccattaatttctttagtagagaggtgagtagcctcttgtttatttcactactgatcatagtctattgtgagatatgaagatgtattagcccaccagaattaatcacctttgtctgaagtagtgaaagtatattgcttcattttgttaaactctgattccttacacaattgttaaggattgtgtttacttttatctcaaaattgttaccttttaatatatatagtcttatatcagtgatcttttcaaacttttaaaatgaagtctgaataaatattattttcttatgcatttcttctgcaccagctgatagggaattttctgtacaatgttttcaggcctcttgcctttcttgcctttatttttctctgcaattccacacacaggtcattgctttcccttcctctccctttttgatcatggatgcttcaactcccttcatatatttgttaagcatattttactaagatttcattttgtgatgcttgcaaatatacattacaaaatatatatttttaaaaagtgatttgaagggccctctgtccatctgatgattaactagaagagtcttttgtaccttgctaaaagtgataagttagccagctatatttagctggataaaacccattacatccttggggaagaatgtgctttgtttagctttatgagaaaatatttaataaatgctgtcttgaaaatatttagcctggctgagtgagctggcaaggcttcaatactgataaagcagaggtgatggtgaaaagctggcctgccagtccaagctcaagttaaaaaaatgcacctcttgtcactaagggttgcaactgtcgccaagtgcttgtccatcagtgtcacgtaaagattttttaacctcacatatggcatcatgcagtttgtctgcctaaaaaggcaacctagattcacagagtggttacaattggctttgaagtcccatctgttctgtaaaatcctagctttatttcttactgctggtatgactttaggtaacttgtttaatttttcttaatctcagttttctcatctgtaaaatggggacagtgataatttcttagagcgttgtacagattaaatgagattaaacgctgagcagagtttcttacactaagtgttcactacatgggaattaatcagcagtagtagtgatttgtaatcagcctaacattttctgtccctccctaactcctcccaccccacaggagatacaaagagcaaagtcctcttgaatgtggcgaggtaggaaaggctctggcatgggcatcaggaggcctgggtcctcggcttgaacttcctgtgggaccttgggcaagttgtggctcacataatccctccccactcatcagtacacagtgcacagggcagcagagctcctggctgctagtctctcttttgatacctaattcgttgtggtatcagaccaaatttgatatgatagctagacccgccggtccgtcagtatcatttggggtctggtgtaagatcagcctgtgaaactcaggcatgtaggcaacaagttatcagtaagaaggtcaatcattgggattctgtctcccacaatggtctggattttctctctgtggctggtgggctcagccccaatccttgctactcaaagtgtgattgtggtccgaggaccggcagcatgggcatcacctgggagcctgttggaaatgcagaatcccagactgcaccccgacctcctgaatcaggctgttaatatgtacattaaagttggggaaccactgcctcaaactactgcccttgggaatattctgacacgcagagggtatttatttactaaatacttacagaatttgtgtttgacattgacattttctagacaaggttccattcctctctttgggtgtagtgtactgatgtgttaggtcagggttaccataacaaaacaccacagactggtgtttatgtctgtaccaccatagacatttagaaatctatttctcacagggtgccagtgtggttgggttctggtgagggccttctccctagcctccaggctgccaccttgtcactgtgatctcacatgggaagggtggggagaaaggtctctggtgctgcttcttataaaggcactaatcccatcgtgagagcacttgccctcatgacttcctgtaaactcagctgcctcccaaaggcccatctccaaatattatcacattgagggtcagggcgtcaacatgaatctggggggaagggacacaattcagtctgtagcaactgacttccacatctgactttaaaatgcatctttaaaaaaaatgtgctggcagataaatatgtaaataaagcaaatatgaaaatgttaatcgtagaatctaggtgaaagataatgtgggcgttcactaaacaattctttcaacttttcaggatatttaaaaatgtcagagaaaaaaccccctactctctatagttatttaaaaggaatctggtgctgcttttttctccttatttccatccaggctttcttaagagtgcttgttcggtctggctggacaaacttgcctttttggcagtttctctctctctacccactcactttctccttggtcagccagtggcctgcttctgcactgtcagtgaggtcccagcctggatccaaagcttctttctggtctctagtctgccagtagcatctttctgtccagttcctctccatccccctgccctctcctaatactaatcaggggatccttcaattgcttgtgacatcgcagcttctcaagttacattttacaactctgctttattatttttaagcatttctaacatgacattttataagtttgactctgaaatttatcatcacatgtaagtaggaaagaagtgtctccacaagtttgccctcagccagagatagtgtggttcatctggaatgcccctgcctttctctggttattaataggggctcctattgcttttccatttacagtgttaattatctgcatttcaaagtagttcataatgagagggaatatattaacttgttatttggggaggaagtacaaaaactgctattatcaagatcatttaacttgagcataatcagaaagtattaaggttattcccttgtgggattgaccatcagatatctgtgtgtttcataacacccttattgcagataccttttaaagaagggaggcttgcaggaagtgttgggaaacttactataagcttctttccttgactggcacttgtatactctggcgcagggaagacaagcccaaactaaatacataggcattacttaagagctttgtgacattggacaaatagtttccttgcctttaaactggggataatagagactatacacctttgaactgctatgaaaaataaatgaaaatatttctgtaaaatacttactgtgggaatgtggctcctagttgatgttcagtactaatcattcattcagcaaacagcctaccgcccactgtgtgtcatggcctgtgatttgtcttttttctttttgggggcttctgggtcatacttcgtatgaaatctttcttagcacaccgaaagaccaactttccttataaatcattggcttcaaaaatcctgtggactcaggtataaattatttttctggtgaggagaggaggaaatccctttcttccccatttacatcctgcctagctattttaatttgctgtacaccgtaaattgtaatcttagaatcaaactccaatttaggtgataaggatcacaattaattaggctagcctgtcaaagattaaatgtaatcttgcatttcagttacctcctaactctgaggctttagctaagcccgtcagaaacaaagctgttaggtctgcttaggtttaataagatctttgcctgctgtttgttttctataccagtctgttgtctagaaataaaacgaatggacagaggatctcaattccctttcatttgtttttagctgtgcagcaggagagataaatgagagaagataaacttaacgatattaaagactaattaggatatctgaggagatttgcaaacttctagtttaaatctgtcggcaactcttttaattccctcctgctagttatctctgaaaataatgtagttatggctgaagatttatttccacatctactctttgtactctcattttcagttgcgcatactttttttctccttcttcctccaaaaaaaaaagctcttgtttcggccacactcaatataatttagcacacagtcattccaacttcattttgtcttcacattcagaaaactgaagtctaatatctcaaatatattagtattgtggtccttttggggaaagtatgataaattgaaaatattttggttttgacttctgaagattttgagtattgtttatatatacaaaggcaaaatgcaaatatatacaaggcaaaatgcaaatgtgcttccagcttgcttccttagaaaagtattgagaacagtctaagtatgataatttctggtcttaaaacctgcaattgcaatcgggtatttccataatctaaacaataataaagattacatgactaattctaacaataataactacctattagtttgtgctttctacatactgggcacgatgcctgtcatgtttatatatatatattatttaatccttattactgcacataattactcccattttacagatgaataaatgggattcaagttaactaacttgcccaagactactgaattcagtaagtggcaaagcaaggattaaaacctaagcctctttggctttaaagctctgcttctaatcacttttttactactgattaaacagatgtgtcccaaaattaaggaagtcatcgttgttttttttgctttgtttttgcttagtcaaagagcacaggccatcatttgttgtagtgtcacccgtaaagcttaataagtttaaagttcagggtgttaatcattacaagcataaagtatgaatatgctttaaaggtttatttaagaaaagaattgggattagatttgcccaccagaatatacatttttcacttgaagtcctgagagagattcagacagaaacagctttgactcagcagcagttagcagacaaacatcttgatataatactgatccacactttgcatatacactttcttttctttgtattacatttttagaggtaagtggcagtttttcacacacttccaaactgcttccatcagtaatgaaatatttggcttgggcagcctctggagtcccagtgtttcagcttaaactttccagtgggccctgccaggcactaacttcaaaatatctttttttatggtgaatgcctccagaaggtgcaactgtgtggtggtttcattttgcacttcataacggtgttggcatcacttaatgcaaagaatgccactgtctcccacacaccgctggtgcccaaggactgtcgaggcctgtccatgttagtggtttgggaagggctgaagtttggagagaaggctctttttctattccatgtgattggctgtcaccagggcaaagggggaaaactagaacgagtggaaaatgcagcatcggatgtgtcatcaaatattcttcctacaacctgggacacctagttcattggtgttctggtcaacattgaaggctgaatcctcctttcttttgaaataatgcgtgtcttggattcactacttttaaacctttctgctgatctttatccttttcttcctaagcaatactgatttctttcaatgaaaaatgatttagctagtgaaaaactgggattgggttgtagtaaaggaatcaacaaatttgcccagattcttaagagtggagttggttctccacacttatacactgtgctacagcaagcttcacaaccaaaacccattacttattcaggtataaaaatcaaaagctgaactgtaatgagaatttaaatgtaaactgttggaggatggtgctctgttaatttgtgtttgctccataccccaccctatataattgataatatttgcatctttttgtttttagtactattattttttggtttatcaaactttgtaacatggtgctttattgtggacttttcaaagaacaccttgccaaatttggtaattcctagcaattgtcatttcctgttggaatttcttaaagtggaatctaatggaaaagtaattcttgaccttgtgtatttagtaaaattaaaggcatagttgattttaggattgtcataaaaattaatattttgttttaaaagactttttagactttcaatgctaattgatcctattgttggaagtagatgatataaactttaaagctttttgggtagaactttcacattcaccatgtctaaatattttaaagaggaaatggattgactcgcagacattttgtactaaggaatagaaaatctttgaattgctatttaaaaaaaaaaaaatccctgtaaaatttaccattttaaactccagttgcaaaatcctgatcagctatgatgattcatacatttgagcgataaagcttttttcaatattacaaattcagtggggagtcactcaatacattacaaaaagagtacttacacttcctagtacccatgtgtatttttttttctttttaaagcaatctggtgtgccttttgagaaaagttccagtgttctcacagatcctgacttggtgtagcacagtgcttttcagaaacttggtccaacacctgaatgagtaatgtgtaaaacatataatgttttgtagctcaggatactgcaggtaaactaacactttttgccgaaaaaacattgaaaagacaaaggaaagcaaggaagttttgcttttttaaaaaattttttcaagcttaatgaagaaagagctggaaatccttttgtatggagcatttgccagcccagcaatataacaacttttgggtgcatatttcaatcacaattagatgaaatctttaattatcatttaatttgactttcatatttgcctgcagaaatgattgtgttgataagactctggaatgagacaaacctttattaagtaattccattttcagagccaacattaaagttttttttaattaaaaaaatgcctgtgtaatttatgagaaaaggggaagaggaattggcatgttggttgcatgagagttgcatggatatgtatttactatttaatctttagctttttgagatttggggtgtgctaagtcttgttagtttgaggggcctaaggagtgacacaataatggatcttaataaataacacttttctacatcatttctctacctttatatttcccttctattatatatgctgacaggatgatatttcattgtattcagtgtagaaggtgtttgtgagagaggatacttttgtgagttgatattaaggcaaagggaagtggtttataatttatcagaggaaatgaaatggtgtgctctttcattttataatatttcttttaaaattttataatgcttttaattggactgtgaaacctttaagacatttgtatttgaagtgcttttcagatatatttacattttaacatacagggatttgagagatgtcattgctggattttttcataggatcacccacatgaattttcttatcaaaagagtatgtcctaaagcttatttctaaccccaaacaggttactagcccattcctggatgttccgattctgaagatttagggtggtacctgggaatcagtatttctagcacgtcctccaggtggtgcttagctctggcaagtgtgggagagaccagagagaggtgaagttcccacccagccctctgcacagtgactggaaagttaatggccagtcgtttgtgcttctatgaaacctaagatgtgttacagtgatgttgcagtaggacaaagtcactcaggaaatcgagtggtaaacattgcagggctttgagttcaaatattgattagctctatgttaagatgccttgtcttcagggatagctttagagtgggatctctaacacaaagctgactcgggaatctttcatctgccattgacaaaatttgcccttgtgcaggcaagtaagactatactctctaattttatgggcactagccacctatggttgtttccatttaaatcagttaaaataaaaaattcagttcttcactgggaatggctgcattttactcaataaccgctgtggctagtcattgctttatcagagagcacagctgtagaacatttccatcatcacagaaagctctaatagtgctactgtaggattttccctcataatatagctcttctctttttatcctgggtagttgcaatggctaatagaattaggtggaaagatcatgcatccatctatgtactgcacattgcatactgaaatctgaaagaatgtttttgcaaaatgacttaatcatacttctctgagatcaaaatttaataacattactttcataacgtgaatttgttctatgttgacttttagtacttgaaatacaggcttaattaaaaatttgttggccaggtgcagtggctcacacctgtaatcccagcattttgagagattgaggtgggtggattgcttgagtccatgagttcgagaccagcctgggcaatatggcaaaaccccgtctctactaaaaatatacaaaaaattagctgggagtgatgctgtgcactgtagtcgcagctactcaggaggctggggggggaggatcacatgaactcaggaagttgaggctgcagcgagccatgatcacgccactacactccagcctgggtgacagagcgagaccctgtctcaaaaaaaaaaaaaaaaaagaaaaaggaaatttgtttaccatagtatatggcttctaataaagagctatactggtaaaatctcacagaaacaaaattgcaaatatttagtctttctcagattatataaattattcctagaaaagactgcaagcaatgaggctaataaacaggttgtacttatattttcataatgactttaatttacctttattttgcagtttcacaaatttaagatgaatatatttagctccctcttctggcataatttgagaatttttttgcttacaatggtcttatttattttttttggactgagaataaggttatcaatgtaatgttgaagaatgttatttatgagtgtcatccagttagattttttggtatcattgtaaatggttaaaacgcatgcaaaaagtttacgaaaacaccacattttaaaaactactaattgaccaaaaaatacataaacaaaggctttgacaaagttatacagaaatttattttgatatcaagtgggcagtgatcattcatattggcttctggatctgagactcagcccatacctggcatttgtgaggcttggggcaagaatgcaaaaagaggcccaagtaccctgtgcctaagtatttttgttataaatcatgtcaactgttcaataaaatctgtcccatcctttctaggcagttatttcttcctaatgaccaggaggagagatctgaattcaggttcttgggctcctgagagttctgccctagagtgtggtattatggggagagctggatcctggttcatccctggcttctccctgcacatccaaactcccatccatcctgccactccccccacctttggggcccaggggtgtacctagacaggggggtttgtcctggggagggtggacctgggggaaaggccataagaggccatttagcaggaaatcctggagcattactctgagtagaccctaggtgagaagcagtgggcatatcactttggcctggaaagtgcaaaagcccagagcaggggttcttcttgctcgggcctgatgtaattaaattattttgtacgtccttcattgtggtctaatgcattcaactatccaaattaaatacaatggtgggattttgttgtttgcagctttgactctcccggatcttgcagagcagtttgcccctcctgacattgccccgcctcttcttatcaagctcgtggaagccattgaaaagaaaggtaaccagactgctagagggcatcagttcctttgttctacccttatttcatggctcttattatttgtctcttgtgcattcattaagtaaatttcctactaccagctatgtccagatactctgctggacactcaaactgtttggggctaagtactgggaaaaatgtctcagtctataatttctaactctagattatcatgtagtttccatatggaaactattaaattcttcataatttaataaatatgattaactttcttcttagaggccagatggttttgccaaaattatcaacatgccaggtaagattaatagtaggagttgacttccaagaatatttggtacacatctagaacagatactggatggaaactggaatgtctctggcagcagcctcacaggttctccagagagctgtgttttgcatacatggtctgtggtctgttttgtgtcctaggtctggaatgttcaactctatacagaacacagagctccagcaacctggcagaattacgacagcttcttgattgtggtgagtgtcacagagctagaaatgcaaatgggaaagacaggtcttggctttctgtttcaggtaatgcacacacacaaaattgaatttaatctatgcagtgttctaaatttaaagggaactcaaatcatgtacagttctccctgccctgttatggtaacagtgcaaacctttgaaatttttctcctgagttgggctgcaagtgtgtgcacgcctccctgcaggcatgttggtcatcatcatagccatcaggccctgggtcctgcagaggagagaaaccacctcttggtgtttctctcgctctgtgtatctaccatctttccttgaccctgaatttggctacatctaattcatctgaatcaattaaaaaatatttttaagcctatgtcacttaagaaatgtctcttctgacatcctttttcttttattacctttcccttccattttccttttccgtttccctttctttctggcttgccttctttctttttttgtgttgagtgcattaagtaacatcacgatattgttatgttcagtggtgtgctgataaaccaactctctaggaagaaaaaggccctggtttgtagcatctgcccatttttgtggcatgaatattcccaccggggcttatttcaagctaaccaacatgatgtcactggatgtggaattgggaagaattgaggacagtttgttaaataacactaattaatttagccaagagggctttagtaccccaaacacccactccctcctttggcatagatgaaaaactacaaatcaatttacttgccagcattccagcaagtcatcttcttataaatctttcaagatccttcattccctcataacgcttaaaaaaattatatactgcctcacatcattttaactgaaattaggtgtttaagccaaaaagagtgaaactcagttttggactccgtcagaggtataattgtacaaagaatgcccacatgacagtaaatgagaatttgaagcatgaggcagtttcaaaatgaggcaacttctgagacttttagaaaagaggtttttttggagaaaaggaggagactagacctttatcagtatcagtaaattcttacacttgaaatgttctgaccagatgtttcaaaagttaaaaaaatgtttaactccatttttcctttgtacatggaaatcagttgcatgcgaacagagcatatcctctttgctgctctgcctcctgcacttcccacagagcaggtcattagaagttaacatgcagaacactcaaggtgaaaaggcttgtttttcggtgtttctgacagctttatcagggctttaaggaaacgctgaattttgtccttagccaattgaaatgaagacacatgtttgggtcagaaaattggtcaaattatgaacacgtttagtcacaggaagagtttagacatcagagcccgatgaagtggaagttatttgagaaatagtggttaggtttataatgtgatcaacacaaaatgatgcagtttagttatttaaaaaaaaaaaaaaactcttcacaccactcgtgagatagagtcaacaaccaagattcacgtcaatggtacattttgaccaacaggtttccttccccagtgagatcaaaacacatagaaaactggtttcatttggagtctgtgctaaaaaaaagtgaaatttgtgccccaccccaaaaaatataaataaataaatgatgtccaaacttgggagtggatctgccagatctgtttccaactcaaagatttttcaatacataaaaacattgtataatatcctggaggaagctccaaaatagtcacttacacctaaaaaaaaaaattatggcttttaactaaccttgtgaattaccagtctttgaaaaggacagacatggcagacaatagcccacttttattagcacctgttatgctagttcatccatacattaactttgtgatgtatgtcctagtaactttaactcaccagaaaagaaagctgaccctcaggtaaataatttctttcacatttttcagtgccttagtggctaatttttctgactccaaaagtccttgatttttttctcttttttaattttgccctaaaatgaattgtttctttgtctcatgcaagttttaatgattcagattttcacctgacagtttttggtttcatttaacctaattcaggctttcttagccttggtactattgacattttaggctggataattctttgctggaagagtgggagcttgtcccgtgcattgtgggaagcttagccacatccctaacctctacccatgaggtgccagcagcattctcccccagttgtgacaatcagaaatgtctccagacattgccagatggctcatggcagagggcaggatcccactcccactgggaaccactaacctagggagagacctaaggaagaggagactccattccagggggagggagggaggagtgaagggttggagagtttactgggtacctgtcatgagtagactcagtgaaaagtgaggtaggagagaatgcaaacacctccaacccagacctaaagattatgtagctcttcaaaagtcatcgcatgacaggtaggaatagctaatggaagagcacgttaggccagtttcaatgcagaaaaggattcttagagagcagaagtcagataaatagaacagactttgtcactagctctagtagaatttgacataaggtaaggttacccaaagacctgcataggataattttattcatatactatgaaagttcttttgatatacctcatgtgttggaaaagggctttgatgaattaacttcacttgtggattgagccttctagttcaatccacaaacatttaacacgttgtatgtgctggacactgagggatgccagaagagcaggtgacagccacagtccctgcccttgacgtacctcggtctagtagggaaacacataatcccacactatgattatactccttgggaagtgtcttgttagaggggtggctcattagcactgcagaagcacagagggaaaccctgcctgagggagggatgtgtgcatatttattatcttaacgtttatactgcatcaccaaatgttttatcacatattttaggataagcaaattcggtaatattaattttccgggcagagagacattagatgaaacatgcggggcaaagtgtatgggaaaccagaagcacggccaagagtggtgaccatagagaattcctatagcagcacacacacaattttatttgacagtatttaattatgctcacaattgcattaccttcaacgtagatcctttatgcagaggatctactacagtggtattgcccctcccacacttgttaaacatgtgatatgtctctggttggttgtttgtaggacatttaagtgatttaacacttcgcctcttcaccttttaaatttaataattcttttcctcaagttgacctatccatatcctattccagacctacttttcttagagctgtgtggttgtgtgactcactttcggaacgtcggcctacctagtggggcaagtttggtttatgatgatatgtccaaggaatttttgtagtcttaggctcaacctagaatgatttgtactgtcatattccattcaaggttatctaggatactaccttctcccactcatttatactcaaacactttgcagtaaactttcatacttcctcattctctcctaggccacagcccaatgcagtcaatcaccgagttatatgaggtctcgataatattttgtacatttctaactgcattagaattcagacccccatcaccttgattcagagaactaaatctggtagttttacttctagcagcactcccttccaatttattcttaacactgtcattagtaaagctgttacaaacgtagtatcttgcccatcagcccacctttgctccactgagtacacaagtccccagattactttcctcaagttatccttcgcattgctagtgtacatccttcagcagcagccaaagtcctctccttttctagaggcccatggtcacccctgcccccagatctttgtttctagcatccctttcttctgctgggcattgtgtctttttccaacccaagtacttagagtgccatgcgtagtgagtgcctggagggtggtattgattagttttacccccattattggattgcttgacctgtttcccagctgagggatttactggacaggtatgctcatcttattttctgagattgtctgatatccacaggttagattagtaatactcagacagaattagggagaaacattctaaaaatgttcaaattattttcatggatattcttgagattggttgctaaaagtctgtagtatcttactgttgaatccatcactctgttggtgacatttacatgaattctgagacatatcaactcaagtcttaggaaatctgggaatatgcatttttaaatttttcctgttgaggttttaggaaacatttactatatgactaaccattcctagttagaacccttttcagtcagggcagaaccaccctcagaggatgttaggaaatgtttgggttctgtattcgtttgctcaggcagttataacaagttaccacagactgcgtggcttaaaacgcagaaacttggccaggcacagtggctcacacctgtaatcccagcactttgggaggctgaggcgggtggatcacgaggtcaggagtttgagaccagcctgaccaacatgatgaaaccctgtctctactaaaaatacaaaaattagccaggcgtggtggtacacacctgtaatcccacctactcaggaggctgaggcaggagaatcgcttgaacccgggaggtgaaggttgcagtgagccgagatcacaccagagatgcactccagccttggctacagagtgagactccatctcaaaaagcagaaacttacttctcgtggttctggaggctagaagtccgagaaaaaagcatgtttggtttcccctgaggcttctgtccttggcttgtagatggtcacctgctcactgcatcctcacagcgtttctcctctgtgcctgtgcatccctagtgtgtctctctctgtgtcctcatttcccctcctagaaggatatcagttacattggattagagtccactctaatggcctcattttaacttacatgcagtcactttctgaggcattaggagtttgggcttagaggggtgggacagaggatggggtaggtaaccactgaagatgcagcccaattcagcccataacaaaggcattattttttgttgccccaaagtgtggaggtctgctactggcatcatgggcagggggtcaggcatcctaagtgcttgcaatatgtcagagagacctccacaggaaaaattgttctaccccaaatgcccggagcaacccctacaagaagtacggctaacgaatactttgtgtcttgtatttatcctcatattgcttccttatttttttttttttttgtcacatgtgagtcaaattgttcagaaaattagcccaactgatgtattctataaaataaatgtctgaaatatttcttaaattgtttcctagatacaccctccgtggacttggaaatgatcgatgtgcacgttttggctgacgctttcaaacgctatctcctggacttaccaaatcctgtcattccagcagccgtttacagtgaaatgatttctttagctccaggtttgttttttctcttctgggaacctcattgaacatacatggagatgtagaggtgcttgtatatgtcttgcatatatagaaatagtggttagaaaatagtagtaataacctgtccctcccccaacaataccacctcaaatttcctcctccacccaagcatccaagagaagacccagattctcatttgcttgggaagcccgtctgcatgtcagaatcagaaatggctcattgttaacctattggtcttaacaaagtttgtacgtcaatgaaggacacggtcttccaagtactagtgtcagattcaaggaactgggactagaatccagtgatgggggatgttcttgtcatctttcctgagtggccataacagaatgtgttgagggaagatggctctcagttttaggagataaggttcagttaagtgctttggggacaggaaactggttcgtaaccttcaaagttaaaacctgtgatacttatctgatgctcctctgagttagccaatcacacttgaagctgctcaatactgggtaagttgctgccagcacaccctgaacagcttgtggtttctttacacactgagctttttgcatttccatttgacctgagatttctactttctcataatgcgttttctaatgagaaggacaaatgtactgtgtgcttctcccaacaactttttaaatgactcctatagcttgaagaaagagcagaacttttctaggtgtttattcactgatacctggaagtagtcgcttactcatttctctttttttttttttttaaacttgtagaagtacaaagctccgaagaatatattcagctattgaagaagcttattaggtcgcctagcatacctcatcagtattggcttacgcttcagtatttgttaaaacatttcttcaagctctctcaaacctccagcaaaaatctgttgaatgcaagagtactctctgaaattttcagccctatgcttttcagattctcagcagccaggtaagtgaaaggagacaaacatgtattttggggtgatgagggtagtcctaaatggattggtcatgaaaatgtattctgaatatactactccagagatgcatgtgcagatgctatcacacacattcacttgagtgtatataaatgaaaatgagtttgcttttagggaaaaggtttctaataaactctctttcttacagctctgataatactgaaaacctcataaaagttatagaaattttaatctcaactgaatggaatgaacgacagcctgcaccaggtaatgctttttgagcatttaacattctctcattgttcattttttagagccttaaaaaatgatggctataaacctcctttgaagtaacacagcttcttatggaattacagttggtagtaatatgttaccttgtgatttaaagaaaaaatagctgagtggtagtgtatatgttaattattatccgagtttcaacatttgtggattttaaattatcttggttttaggtgagagtttggagagttccctgtacccttcaacatttatgcttcaggttgttgaagagatttatggagttcattttagttgttgacatttttgtttttctttctaatacttacaaagtaggggatttataattactatataatttaaagtattttagaatgtgttttttggaagtgggtatgctgagaaatgcctgtcaaaataaacattttcaataatgcaagcagtatgaaaccagtgttccctgcagcaagttcgagcaagccagacacttctttgaaagcaggctgctgttcagttagccatttaacaaagcaggaaatgtagaccatgttagcaatgcatttaatttaaactgatgtatttttcttctaccgtggaaagtctaaacaacctcattttgctatataccagttaaaagttagctaatcgacactggtcatttagaatagtaattagggtactatacgtgtgaagtttcaggaccagtaaaaggtgttgcttgtagtcttaatttatgcctggaacttaaaatgaaactccatgaatatatttattataggtaatatatgcagattaccatatttatctctgtatgagcaggcatggggactcagtttcatcttcatgcaatggagagttaagttgtgctttttcttaattgggtattgcacagccaggcttggttacttgcatctggatggggcagcctaagagaggccagggcctagactcaaaacccacctgcagcaggtaggatagaggatagggtaggtaaacactgaagatgcgggtattgggaaaggtttatgtggacaggcccaaaatgtaccaaaggtgagagagaggtatccggtatagtagataaggcaagcatgggatgttccaaatcacagcaagcagaatgttttaacaggggtgcccagaattctaggtaaactacgtcaaagaagactgtcaacaggtagggactaggacttcagtccaggggttggccaaaaggcttcatctcgtgtgagtacacaggtcactgtgaatggatttgggagctctgtgctggtgttcagaggctgcctttggacttagtggaaaagaattggggtaggggtgtggcacatggcacttaagttgaggtttatgttagagactaggtagagctggaccctgctctcagtgaagggctagtgggtagtcctgatcttttcagtggccactcctctagagagaggagacacatggaagccaaagccagacagggtttgacagatacccacaaatgaatttatcacatggaattttggagaatttctactacacaaggtatagcagaatcagtggtagagtttgattagcctgactggtgtaaactagttaaacgcctttgttagtttcatcctaattccaccaaagtaaaaacgggtatctgcactattttcataatgccacccggaaagctgtttgatatgtcaaaggaccctacatttctctgctgagcaattggtgcgcctgtttcaaaggaggattagttccatcagctctgctaaaggatgacaaagccttgaacatttgctagatcatcccagtatttatgtggcctcttaaaaaaaattaaatccaagtcggttttaaactctagtttgagccgttttcccaggaagtttgtgtgatttgtataggacctttggaattaaatggctgttttagtgtctctcatgtgtgcatacattgtactgcccactccaggaacaaaacgtccccatccagaacatcttcgtattcaggaatggctccagtgcaaatgactgctatggcagcctgggttgaagaaatgattcttaggcctggtttaaaaaatgcaataatttcttagagtccttcagcattgccacagcatgtgctagtaccagacagaactttgaaagcacagcaccttacatctccagcgaatggccatttacagtaacattgttgtgaacacaaatgagtacctgaatgatgtttaagggagacaaaagcaagactctgttatagggcagatagacagcatttctaattattaccagatagaacttgaaatgacaaagcttatgatgtttgaggcaaagtatcagttcaaataagagccattagcacatagtatctaattaaatgctaggtgggagtacacatactctaagtacaaaaagaactttagaaatgcagctggtgactttctagggtaatggagtagacagaaaaggctcatagaagaaatagggcttgaaatgtgccttgaagaataggtacaatttgaataggcaaaggagaaatagcattttgatgcatggagtttaaagacttattcaaaataaattacacagtacaaaataatggcttggtattttacaaaagcagtacatattttaagtgatagtatcacaaaaaacatcattttagagttgaaagcattgtccagctttaccaatttggacatgaggaaaccgaggcccacagatagaggttcgctctgtgctacccggccagtatgggcccaaaccgggtctgcccaggagccgcctcctacactccagcccattctatctgccatgccctgctgcctggatttttggaaacttcgtgagcaatgaggctgcttttagtgtccaatcaaaaactcctctgaagtttccagcatgtaataaactaaaaatatgtgaaattagcccccatgggtcacatatagtaaacaaagtcagggcaatgtttatacttttcaggataaggctccaaatcactccatgagctgtgcagtggaaaaaaaagtgggcttctgactcaaatagatctggattggaatctcaactctctcgagtaactcagcttttccaaattgttttccagactgtggaattgggttaatgcctctctcctggggttggtatgagatttaatgaactgataatttctctgctatctatcgcatcaactctagcttttgaggccttatgggagctgtcctcattcagcaggtctgattccttcagtccacccattcctcattagttgtgtgaatcctgtcaggcctttttccttactgacgccatgttcccagccagcagagctacggcctctaggagcctgtaggggctaaaagggacacttgggaagttgccaccctgatgtgggtacattgcttggagggagaaaggtgcctttgtatgaatatgtggcttggtgaatggagcagcctagatttcatcaccactcctccatcttgcctaggtgcctttgcacagtgcacaaaatatgcaaccatacgtcgctgccccaagcagtgccatccactttatctgcactcaagtaggtccttcccgttttatatgcaagttaagtcgacccattcagtatgtttatgcctttaagcttcctgtcaccttatgtttaactgtctatagtttttcctattcatctgcttaattacatttctaaagggtaggggtaaaggctttttctccttttgagctcttcctagcagagaactaggtacagcataataattatctaaatttttctttgataaacttccaactttcaaagaatagtaatacatcaacacatctaatacatccagcaatcctgggaaataaggattctcctcatttacagagggaagctaagatttggaaaaggtagggcacagagtaagctctctagactttgttgatagtttgctgttctattttgttactaaaaagtcttaacttgtcgtttggctttcaatatttttttcttgaatcattgtgttatctttacccaattaatgcttaggcaggtaaagtagatttctgtaggcaaaccaaggtaaaaataagtctatttaacacagggtgcctttgaatgaaacccattataagtgtatttacatatttcagatttcatggatatattcagaaatattaatgtaatataattgaagtctaatattgcaccctcaagcccagagtggaaaataaatgactctttctaccccttgcccttctacacctgtcaaagttaatttttaaccactggcacattgcaaaacattcatcctgaagagcctgattcataaatcttgttttaaatgctctgggcttggttctcaacccagactaaaggcaagcactaaggtagagggaaatgacattcaaagagttttacttgtctctgatttaatttttattggtttaaaatgtggtctgacattagagggttgcttcaaaggtgaaaaatgaaactttgaaaaattacatgtttgtagatgcgtagaactaaacgggcaagccacactaggttttgtcaaacaatagttttatttgtgtcctgagagacacaggtattttggtatgtatgtgtttaggaggggtatatagtcagttttacttttgttttcacagtgcagatgtctctttgtctcaagggacaaagatctgagggagaattgcaggggggactactttattctgctaagcagtggggatgcctttatcagaaacctggtagaatgtgtcagagtttatacatacgtaaacctgggcttatttatatacttaaatggatgttttccttagcataatgtcagttaagaccagtggatatggagcaaataatttgaattaccctaaaaggccctctgttctaagttgtcttaagttaaaattatgaagagaggtattcattttacccttagatgaagattttggttaatttttgttgtctattctttttttcatggtctttgttcataaatgatgtccagaaaaagaagaagttttctaggttgaaagctgcttgtgcaacatttgccacttgatggtgacttgtacatatgaaatatagtattcagtttgtaacttttgaacagtttaaggatcaagagacattttcctaactatatctgctgagaagtgaaacaatgggctgtatttgcctctgaaatgagttttacgaaactttgaggaaagggagaatgatacatattgttttaaagaatccagaaggtaaagttagttttccagtgtgtctaggcctttgaggtcccagagaaatgctgacattaaaataaaagttttcctacaacactagcagcttcgtgaaaactgtacttttgatttactaattagtgagtcatatagatcaagtgacagtaatacaattatgtacattagttggtgtcaaatttggacatacgaaatatacagaaagttgatggttttctcccaaagcaggaattactgattcagttctaccagcagagggctcccttttttaagctaataaagaacatgtgtcttgcagatcactttttaaacactaaaattcaacgggaaaaagattcagctcacactttcctaatataataggacctctttggtagatgattgtacatattgtgagaaatttgtttaaggcaaagtttttccaatctatttcaagactttctatacgttgagagagtactgctttccagtggcttattttcttctgaaacagaaaatatactggtggacttaacagagcattttaatcttagaaggttttgacatgaaacatcatgtgaatccagacaggtatgcttaggagactgatgtttccaatgtttctagctttagaaaggctatttttaaaagtagggcaagattatgcagctcaggatgcaagggtattctctgaactaaccatatgtccctatgatcagatggcagattcacttatagactgttatttccattgggaaagtttttcaatattatatcagttgcactaaaggaaagtttgtaaaatcactttcattgtgggtttaacagcactttccagatatttcaagtaaccctgaagctagttgctgctgttggcctgtgtggactttatgtgaccactggatcactttcccatgcagagtatgagggtattattgaaagaacctatgtcttcaaagggaatgaaatgttttgttttaatttaagcaagctaaaaatagaaaacagaaaaaaccagagttttgttaggggtgtgaaattttttgcatgtggcttaaaagattaacttcagttttgtccatttttttttacgttctctagcaaagggaagtgaggagcagggacaatgggtagagaagggcatttgaaaccatcagaagattgggttctagtcttagggctataatcttctgtaaaccacttcacctccctgggtcagatttcgttttcccctctatggcatgcaggaattgattgaagtgaactctaaattactttctggtgtaaagtttggtgatttccctggataaccttaaagctatctatgctcatgcaactgaaaattttcttagatcaaattttaattaaatagtagtcagtaatcccaagtctggtccattgccactttctcaaataaagggcaaacatccgcttagaaaggtatgcccttctctgcccttctatcctttaccccattagctggcacataaacctaatgcagagacaccttttaattagcaggtcatatggccatttaaatgcgagttgcaatcgacctcataaaaatagccgcagtgttgttttattctgaatcgtcacatgatcatggagtatagtatgcatatggtgtggggtttaatattcgtccgaggatgccctcctactacttactattgaacatttttgtaatctcctccctgcccgagttgctcacaagggctttcctgttacacctgcagggctgtctgtgctggtgtgtgggaggaggtgcaagaggtggacacgagcgaggcgctgtgttctgggttgttccaagaggttcaggcctttacaagtgaggctttgattctattttttgctgaactagctcagccacttcctgtgtttggctgtgcatagtgcctcgcttcactgtcggctacttgagccccgcgagccagccagcgcgctcagcagccagtgagactattttaggtcccctcacaatggccttctcatttcccaggcgaaaatgagcaagttggtcttgcattggccacttgtcagccgatgacaactttgacttgggctcccctccccctcccgaaatccctagctcagcaaatatttgaacctgcccaagttaatcatgaagctgcgatctttatctaagggagacgtgcgagcgcctgggctcctttcctccccgatacagtagcgaaatccagttggcttctcaatgaggagccggcagtgagcggcggtggcccggacgcactgccgggcggggcgtggggcggagggacgagccgagccgagccaagcggagctgggccactgtgcacgcccggagggtcctggcggcgcccccgctcctgcgcgcactctcggcgccggacacgagcactgcctgccgggaacaggctggggggaggtgcgggggcttggcccacttggtggaagaacagctttggggattttttttttttcattgtcggatacaggcatttcaaagggaaaccgttgaaatgcataacctgcaaagtaagttgccttgaatttgtgcacttctctgttccttatctgagcggtgcctttctgtagtttgtcttggagtacgtgtgtgtgcgtgcgcccctgtaagcgctgcctggggaggacagatgggagattaggggagacactccccctgtcctcgagggggacagtggctgggaaagatagggtttaggttggaatttcagtaagaaggtactaattacaacgtgcttggttggaagttggtgccaggccagggcttggagagaccatgggaaaatcacctgtctccctgccttctccctgagttagtttgccacagaagatccaacagccagactggtttgcaccgacggttcccaaatgcatggactggcactctgggctgttacacccgccacagctgctcggagaacttgtctccttgcttcgggggagggtcgacattttaattaaactaaaaaagaatgtttttctgaatcttagggcatacagccacttttaccatttttatttgaatttgagttcaggtaaacttaggcaaatagaaaagtgggagagggtgggaagagacaaggtgagcctgcttttcccaatactgggaaaatgaattaaactagacgggggacgtcagagaacagaatgccttgcctttggtctgctttttaatatattttatgatcccaaattttacagaaagtctcaagggtttctgtgttttttaaatggtcaaatatgtgacatacatgtgtacatagatcacagagccccactgtagttttttaaatgagccacatttaccttggggaagagcccctccccccccgccatcataatattgtgaatgtaaagagagattggttcacaatgagaatgtacagtaggctcctataagggtgacaggattatatgcagaatgactttgaagagccaaaattgatttatttatgttaagtagtgctaagaaggaatatttgtcccggagtgaggcatttgagatagagggggaaaagcaaaaaaaaaaaaaaaaaaaaaaaaaaagtgattacatcatcttcccgttcaagcagtattagtagcgaagatgggttcatcagtgaaatattttgcaaagataaatatacctccactctgcattctgatctatagcctctttctttttggaagaagcattttctttgcccagtttttttaggcagtcacattaaaattctcattaataatgttgacagacaattacgtttattatttctgctaataggcatctgcattcctattcagaattttcattgttagtctataaagtctagttttaactttggaatgtttggtagaggaggacatctatacattttcttttaactgtcctttctaatgtggtacatttgtgacagtgtttgaattctgggttttcagtgaattatggaggactaaaataccaggagtagtccgtactgcttctcttatacatgagagatatctaaggactataaaacataacttaagtatacccttttaatgcctttgtaagatttttaaaccaaggaatgactgggctatctataaacccagatgcactaagtggggagaaaagctcggagctgcagcatatcagcttttgtcaacctgccaacagcagagcgtaccatgctgcaaggagtaataaacaaggaattagaaaactcgctgctggagaacagtcaaattaaacacctttttgaaaggatgagcatgtatatattgcagttctattaaatgtagcttcttagtgaggttggcattatgttaaggctggtatggaagagaactgatgaagcaggagtggtctggtgacatttttctgacttgattggctggggcgtgtgatgtaataggtttcagtgcagccccttataggttttaaaatgaattccaagacaccattacaaagaaagccggactcttttcttataactgagctcagccaaggaaactcttgcacaaatgtacaatactgtttggaatatggaagacctggatttagaatatgccaagacagatataaattgtggcacagacttgatgttttatatagaaatggacccaccaggtaatactgcagtattattgtagagagttagttaatttcgtggctttttaatttttcgaaagctactgtaaaagatcctttttggatttctgtttttattaatttgtttcattgataaaaattagtttgctcatggcttaaaaattaaacagattgtttgactgtctgtggaagcaagcagctcaggctgtgtgtggtaaatgcttattcttacttgaatggatatgaattgaactccagtttttcactggtgtcttttgttaatcgagatccttccctgggtgagttatgttgtgggatattgtccctgtaattaaaatgatgcatcttttgtgctgcttttctctgttgccagtggatgagaacagtgtagcactttgcagtgataacacttggtactttagaaagcatgtaaaatgtagcagtgattacaactcagttctctaaatgttgagactttgcttgctctctcatattaagatattataatgaaaaaagaagttgactttccattattgttagtctttgtaaaatattcttggtagatacctgaaatcattttttgtataagttaaaatagtaacagtgctttaaaacttatgacagaatttacctaaaaatcctagatttattttgtttcctaagtaagttgttttattccaatgttagctctccccctgcccccatttaaggtattcaggaatactgcagtcttttatttgtcaccaattggtatatatgaatactgatttgacattgaggaagggggatatcatttttaatcagacctagtatatagagcacaatttatccaacagaatattaacatattaaagagatttagggcacagatgagagtttcttaaagtggcttttggcagaacagtgcctgaaatactaagattagagaaacccaattgctcctcttaaaacatactgctgtagatgagcctttttattactgcaacagagtttgtggaggacagagaccaaatttgtctttcgtaattaaataagaggaaattaaagccaactcatgttattcctgctactcatatgttcatagtttcttactttagatggatttgaccaggcatgaaactttaatataactagaatctagaagtacagaatgtcatgactctggatttactttgaaatttattcacatggccagcccaatttatttgttagtttctaaggctctctctcttttctccttttcagtttcatttctttttgagccatgctctgaaagattttttttaagaaaattatcttccatattgcatggaattgtgaactaatgctatatatttcagttactctaactttttatttttttaaagtaaaagtattcatctaaagaaatttagttctaatgtagttgggattgcgaacaactttttctttttcatctgcagcactgcctcctaaaccaccaaaacctactactgtagccaacaacggtatgaataacaatatgtccttacaagatgctgaatggtactggggagatatctcgaggtaaggctacagaaacttcattttcagagagttttagattaaaagaaagaaaagcaccagcttgctaagttccatttttaggatatcatccaacataagcatgaagcatagttggttctcttccaaagacgaccagaaaaagtcactgagcactggagaactgtgggtgctggatgccacaggaaattaaatacccgggaagtttcattattgacagagatgtcagtgaagtgccagagtgaagtggcactgcctaagaacagagtgtgaaggcactctatctattaagcacaactctaagaattcttgccttaaacacaataagaaaacaatgccattttatgttagctttgggaagggggagtaaggttggagaaactcttttgagatcatgagtttctgtgctcatttgtcagagagattgtaatgtttggttgaaaaaataaaaacttagtaccacagatacaccaatagtgaaagtgatatgcacctgtttgtgatgagactgcaattgctaacatttctatttaaacaaattattagctcttattagtgagctctgaaaatgcaattcattaatttaaatctatgtgggcaggaggaatatgggcactcactgtactttccacttgattttgctgtgaacctaaaactgctctaaaaaatagcctattttaaaaaatataaatctgtggtcactaaaccttaagatgagcattgttttgtgttttcatttcagggaagaagtgaatgaaaaacttcgagatacagcagacgggacctttttggtacgagatgcgtctactaaaatgcatggtgattatactcttacactaaggtaagccagggaatatagctgaaattagggttttgggctgatattaaaacatatttccttattccaaaatgttaatacctttatttttatattgtttttacaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggtaataaaaactgaatgaattatccagttacgatgtttagacaagatccttttaatacttagaaaacatttgaagcagatgaattacatgtaatcaagtctaaaaaacttgacactcgtaattacataattgcaattttaaagatgtttccatgtcagctattttgttaaacaattgttatttgattaaataccttatccattgaatttattttaatctttctaggatcaagttgtcaaagaagataatattgaagctgtagggaaaaaattacatgaatataacactcagtttcaagaaaaaagtcgagaatatgatagattatatgaagaatatacccgcacatcccaggtgagttttctatgaaaatcagattaaaaaataagagttctaaacttttaaagactaacatggaaaaaagaatttaaaaggttgagtttttacgaatgaggtgggggtgagagcatttatttgtgaatcattgttgattattctagtgtaatatctctaaagctttaaaccaaaaattttaagtatcagaataataaattaagttcacgtgataactgaagcagtcactgagtttcaagttgatttaattcgtgatagaaggatcctgtttagattggaagttagtaataactggaagtttcacagacttgtctaatccctgaaatggagatttaggcattaatatatatcctaccatgaaaaggaagggctatatactgctgtgcttttctagacccttattcttcactggtcactcatgtatctgggaatgccagagggaacagaaaacaacagggatgctataaactacaatagcttttaagaagataaaaactataggaaattgctacgcaatcatttttcatagattgagaaaattctccagaggaaatacttgtttctgggatactgttttaatggattttatgaatttgagtcccactctgctaataatacagatcaaatgtcctggtagtgtcttgcagtaagagattgttctatgaaaggtatgacattatctttttaaaattatgttgcaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggttggtgtttcccttgttcttgtgctagagataaccaaaatcctctaaaaccatttaaagatgatctcgctttctgtgctttgaatgatcacgtggacacaggaaggggaatatcactctggggactgtggtggggtggggggaggagggagggatagcattgggagatatacctaatgctagatgacgagttagtgggtgcggcgcaccagcatggcacatgtatacatatgtaactaacctgcacaatgtgcacatgtaccctaaaacttaaagtataataaaaataaaaaaataaaataaaataaaatatgttgagccactccaaaaaaaaaaaaaaatgacaggaagagaagccacgctttacctaaggaaaactgctgggaaaccatagtgaaacttttcataaactttggggaccgttcctgatgtacccagataataacaaatacgtttcttttgcctgcaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtaagtatttgaaatggaatcctatacatgaataattggtgattgctacaattcaggatgagttaatgcgttctcttttcaaaactgtttttcaggtggttgactcaaaaaggtgttcggcaaaagaagttgaacgagtggttgggcaatgaaaacactgaagagtaagtagttactaaagatggtgatagcagaagatttttctcattttaggaaaatgcatgacttgctttgtttttagaacaagtgaggaattttactgagtttggaacatcttgtaggagaaaatgtataaactcagtgccattatccagaattttaaaaaaagaaagcttagctaaggaggactaggatttatttttactcataatgctgtgaaacaactctctgtgtccataatgatgtccctgaacatctgaaaaatcccaaaatatttttggaacagtcagagaaaaaataattatgcttaatatattttaaagcttaagtatatactttgtttgaattagtcaaaaactggcaatctgcctagtcaatttcctgatctaaactggataaacgagattgttttaataccttccactctgcccaggtacctgagtgtggttgcttgaaaacagaaatagtacagttgattggtaactctttgtcctgggaggttgcactggaggctgaataccaggagaggaaaactcaggtcgggcagaggcaggcatgtgatggccagtctgactggcttggtaggggccaggagggaagtgacgggggtatgcctagggaagacagcaaggcaggctgatggctcctgcactcttcatttagaaactttctgtcctgcctgcctagccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtgtatgtatctccagcaaacttttctttacaacatctcatgaagagatgtttcatttattcattcattgagttttgggggcaaagatttgacatagttttagtcttgaataagcttacagtacaataatgtagaagagaaaccaaagcagctgtaataccattttaaagtctagccagaagtgtatgttaatacagtctaatagatacctactgtttagttggaagactaggtttggattcccattcagtgctaattaatcatgagaaatcgccaagtctttttttctcatctttaaaatggaagtggcagtgcctgccttttttgcctctcaaggctactatagttagaatctgaggtaatttatgtgagaacatcacccataggaaaaatactcatcaggaacaggtgaaaaaaaaaaggattctgatcattatccttgagataggtacacccacattggatcactgacatcaccatttccaagaaattaatgtcctctagtagggaatggttctaaaagtatgttacactccatgatcacctttcatttaatgagagaaatagtcctacagcaaagaagggtacttttgtccttactgtgcataagggcacatgcagagatggagagttgtgcagacacctcaaggacagccagaaagaaggaatcctatgaatagtcataatgggagtaatagtaacactgctagtcatggagcactgcagatagttgtcctcatcatgattggaagctaccacttgttgcatgcttactgcatgtcaggcattctatctagcattttgcatgcatgatctcatttcatttctcaaagtaactgtattacatgtattttactattgtcttccctttaaaccattttaaagatgaaaatacagtcagtcagtgaagctgggttacctacccaaggcactcggccaggtgtcagttgtaacctaggaccctttccccaagttgagactgcacaataatgctttttattaaagatgccctgaagagttgtgaattgtcttggacaagctcaaaagacagtttttcttctctcctctctagggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaatggcttcagaattaaaactatgaaatattttacagtttttcttgtacagagtacttggctgttagcccaaggttaaaaagttcataacagattttttttggactgttttgttgggcagtgcctgataagcttcaaagctgctttattcaataaaaaaaagaaatgaaaaagatatatgaatatgacaaagtattgctgagtccaacaatgttgttttaagactcttaaaatacggtacctggcaatgtttatttcataaagaattgtgaacttcttgaatctagggagggggaatgtagtgaagggatgtatcaagtggggtggtgggagggggaggcaaggttatatgcactttctcatgatttacagagaagtgaataactgcaaagtgaagttgcttcttctacttcagtcttctctcactttgatttgctagttgttatcaattaatgacaattacaaacctactgtatctctaatacagtgtgactggtcaggtatttcagttcttaggaaggaagtgccaagtttgtttttgggttcctggaacagcgctcacctttgtttagaacactggtttaaagggataatcatctctgtcacattagactatccatcatgaccagcaaatactcattttaggaaaaaaaaaagcatgatctgaaaaatacttttggtggtatgttggttaccctcctagctttccatttggtttagaacataaagcaaatagacacagtcatactgtcactgctctggactgtgtggagctcgctaaagtcatggtcattgcaggaatccaagtggcagtccttctcattcattctaatcattgtatgtgcttcactacgggggggagaaggaaacgttagcatcatgtttcccatttagggcaggagtgagaggtctctcttcctgatttagatatgcaaaagctggtatgttcagtaggaactgtacatgtgttgggaggcataaagactaattagcaaccataatatggtcactaccctaatagactaaatgaaatcttgcaatttcaaattactctttctccatattagatttacccacagctatatttctgtttaagtactagggtgagggttttctgttactttgttttttaatgttgttccttttgaaagaatcagtcttgcagctgagtgaaaaatctgtggaatgtattatttgtcctctttacatgaaactactcatacttaagcaaaagtcagtcttatagcaagactgttagccctcaaacttgactctactgatctgaccatttccctctcatcgccagacaactgacgatttccctggttttagtctgcgtctctgctttaaagttattgtgatatccttctagatcatacacaagtctaacagttaattagttaacagtttttaaactaggtttgtgggtatttttttggtagcacatgtatgctattacatacaaatttttatttctaaaatataagatctgagattgaatattttcattaaaagctacagttttgtgaatctttgtgcttcaacattctttgcaagatgatacggtatttaggcatttgccttatttttgcatctcacaaacataagtgcaatagatcttttcattgaacagcaaagtaggattcatcattccatatgacttgagttacaccagacctgttctgcccaatgcctttttgattacagtgtagcttgcccaccgcatttgtcgttttagatactttgctagccggccactttggatttcatcagacagtcctaacaatattgtctgaacggctgaatatgaatagatacagcagaggcactcctgatatatgatttttatccatgcgtcagtttttcccacccagtgtagcatcctaaagataaagccagaagctaagctgcagtgaggctgtgattgggcgtagaagtgggagcattgggacctcacattacacacacgagagatcataaccatgtgaaaaggcaaaaagcatgtgtttgcaacatctgataacttcatggcctttgataaatgtatatatgtatatgtgcatggactgtgtttccagtacacctttcagccaaaacagatccacagtagttgttgagttcaagtacataaagtacataacaagcgaacgtctagtacaattcttacttatgtgtatgggatttttccctttgaggttgctttgttttgtcttacaaaggtgaaaattgtttgtaagtgaagtgagaagttcatatttctttggcttttttgtgtttttaaaagttactccttttagggagctggtctgatgacttgcttagcttggaaatccttgttttcagtgtgtcgagtcaaaatgtgtttatgtgagctgtcactgtggggaaccaattgctttgtcatatagctggttatgaactagtaacatgtttgggaagtcctactgatgttcctttggaagaaaaaatctgctggttttaacaactgtgcttttgctatgtatggtatccaagttagttgaaacgcagacactgagatctgtttgagtttagggtcatttttagaaaggggcagtttaaagcacaatgtctcacatgggacaaagttccaaaatgccaaattcttattttttaaaaagctagttctataaaatactggtattatgggtggggaggaaatagaattgagtcaattggaaagactatccaacttaacatgaaacttgtcaccatgagatagcattagctgcccaggatgctgctatatatatatatatatatatatatgtgtgtgtgtgtgtgtgtgtgtgtgtatatatatatatatatatatatatatatatatatatatatgtgtgtgtatatatatatatatgtgtatatatatatgtatatacatatatgtatatatatgcacatatatatatgtatttaaaaaaatcaaaacaaaaaaaaactcatttatacctgtgtattttttaaagctacaatctgttcaatgtttttaaaaatctgtttatatgacattgttaaaataaagttggtcttttgacgagagggaggatgtcacggtcagttgtaactttgccttcacaaggcaactggggtggggggtgggggtagtgtgcctccttgacatttcgttcaagttatagattcaatggagctatgtcttgttttaagttgctttaatgcattgtattagatcttcaaacagaataaaggttgttttgaaactgaa

SEQ ID NO: 61513 - DNA, 85634 bp, Homo sapiens
gcggagcgtgtgacgctgcggccgccgcggacctggggattaatgggaaaagttttggcaggagcgggagaattctgcggagcctgcgggacggcggcggtggcgccgtaggcagccgggacaggtcagtccgagacgagagaagcggtcaggcaagtggcggagggaagcgccgggcctgggccgaggcggccagcgggactggggcgcaaggcccggcggcggggaacggggtgcggggagctgccggggtccgcggacagcgtcacggcggcttcctgatgctccggcccgctccggtcagccgtcgtgcgttgccatgtaggcgccccgctgaccctgcgcccccccgcccttggacccccatagctgcttgagtgagtccgaaatacgggcctccttccaccctactctttgccccctcttgggcctggtggcttcgtcttctcccacttgtgagaaccccgtctcaggcccgggggcctctcccattcccctcccctgcctctgacctcttccttcacccgtttctggtgttcctgaatccactgccctatctagcgagagtcttctctgggatcttttcctctgtccccctcgttatccttgtctcctgccttcatcctcccatccttgctctctcaggctttactctctctccccatccctgtccccttcttatctgtggtctgatccctcctagtattatgggtccccatcctcttccccagggtgttcctaggctttttccaactccgtgcctgcagtccctgtctccctaagactctcaccttggttccctgagaggccctgtttttgctcctttttccgatttccttcgtatcaattctgtcccctacattcctgtcgcccacctccttttctctccctgttcctttcccctgcttcagggagaagccttagctccacactctactctactttcacttgacctgcagttgacataaccatggggtgggggtggaggtgttcagaccttgatcgaattaagaggctgattgactaaaggaaataacagattgtgtgggagaatgtacgtgggtgttgcatcagagatgatgtccaatttgtaggccattcttcttatctcagctttaatacttcccctttatggggctgttgacttccaggaacccttgggggagacggcgctgagctggatgtgtgccacgggtagccggaggctttgtccaattcttttccccttccaggaaccggggttttgtgtctttccactctggatgtgtggaatacacttataccatgataccccagcctctctctgccctcactcccaccctccaccctgtgctccatccgaaaggactaagagaattctccagaagctgtgctccagaaaatacttgtggtcctcaaccttttttctgtgtactggctccagaacttttttttttcccgtttgagttttgaaatagattgctggcctgatagccctggggctggcgggcatctgtccccttttattattggtggcttgaaacagctgctgattttctctcatatctctttgacaatctttggccaactgaatgtgcctctgatgttggtcactgaacatgttctcttggagtctcttctccctcttttttctttgttcttttctgaatctagggaatccaaattgtccctctttttccctgggagcttaatttcctctgtatccaggaggaacggcaatcccagagctctgttccctttgcccaggcatagtatgaggtatcagattgataactaccctggtgggctgtggggctgcagtagttagaccttgtcaggaacttgagcagacacatctgcttccagtcacatagatcatcttctctggggcttgagagcccaccaccttccatgtgtgtctggatgtttaaccttaccaagcagaagattctcgtcatatccttcagtttgagctcctttatttggcgttggttctctaaagaagtattcaagaaataacatatcctttgtttctacccagtctgatcttggaggattctgaaagcgtgacccactctcatgtttagaaatgaaggctcattgtttcacctggccccaggtttctaggggctcctcttttgatgattgtgctgtctttgagccagattggacatgggagttggcaacctttaggagctgcggtggagagccaaaggaaccagcttgaccagactttaaagttttgtaatcctcttgtacactgttttctgtgaaagcaataggattgtggatggcctgttgttgagccagtcccttctccactgacccccagaccccctttgcagcacttgcaaagatttgggtagactggaccagagggttttccttgttcctgtgaatagcatctctccagggttttagtggatcattctaaagaggtagaggtcaagtgttggacagatttttagtctagtctctggctttcaaggactcctccttactcttttgagcagtttgttacttctggccgtgcttaccccttagtagtgctctctgctgtggtggcaggtgagagatttgagaacaggtcaaggccagtccttgtggagcagcttgggcaccagcagccctagatggatagcttcttgcagtttgtccactctcattttctgagaaggtagtcatgattgtcaattaccaaattccttccccattcagtgatttttgcagagtctgggtctggattttctttccttctttcttttctgacacaaggttttgttctattgcccaggctggagtgcagtggtgctatcatagtgcactgtaacctcgaactcctgggctcaagggatcttcctgcttcagcctccagagtagcggggactacaggtgcacaccaccacactcagctaattaaaaaacaatttttttgtaaagacaggctctcacaatgtctcgaactcctggcctcaagcagtcctcctcaccttggcctctcagagcactgagattacactgactgctcgttcaggtgcctttctccttgcctcttcaccatggccttcttgtgtgatatatgccttaacccattcaggaagaattgctcctactcagcctttcaacccgacctgtggtcccttagacgccttcccttagggcctggtaagaggatagacagtgtagagcactagcctgggaagccattaggcctctgctttgggcctacagctgtcctgactgttgtgcaagctgtcttcagggcctgcagattctggcacatcctgggatagtgcagctcctctctctcaggagttggacctgtcacttttttttcgttttttttttttttttttttgagatggagtctcgctctgtcgcccaggctggagtgcagtggtgcgatcttggctcactgcaagctccatctcccaggttcacgccattcttctgcctcagcctcctgagtagctgggactacaggcgcccgccaccacgcctggctcatttttttttgtagttttagtagagacagggtttcaccgtgttagtcgagatggtctcgatttcctgacctcgtgatctgcccgcctcagcctcccaaagtgctgggattacaggcgtgagccaccacaaccagcctggacctgtcacttctaagggcttcagctatatcctgtccctgaggcccacctccctgagtgctctctgcaggctgggaagctgaacagtggtgccttgctccagtgcctctgaagggcttggaaattgcaggacacagctttactgctcagcattgcccacactggaaacattctcttcctccctacccaggtctctgtgggctttgtccgttctgccaggcccttgcttatatgatgtcagaagccctgtgcccggtgccattgtcaatgccatgtcccagattacctaatggctgcttcttggagatggtttggtgtccatgcacatttttctctgccgttggagccagggtgaggagctgcttgcaacagctggattccagggtgtcagaggagcccttggagcttgccttgagcctggcagggagaacatggccccttgcatcaggtttcagacatatgggtcttcttccttggcagatggctcctagccttcataactcagcaggctggtgattggcatgtgactccagttcattctgcaggggctttggtgaaggcatcaactatgactcaggacatcttcatttatgagcttctacccagctcccttcttaccttgcctgcgccttctgcgccgacctgataaaatcagcaaagccagtgtctgcttacttgggagtgagcagactccttccaggattggggaaatatttgctgactcaggctcagaatcacatctcagggtggtgtgtaagggaccgacgaggagccagattaccttaggaacactctttgagttacggtgggtataacttattagagttgctttgagggcccctggcacctgtcagctaaagctgttggggttttttctatcctgcagtgttgtacagtgttttgggcatgcacgtgatactcacacagtggcttctgctcaccaacagatgaagacagatgcaccaacgaggtaatcccattttctttactcaggggtctctgaccaccactgacacaggatccagatttaagatcctgaccttgaagatgaaataatttcactagggcttattcccagattccaggttcctgtcacagcatctggtaccagttgcttatgcatagtataggcatttattaagtaattattgaaagtctatggcttacatagttttttcaggagcatggagattcccacctttgcgcccattaaaagataaactccacagggcagggagttgttttgctgcctgttgtgtctaggatagtgcctggcacagaggagataatgaataaatttttgttgaatgagtaaatgaacgaactttcgtctttgcctatatgggtacctagggtgccaggccacaaagatggtgtccatcattctctcttattagggggcaaatatatatatatatatatattttgtttgtttgtttgtttttgagacgaagtcttgctcttgtcccccagactggagtgcaatggcgtgatcttggctcactgccacctccttctcctgggttcaagtgcttctcctgtctcagcctcccaagtagctgggattataggcacctgccaccacgcccggctaatttttgtatttttagtagagatggggtttcaccatgttggccaggctggtctggaactcctgacctcaggtgatccgcccgcctcagcctcccaaagtgctgggattacaggcgtgagccaccgcacctggccttttttttttttttttgagatggagtttcgctcttgttgtccaggctggagtgcaatgccgtgatctcggctcactgcaacctccgcctcttaggttcaagcgattctcctacctcagcctcctgagtagctgagattacaggcatgcgccaccacatctggctaaattttgtatttttagtagagacggggtttcaccatgttagccagactggtctcaaactcctgatgtcagatgatctacccgcctcagcctcccagagtgctgggattacagatgtgagccactgtgcccagccgggaacaaatatttttaagtgccaactatgtgccaggcacttgggaaatgataatagtaaaaaacagatccaatctctgcctcatgggtctgtggtttgctggtatatatgagagctggccataacacacagaattgtttcttccatctctgcaggggtaggaggttctcaccaagagtctgaacaatgctctgggttcccattgctgtttccatgttctcaggatgcctggcaggttttataaactctcagaagtggagctccagggaatacaatgttcattgtcctatttggaaggctgggttgttgtgggtccctgctgggggccggggaaacgtgggcctcctgcctgatttgttttaatctctgaagttcagtggttccagtagctgtttgtgggcttcacttccccttctctgcctttaacaccctgcaggttttcctgttgtcagacagggtggtgagtccctgtgtctctctgtctgtgggggtcaggttgtttgtagatctttcaggaaggtcctgggtggggggccctcctgctttcaaacccataccaagtgctttcctctgaagggaatgtgagggaggaagaaggggggagtttcagagacttctgaggttccccaagagggaagaggtcaaagtacctcctgagcggggagagctactgagttgaactgatttgctttgccatttgctttagcagcagccaggcccagtggcagcaattgtacgtgcatttccaggggtcagttgtccagttcatccctgagccttgagctcccagtcgcaggtaggaacttctcttctcctttctttttttttttttttttgagacggagtctcgctctgtcacccaggctggagtgcagtggcgcgatctaggctcactgcaagctctgcctcctgggttcacaccattctcctgcctaagcctcctgagtagctgggactacaggcgcccgccaccacgcccggctaattttttgtatttttagtagagacggggtttcaccgtgttagccaagatggtctcgatctcctgacctcgtgatccaccggcctcggcctcccaaagtgctgggattacaggcgtgagccaccgcgcccggcctcttctttctttcttgattgggtactgctatatcacctaggaccaggggtgtgtccaatcttttggcatccctgggccacattggaagaagaattattatcttgggctatacataaaatacactaacactaacaatagtgatgagctaaaaataaaaatggcaaaagaatctcatgttttaataaagtttacgtatttgcgttgggatgcattcagagctctcctgggctgcatgcagtcatgggccatgggttggataagcttggcctccctaggcagtcctctcaccacagcctcccaagtagctgggactacaggtgcacaccactgtgcctggctaagttttttttttgtttgtttttgtttttttttaatttaatgggtacatagtagtaggtgtatatttctttttttcttttcttttttgtttttttgagatggaatcttgctcttgtcacccaggctggagagcaatggcacaatcttggctccctgtaacctccacctcctgggttcaagcgattctcctgcctcagcctcccaagtagctcagattacaggcgcccgccaccacgcccagctaatttttgtatttttagtagagatggggttttgtcatgttggccaggctggtctcgaactcctgacctcaagtgatctgcctgcctcagcctcccaaaatgttgggattacaggcatgagctaccacacccggccttgtatgtcttcttttgagaaatgtctattaaaatcttttgcccatccttttattagattattcgtttttttcctatagagttgtttgagctcgttatatattcttgttattaaccccttgtgaaatgggtagtttgcaaatattttctctcattctgtgggttgtctcttcactttgttgattgtttcctttgctgtgcagaaactgtttaatgtgatgtgatcccatttgaccatttttgctttggttgcctgtgcttgcggggtattgctcaagaaatttttgcccagaccagtgtcctggagattttctcctgttttcttgtagtactttcatggtttgaagtctcagatttaagtctttattttgatttggtttttgtggatggcaagaggtaggggtctagtttcattcatctccatatgaatatccagttttccaagcaccatttattgaagagactgtcttttcctcagtgtatgttcttggcacctttgtcaaaagtgagttcactgtagatgtgtggatttgtttctgggttctctattctgttccattggtctatgtgtcttttttttttttttttttttttctctgagacagagttttgctctgttgcccaggatggagtgcagtggcgtggcgtgatgttggctcactgcagcctctgcctcccgtgttcgagcagttctcctgcctcagtctcccaagtagctgggattacaggcatgtgtcaccatgcctggctaattttttgtgtttttagtagagatggggtttcaccatgttggtcaggctggtcttgaactcctgacctcaggtgatctgcccacctcggtctcccaaagtgctgggattacaggcatgagccaccgcgcctgggcgaaagatggcttattttgaagtcaactttagaatattataaaacagcattctcaaactttttggcctcaagatccctttagattctttttttgtttgtttgtttgtttttgttttttgagacggagtctctctctgtcacccaggctggagtgcagtggcacaatctcggcttactgcaagccccgcctcccgggttcatgccattctcctgcctcagcctcccgagtagctgggactacaggtgcccgccaccacgcccagctaattttttgtgtttttagtagagacggggtttcaccatgttagccaggatggtctcaatctcctgacctcgtgattcacccgcgtcggcctcccaaagtgctgggattacagatgtgagccactgcgccagtccctttagattcttaaaaattattgaagaccccaagggcttatgtttaccatgttagaagttataataggccgggcgggtgacattcgttaatatcaccactgatctcatttttaaaaagtctttaagtattgggaagctgtcgggctcacagtggtcaatacacgttttctaaatttgagttttctcttgaaagtttgatttttatcattggtaacatactgttggttcttttgtttgattttgtctgagatagcatctccctcagtcacccaggctggagtgcagtggtgcagtcatagctcacttgcagcctccaacttctgggctcaagtaatcctcctgcctcagcgtccagagtagctaggactacaggtatgtgctaccatgcccagctcattttaaaattttttgtaaagatggtgtcttgtgatcttgctacatcgaccaggctggtcttgaattcctggcctcaagtgatccatctgcctcagcctcccaaattactgggattataggcatgagccaccacacccagccttttttttttttttttttttttttgatatggggtctcactcttgcccaggcttgagtgcggtggcacagtcttggctcactgtatctagccttgacttccaggctcaagtgatcctttcatctcagcctcccaagtagctaagactacatgcatgcaccatcatgcccacctcattttttaacttgttgtagagatcaggtctccctgtgttgtccaggctggtctcaaactcctgagctcgagccattcattcctgccttggcctcccaaagtgctgggattaaaggcatgagccactgtgcccagccagttcttttttgttttgttttgttttgttttgagatgaagtctcactctgtcacccaggctagagtgcagtggtgtgatctcggctcactgcaacctccgcctcgtgggttcaagtgattcttctgcctcagcctcccaagtagctgggaccacaggcgcgcaccccaatgcccggctaatttttgtatttttttagtagagatggggtttcaccatattggtcaggccggtctcgaactcctgacctcatgatctgcccacctcagcctcccagagtgctgggattacaggcgtgagccaccgcgcccggccacaaagaatatttaaaagacagatatcaaaggtggagattttaataaagttagtttttatttattcatctaggacattcttaaattggcattttattgtctttcatggttctgtggattaactgggcccagctgggtggttcttgcttgggatatgtcatgttgctatagtcaaatgaagacggggcaggtgtcatctgaaggctcagctgggctgggtgtccacgctggcttaggcacatgggtggcacttgatgctgttgaatggagtgcgtatacatgacctctctatgtgccttgggcttctcatagcatgagagctgggttctgagcagaagcattcccaaaatgaatgtattgagagattcagaaagaaatgtcaatgtttctcatgtcctagccttggaagttacacagtgccacttcctctattcccttggtctcaggaccagttcagattcaaggagaggactacacaagggtgtgaatactaagaggcgtgattcactgaggagagaaacaggcctccttggagaccagctactacttttcagcatccttatgtgaggtaatgtggtcttgatacttccaagagaaaagcacatcttctcatgattttcattcctggaagctactgttagttaggaaattcctaataggttgatggaggacattgaatgctaggtgaaggaatttgtactctgttctttgggcaatgggggagccatcagtggttttggagcaaggagtggtggtgttaatattgcaaaaaggtagattaggaatggagatagagaggataggtaggggactgcagtggtctaaatgtaaggaaattcttcttcacattaaatctgagttcctctggttgcaatttaagtgtattgattttgatatttcagccacacagattaagcacccagagccagggtggaataacccatccctaccccatatccatttagggctgttgatgcacaggagagattaagagttcacaaactttagaaggcaactaaatttaggttttattgtcaaagcacataaaaagttaagcataaattattcaaaaataaaaagcaagaaaggtgaaacttcatttaacaccactaaccatgtttcaaatacgcttcagtttcagtattatagaagcaaggagtggagccagaggaaggaatggggaggacaaattagagaatggtaggaagagggacaaaagtaggggaagaaaggagtcaggaggggcacacagcagaaagaatttgaaggaggtcagattggagcaactacttgaagctgagagaaggctccgtatggggctaacatgttagcaaagagctggtgccttctgtgtttccctgaggcactggcttctgggttttagcatctggtatcctcaccctttctttaatacagacagtccccaacttatgatggttcaactttacagtgatgtaaaagccatacacggctgggcgcatggctcacgcctgtaatctcagcactttgggaggccgaggtgggaggatcacgaggtcaggagattgagaccatcctggctaacacagtgaaaccctgtctctactaaaaatacaaaaaattagctgggcgtggtggtgggcgcctgtagtcccagctacttgggaggctgaggcaggagaatggcatgaacccgggaggcggagcttgcagtgagccgagtgcatgccactgcattccagcctgggcgacagagcgagactccgtctcaaaaaaaaaaaaaaaaaaaaaagcgatacacattcaacagaagccccatcctttagtactcatacaaccattcttttttttttttttttgagatggcgtctcactcttgcccaggctgcagtgcagtggtgtgatctcggctcacagcaacctctgcctcccgggttaaagtgattctcctgcctcagcctcctgagtagctgggattataggcgactgccaccaggcctggctaatttttgaatttttagtagagataggatttcacaatgttggccaggctggtttctaactcctgaccaggtgacctgcccacctcggcctcccaaagtgctggaattacaggcatgagccaccgtgccccggttctcatacgaccattctgttttttcactttcagtacagtattcaattacatgagatattcaaaattgtaacataagctctgtgttagatgatgttgcccgtaggctcatggaaatgttctggcacatttgcagtaggctatgctaagtaagttatggtgttcggcaggttacatatattacatgcgtttttgacttgtgacgttttcaacatatgatgggtttgtccttataagttgaggaacatttgtagccatttcatcgtctgtgaagaggcctgagtggattttgtgctggagaccggtgtgactcagctccagtgttgactgaccttctaaccatgggcttgtgactgaatgtcctgagccttcattttcttccctgtgaggattaaaatgaacctcaggaaatgctggcttgtcctctttctgtcaagctgggttctgagggggtgagcccaggtaggagtgacttctgaaccagcccagatttacaggcttgggcatagggagcccagcctcagcctgggagcctcatcttccattaaatagctcctggcattcaggggagtgcgttgcagcaccccatttttttttcattgaagtcctgtcttccagccaggcacagtgaatcacttgaggccacgagtttgagaccagcctagccatcatggggaaaccccatctatactaaaaatacaaaaattatctgggcacggtggcgcacacctgtagtcccagcacaccagagttcaagaccagcctgggcaacatggcgaaaccccgtctctacaaaaaatacaaaaattatccaggcgtggtggtacatgcctgtagttcctactccttggggggctgaggtaggagaatcactcaagccgaggaggttgaggctgcagtgagccatatttgtaccactgtactccagcctgggtgacagagtaaggccctgtctgtaaaaaaaaaaaaaaaaaaaaaaaaaagtgctttcttcttcttcttctttttttttttttttttttttttttttttttgagacggagtctcgctttgttgcccaggctggagtgcagtggcgtgatctcggctcactgcaagctccgcctcccaggttcgcgccgttctcctgcctcagcctcccgagtagctgggactacaggcgcccgccaccactcctggctaattttttgtatttttggtagagacagggtttcacggtgttagccaggatggtctcgatctcctgaccttgtgatccgcccgtctcagcctcccaaagtgctgggattacagtcatgagccacgatgcccgacctctttcttatataatttttttttttaatcgggcagccctcagaatcacagcagattcagaaagactccccagaaaagttctttcactcctaacttctacccagcctcatggtcacctcagcagctctcctgagaccgttactaagttctccacagctaatggtaactcagcttggaaagagttctcttgtaggaggatgctgaagggaggttgccaagtggtgtgggaaactgcttcatgcttaagttcacttccatatcatgatactaaaaggtatctaacagctgattttcattgctttcatttgtgatctgctaggaccacttgatccttatcactgcttttggcacactcctcatccaagagttgatcgcagaggcagagttccttgccaccagtccagtggaagtacaagccaactttgctctccaaatggcagcagtagctgagcaggccgccctgcattctctcctcataaacatgctgttctcaagtttgtcagaatccagagctctctactcattacccccttttccaaacaagcaagcaaagcatgctcttcctttgtttcccttaattgcctaaaacatctccatgctcatagctgttgactctctttgcctcctagttcctgttcctctggtgtaggatttctcagccctagcactgtaaacatgttgggctggataatcatctcttgtatgggctgtttgtgcattgtaggatgttgagcagcatccctggcttctacacactaagtgccagtgacactcttctcccctccccagctgtaaaacccaaatgtctgcggacattgccaaatgtctcctagggggcaaaatcacccctggttgagagtcactgctctatcatttattcactaaatactgctggtcagctgggtccactggcgaacctcacatcaataaacctggtaatagaagcatattgttcttacattagaagtttactctcttcagttatctcactgggcccttgagggctttggggaggagtgatgggaaatggtttacaattaacagcatattccaatgaagaaagaaagcatatgatgtctgcacaacagaggagagtgtccacaatgtacagctcttccctggagcagttatgtttctcagggtgtgcttttccaagtcattttgtgtctggttagaagccaccttcccttagcatccagaggtgccatgtagactagggttggtcacagtgtgtagattgccattgacctgcccattcctagtgtttgacctggtggtcatggcactctgaccacatcagttttcctctccaagcccagatgggttctcagaaccctccaccccaagctgcactcatgagaggcggcacttctgccatcctgatctagagcttgttcatgtggtccagaccatttctttgcagccccctctcctgtgtaaaagcctttaggaaagtgcagagatcctgatggattccccttgaccctcagcacgcacatcctggtatgtagtgctcagcactccgttgggggcttcagactggagaagagaaaactgcccttccctttcaaggacatcctccaagggccagaatgctcagttccgtaaaattaactctccactgcctacttttttttttttttttttaagacagtctcactctgtgccccaggctggagcgcagtggtgtgatcttggctcactgcaacctccgcctcccgggttcaagcaattctcctacctcagccttccaagtagctgggattacaggcatgcgccacctcacccagctaatttttgtatttttagtagagacgggatttcactatcttggccaggctggtctcaaactcctgacctctagtgatccacttgcctcggcctcccaaagtgctagtattacagtcatgagccaccatgcctggcctgctgcctatttaaatagcaagcagttacagttaaagaaagaccctggcctggggacgctgccaaggctcctaatctgacacttctttcatgtggaccagggatctgaactgtgtttcttccaaacttttggagcttgcttccttggtggtaagctaaatagtggcccccaaaatatacccctttataacccctgtaacctgtgaatattatatgacataatggactttgcacatgtaattaaattaaggatcttgagatgaggggattatcctagattatctgggtggacccctaaatgcaatcccaagtgtccttatgagtgggggccagagagagagattggacacaggagaaggaggcaatgtgactactgcagcaagatgctacactgctggctttggaggtggaagagaaggccaaaaatgcaacgaacgtagctttggaagctggaaaaggcaaggaaactgttttcccttagaacctctggaggaagtgtggccctgccaacacactgattttagcccagtgaaactaattttgaatttctgacctctagaactgtaagagaataaatgtgttttgttttaagtcgctaagtttgtggtaatgtggtaatttgttacagtgcagtaggaaactaatacagggctcatctgcctccaggtacaagtggtggcttggctgatccctgttcttattttaaggcgtccctctcatggcacaaggagagcataggcccagcattttcctgaaccagtatttgaaacaatctgcactttgggggaacctgttggggagttcttggaagcaagagagaaagcctcatatggtacccgatccttgctttggaactctcccagcaccttcagtgatatcatgaacaaagagttctttcagaccagtgaggatgtaggattattaaaatctgattctaattccatcttcccctctcctcttccatttattcaataaatgtttattgtgtacctcctatgtgctaggcactggggatgaagggataaacaaagcagataaaaaatctcctgctctcgtggtaactgaggtgggggaagtggagggagccagagttaagtcaacagcatgtgagatggcttcagatgctctctagaaaactaagcagaaaggagggtagtggcagttccacatagagggccggggaaggtctcaccacgaaggtgacatttaagtggaaagaggagagtgaactattgtgggaagaatctcgcaggcagagggaaagcaagttccaaggccctgcactgggacacagctgaggtgttcaacgcatagcgaggaggccagcgtggctggacagagggagggaggagaccaggagatgaagttagagacgagattggtggccctgaagtgccataacagcttttactttgcttggcattttgccccttctttctcctctcctccccctcacaccacctcacgagttttaggcccatgttcctcagttcctttccatgggatatttatcccatcatacttagggactaccagcaggcaaacatagtcacttaaaaatattagaagagggggaaaaagcagcctcctctttctgaatgatgaaagcagttccatggcagtgttggcatggcactgtgtatctagcagtgcaggctggccattcaccgcgtagttctgggtggtttctgagaggttcccctccatggccttcttcagcccatgaggaagtccaacccccctggcccgctgtttctttccatttcacccctcttggtctccccagtgggactcccacagctgacttctatccccacctgtgtctaatcccctttccatggctgagccggtagataacctagtaacgatctgagtagaatatggctcccacatgttgaatgcattgtgctgatcactacatatatcactttgattcacacaacaaccctgagaggtaggaaccattgtaccccttttagagatgaggatactgaggctcagactggttaggaaaattgcctaaagttgcacagctaatgaatggcagagctgggatttgaacccaagtgattaaagcccatgtctttgatcactacatagcagggccttctaggaaggatggctggctggatctagttgttccagtttggaaagtacctgcttgactggccagactgctgttggcttcagaaaatagcagtctcttgttggtcactgagaagaggcaaaattttggcaggccttggggcctcctgcagagtctcattccaggtcagtggacagaggaggccctgagaatagtcgtgcatactggctccctggatctgctccaagacagtgagcagcccctagaaccacaagagactggccagccaagctgtgggcccggcctgtagggtggaaggaactcttaagagaaaaaaaaaatctctgctgtgattaatcaacagcttcagtctggtgaagtgaaaagagaaaagttggcccagatgtgcacatagggagagaaataagggagggaaattgcctttattcatgttctcccttaggccagtcgttaccccacggatgagatcaccttccttttacaccagcctgcaagaggtgtgtagtggtagtctcattttacagacaaggtgtaggatcagagaggttaactcgcccaagtcaaacagctaacaagtggtggaattggaatttgagccctgttcttctcagttcagtagccctgctgttcttgctgatgtcacctcagcatgggctctccaggtatgtgcaaatagttatgcaagtgttgcatccacaggcttgtgagcagaggctgaaagggagccagggctcttggtacttgccctctcaacatgggccctgcctaagctagcaggactcactatacccaaaccagcagtggcattatatttttctcttttcttgcaccttgccatccccgatttatttttagagagccttttctatttctgttcccatttcttggcttggatgcaggggctggggtgcagggatggcgctagaaatcagaagaggcaggcatagatggcatctcactggtggccttggctggtctctgggaactgtgcccatctgcctgccctgctggctcctcctcaggccagctgtaggccccagggatcatagagctcgggtagctagaggctgggagggcaggcgagacagagaaacagccacacttctcatttctttggcttctcagagggggatgagcttcctcctggaacagagaagggagtagctcactgcctgtttctcagggttaggttacggacttctagggaatatggggtagtgcttaagagccagactctgtgtggcatgggggtgataactgtagaccctccacctctggggattaaatgagctcatacatgtaaaggcacagaggaggcactcactgaatgatgattgtttcattagtgtctttagaccctcagcacccagcaccataggtggatgccagtcattattggttagaccaaacagaacttcaaggcagctgggcatggtggctcacacctgtaataccagcactttgggaggccaaggtgggagggtcacctgaggtcaggcatttgagatcaacctgggcaacgtagtgagacccagtgtctatttatttaaaaaaataaaataataataaaaaaagaaaaataactttaatgttatttttgtcgtcctcttcatctgaacattggcctgcgtaggtattaacctgagtccagtgattgtttgtggagccccacagggtacttcccagtgacagcagcctggagtgtgctcctgccagcccctgcctgggccctggaaaaggcagggcagtgcagcgaggaatcttctggcctaaggatgcctgtaaccaccaaaccttatgtttagttttacaccttgctgagggtctggcttttggatatgagctctggagtggtaggggtctgtgtcccatggggacaggtggttctgggtgttgggcacgaggtgatggaggaagggcctgccacttgcaagctgtttatctgactagtaataaacagtggatgacacctttaggaaactgtatttgggagctttgaaattaatcagatgccaccaatggcatttttaatttagttaaaaatgttttagttatataaataatgctcattcgttatagatgattagaaaatacagataagcactgaggagaaaaaagtaatatattatcacacataagtggctgctttgatatatgatttttttttcttacctaggttcttttcaaattgtgtatacctagttattttttctgtctttcgaaatgggatgctgtttaacatttagttttgtgacttgcctttcccatttttcaggtggttttgtggtgtctgcttgtcctccgacctcctctcccatttgtgggaaaggcatttggcctggagggaggcacttgggaagaactgtctggttgttccttgatgttattgccagacttgcagagggtagagaggtgcatgaagtcttactctgcctctccccatctgtgtctctccctgtccctgtccagcgccccatctgctctgcctactcaccactcctgccttttttttttttccttccatacaaatccagaaaaggataccacctccagtctgaaggtttctttctatggcttttagggatgaatctctcaggagtttagaaaaaaagatgcacagacagtatataggaagggtaatgccagggctgggggtgggggtcttgggaagagcaactgagaggagggcctgggtccctggtgctgtcttgagtcagtgagaagaagctgcgtgggtgatgggttggggcggggtaggcagcaggtgactgcagggacctctctgaaacagcaagcaagctggccaggaagacgcctggagaataaggggcccagataggggccagacataggggagaagaaaatgtgtctcagtggcacctgctcctccaccctggccccactctttccatgatctttccagagattctctctttttctgcctgatctgcttccctcacctggcagtgcccagccccagtagtttgacacatctggtatatctggctactgtgctctactgacacctgtgtggcagcagctgcacagcttcttggcatctccctgggcagtaggcagggatccgagcatagaggaagatgttccatgcatcagtaactcagattccgttccagaaacgcatctcaaagcaagggagaaaattgaagatggggtattttgtggggaacaagctatgccttcctgtcacttcttacagaataaaatggggtctctggcagtaggcaaggagaaggcctttctgagcactgagggtcagtggcttctcaggtcttttctgggccactttggcctgcacacaggttgggctaggaattcatgcttaaaagcaggctgatttccataggctgtgcgttcctgtgggcctgcctggatcatatctgttctgctgtgatcccaggcctggtgagacccactggcttcctgtacgtcccctcaaagcctgcgccaccgcctctcccttcaccactcccaagctataattaagttcccatgtgaaactgtatccctcagctgacacacgcttgtaactacagccctggccattggacggctcatctggggtgacttctggggctggtgcctcagcctccagacgctctccagtaggtctgagtaggtggtgtggacccaccaggaaagggtggatccagtgaggcgggggccaggccttgcccaagagtcagaaagtgggaagtcacgggggagatgaagggcgagtgagcagctagaaagtgccaggggacacaaaaatgggggagacaggcagccttttggggctggagggcatggacagggtgactgatgcctgagccacaggcagaatgtgagcagtttattttattttatattctacatatttttatagcataaaattaagatatagttcacataaccaaattcaccactttaaagtgtgtactttgatggtttttgtatattaactgtgttttatatattatattaaattaatatatttatatattatattaacggttttatatattattttagctgtgttgtttatatattatattaactgtgttctattaaccactaattccaggacacttctatcacctaaaaaaccctttacctgtcagcagttactccatcccttggctgctaatctacttcccttctctatggctttccctatcctggacatttcatatgaatggaattatataatatgtagccttttgtgtctgaacaatttcacttagcatgttttcgaggttcatccatgttgtagcatataatagtactgtattcctttttgtggctgagtattccattgtgtgtatatattccattttatttattggtaaattggtggacatttgggttgtttccattttttgactgctgtgaacattcatgtacaagcttttgtgtggacatatgctttaggttctcttgggaatatacttagtgaaattgctgggtcatatagtattccatgtttaacttttttttttttttttttttgagacggcatcttgctctgttgcccaggctggagtgcagtggcacgatcttggctcactgcaacctgaacctccctggttcaagcaatttccctgcctcagccacctgagtagctgggattacaggtgcatgccaccacgcctggctaattttttttttgtatttttagtagagacgaggtttcaccgtgttggccagactggtctcaaactcctgacctcaggcaatctccccgccttggcctcccaagtgttactctttgttttttgtttgtttttttttttgagacggggtctcactctgtctggagtgcagtggcgcgatttcgcctcactgcaacctccacctcctgggttcaagtgattcttctgcctcagcctcccgagtagctgggactacaggcgcatgccaccatgcccagctaattttttgtatttttagtagagacggggtttcactgtgttagccaggatggtctcgatctcctgaccttgtgatccacccgcctcggcctcccaaagtggtgggattacaggcgtgagccaccgcgcccggccccaagtgttactcgttaggcagatacctgatacctgtctgctatactcactggtctgcaccttgcttcacttattatatcttggccatctttgcataccagacatgtagagcttccttattcttttttttttttttttttttgagatggagtctcgctctgtcacccaggctggagtgcagtggcgcgatctcagctcactgcaagctccacctcctggttcacaccattctcctgcctcagcctcccgagtagctgggaatacaggtgcttgccaccacacccagctaatttttgtgtgtgtgtgtatttttagtagagacagggtttcaccgtgttagccaggaaggtctcgatctcctgacctcatgatccgcccgcctcggcctcccaaagtcctgggattacaggtgtgagccaccacgcccagcccctcattcttttttttttaacagttggctcatccattgtatggatgtgccagtctcttcttttttttttttagacagatttttgctctgtcacccaggctggagtgcagtggcatgatctcggcttactgcaacctctgcctcctgggtcaagcgattctcccgcctcagcctcctgagtagctgggattacaggcatgtgccatcatgcccagctgatttttgtatttttagtagagacagggtttcactttgttggccaggctggtcctgaactcctgatctcaaatgatttgctcatctcggcctcccaaagtgctaggattacaggcgtgagtcaccatgcacggcctggatgtgccattctcttattcattgatgaatgtgcaggtgacttctagtcttttttggcaatgaataaccttgtcattttacacacagataaacagattgacaatgcttctgtgtgataggtgcagtaatggagatagacactggggaactagggaaggcttccagaggatagttaagaaaggctcagggtgagtgagcgctggtatctgagtgggccttgcaggcctggcagaatttcagcaggctgagatgttgtaggaagggcaaatatgactgaagaaaagaacaacagctcaggtgtgacaggggaaatgaagagtattagttatctattcctgcataacaaattaccccaaaacttagtagcttaaaacactatctcgcagtttctatgggttaggagagatttacacaaatatgtgaataccagaaggtgaggattgttgccagccattttagaaggctgactctaatagcaagttgcagtaaggataggattggccaaggcaacagatggagccatgattgtggacaatcttacatacttagctgagaggttgtcagagattgatctgagaacagtgtgagccatggaaggtctttgagcaggagaataatgtgatagttgctatacaggacaattaatctgatagcatttatgctagaggggtcaaaatggagagagatacacaggcagaggcctagattaggagatggctatagtagtacaggtgagaaattcctggcctgtagtactaaatacttttttttttttttaagacaatctcactctgtcacccaggctggagtgcagtggcatgatctcggctcactgcaacctctgcctcccgggttcaagcaattctagtgcctcagcctccttagtggctgtgactacaggcgtgtaccaccatgcctggctaatttttctatttttagtagaaatggggtttcacggtgttggccaggctggtcttgaactcctggcctcaagtaatccacccactttggcctcccaaagtgctgggattatgggcgtgagccgctgcatccggcctctgtattaaatactttagctgcatattctttcttcgaaatgaccacaaaaagaaggtattactgattaatatgcatatggtcttgcgtatggccagacttatgacttgcgtatggtcataaaggtagtaagttgcagagcagcactcagacctgcctggctttgatgaccgtgccttgatggcactggaagtggaaaggtgggggtgactggggaggtgaggttttgtccgttccctggatgctaaaaggaaatggaggagtgtaagaggttgattctttgaacctggatggctggggcaaagataacactgtaacaggaagaagagaggccggagggaacactgatgtgatgggagaaggtgagtgatttgggaacatggggcatttgttggcagggtccttcccaattatagggcgagtataaatagttcctgtgctttgtgtatgaagaggtacccttggcccaaaaagactctaaatgtggaaaaaggatatggtggtgtggtggtggtttgaacattgggtttgcgcagatagtgatggtaactggcactggcctgcgcttcagactttcacagcccgttcacttctgttgaaactcacacaaccctattcaggttatcatcattccctatctgattgatgaggaaactaaggctcagaaaaatccatttgctcaaggagaaacagtgtttcagttacctactgctgtgtaacaaatcacctgtgaaactcagtagtttaaaacaaccaccatttatcctttctcttgattgtgtgaattgggtccagatgcttggttctgccccacatgatgtcggccaagcttgcccatttgtctgtgtttagctgcactgtaatgtccaaggcagcttctctttgcatggcctctaatccttcaagagtctatcctgaacttcttgcagcatggcatctgggggccaagacagtggaagccagtcgtgttgaggcctgggctcacgtcccagaacatcacctcaatcatgttctattggtcagagctgtcactgggccagcccagattccaggttgggaactagacgccacctcttgatggaaagagtggcaaaaggtttgtagccatatttaatccacagacagccggtagtggatacctggatttgaacccagatctgtgtgactcagactcacagtctgtcatgccatactgcatccctttctgcttctggttccttgggagttgcaaagcttgctggctcttttgtgtggttggagagggctgatttttcttgtggtctcccacagtggaagttgtactagtcatcccccttttcacagatgagcatccaagatcactgtgtcttagggaaccttccaaaataggtttgctctagggatttgctagcttcccccaagcttcagcagtgatagccagacatgcatggaatttccctgtggagtttccctttctgcgcttagtggccttttgatgcacagtgctcactgggtgggattcctgctgcattgtagccagatgtggaggctagccctattttgagttatcccagatggtatccagcccagtgagtcccatacttgactcaactggcatattcaccagggagttttggggaaaatgtagattcctgggccttcctcatgcctattgaattagaattcccagggatggcgtccaggaacctgcctttaaagctccccattgatttgggagtacagcctggttgggaaaccaatgacttccagaggctggcaccctccctcagcccagtcatttcagaaagatgcctttgaagtcactgatcagaggaggccacatgggagagaatgatttgtccagagggcctcacacttcacaaccaggaagtgactcctgaaagtgtccaggaagtttctatttgaatctgctcaaatctttgatgttgttttgcatgctttgatagtatctgagctttatggtggcctctgggtgtttttctttgaaagtgtttgcagagagtagcaagctcttccagcagtcagcagacactccctaaccaggagctacttggtctgatttatttgaaatatgaaattcctttgcttggctgtctggttggtatctttggtgtgaagaatatgacaaccctagagatacctaggttagcacagcagttggacctttctagtcttgtgccttggacatacttaaggtacacttggaaaagtagattttaaaaccctggataatttggtttgccagttaaataaacttctatattttagaatatttggaaaataaagataaatataaggaagaccataaaattacctagaactttcctctcagagaatttccacggttaatgttttgaatggctattcatccttcccctcatgacccttcacaccccctctttttgaaaaccatattgaagtcatattgaatgttactttttagcagttttgttgagatgtaagtcataaagtccacctgttgacagtgtgcaatttgatggtttttagtatttacagagttgtacaaccatcaccacaatctagttttagaacattttcttagtcccaaaaagacatcttataatccattagcgtgcattcccgcctcgatgccccatcccgcccttactccagcccaagactaccactcatctgctttctctacgtacagatttacctgttctggacatttcatataaatgggatcatacaatatgtgatcttttgtgattggcttctgtcactggacataatcatggtactgttttgaaacctgctttaaacatttatatcctagcaatttgaatatagttttcaagaatgcacttttaatagcagagcggtattcattcttatgagaatatctaatcttatttaatcagtcctgccaacagacgtttaggttatttctcatcttttgctcttatagccagtgctctctgcactcagaaattattttgttgatttattggttaattgtccgaatctgtgactagaacaaaagctctttgagaacagtcaccttctctgtctcccctactacttggcatagttcctggcacttggtaggtattcagtttttaaaggatgtgtatgtgtgtatatgtgcaaattttgaatgaatcaaaatgtaaggatattaataaatgttgccatattgccaaattctagaaagttgtactaatttaccctctcactgcagtataagggtacctgactccctgttcctttgaatctgggttaatttgtacaggaagtcctgtgatcttttgaatgatgatattctctgacctgtcaaccagttagtttgggaattgatgctgtctgtgtcctgaccctgtctgtgggccaggaagggtctggctgttgggaaagatggtggtgtgtgggagctctagctgcccgggtcctcattgtggctccgtggtattgtatcgtttcctgttgcccttagaaaggctgcatcgtgttgtctggccacttcctctattgtgtgcaggcatgttggggagtgagtagagttgggtggataaagtatgtgtaagaagatactggttatggctgctgattggagtgccttttgaagtcgtcaggagagatgtcactctggaagttcagtgtcttcaaaaatagaaatgaagaaatgcttccaggaagtctgatgcaactggcccagtctgcccccatctgagggtggtgggcacccacatggctggtaaacgcttcatgagtcacccactggccacagtccctgctcctctccacacacttcctgtctggaaaagcctgctacccgcccatggtgaagagtcaccccagagaacttgccagggatgcagggcaggtcttcccaggtcacagcagcagcctctcgctcatgggtttcacagcagttcttctccccaagatgagttgtggtaactgctttttagataaatatgtggaatggatggttgggattggaaaaaaaaagagcggctagatggcaaggcagctcttgtgtgtagcagggagctcacacgagccccatggtggggcagttaaggccccagaattcaccttctccagcagctggctgctcattcttttcttcttctcgtggttttcccatcacatttcccttggggtttcttccaggccttcccctactcaccccacaccctctcagaagatgctgcctcatgtaacttggccaagctctcaagcattacagatgcctttaccttcttttctttgcatcttagaaatcactcacatgttggtctctctcacataattgctttttattattacttcagcggttgccaagtgcctactctatgcctagtaccttgttagactcgggaatgatgcagaagaaagagactggaccctgccccctaggagggtaaatgtctgttctcccatggcctctgtttcccttcctctctgactgcgcctttgctgccctggttcctcttcctctttccgctgcctgagtgtcaacattcttcaggcttctgccctctctcctctccctccacgcgcttgtcccttcctgtggctgtgaccatctgctcttatagctaccaaatactaaagttcttttctcctgaaaaccaggtccctgtgtccacctgcctgctggagtgtgcagccttaaaagcagagtccatctttgtctctgctctttgcatatcccctttctgttaataatccgtcattctctcagtttcccggagccttactgacagctttaaacctcattcctctgccatgcacaggtcgttcctcccgttcttttgagtgtttctccccactgattttcctgcctgtagtgagttggatggttgcccctccaaaagatatgtccaagtcctaacccctagaacctgtgaacatgaccaccttgtttggaaaaaaactcattgcagagattctttcctatgctgcagacgtacatgaacctgtgctcattgacctcctctctgggcctggccttgttggtctctggcttgaaatagtgactgtacttctagtccacacagtgattacatatttattactctgtttgagctcccctagtccaaaggcaaagttcactgcctgccctttccactaactcctaggtcagacttgctaggttgtgtgcacagcagctacaagtgtggtttctaaggtgggtctgggtttgaatcctggttctgtcatttattagccaagggcctttgacagattgtaacctttctgggcttcagtttcctcttctggaaaatggagctaatggattgttgtgagaattagattgcatagtgtctagcactgtgcctgacactctgagctttatttttatttatttttattttttgagacggagtctcgctctgttgcctaggctggagtggagtggcatgatctcggttcactgcaacctccacctcccaggttcaagccattctcctgcttcagcctcccgagtagctgggtttacaggctcccgccaccatgcccggcaagtttttgtattttttagtagagacggggtttcaccatgttggccaggttagtcttgaactcctgacctcaggtgatctgcccaccttggcttcccaaagtgctgggattacaggtgtgagccaccacgtccagcccactctgagctttataaccagagagatgctgtggctagccaaatcgctcaacctatacttggaggatcccaagcttggatgagtgtaagagctgtgacttaaatccagcctacttgtatgtcattctgccacagttgtctttgtctctccacagtttgtcctggagctgggcatggtgagggctaagacaatggattacagagctacaggtctaggagggcatgtggaattatgcctatatgagatagatgacaaagtgggtaagagcatgtgctctggagttagacctgggttcagattcaggctctatgaccctatctcagtgaccttgggaaacttttctttgcatctctgggtctcagttttctcatctgtaaattgggaataacaatggttcatacctgtcttagtctgtgctgctataacaaaattcctgagatgggtaatttataaacaaaagaaactgatttctcacagttctggaggctgggaagttcaagatcaaggcattggcagacttgatgtctggtgaaggctgctgtccacttccaagatggcaccttgttgctgtgtcctccagaggggatgaatgctgtgtccttacatggcagaagggtgaaagtggcccagctagttccctggagcccttttataagagcactaatccgttcctgagggcagagccttcatgacctaaacacctccaaaggccacacctcttaataccgttgtattggggattaagtttcaacatgaattttggagggttcacaacattcaaaccatagcaatgtcttatagagtaatcgggatgattaaatgaaagaatgcccataaaacattgaacacatgcctgactctttgtaaacaataattattaggtatcgctattatagagaccagcttctgctgtggagagtgttaagtgccttgatgccacaagccactggacacgcagctgcatggatcaatgtacccctgtaattatgtaacaaggggacatggagaaaaaaacatttccaatgttgcctcctctgtaacatgattgtacccctaaactgcacagaggagctttctgttctttgaactccatagctgttggtacgtctcttgtggggtttgccatagtctgtcttatactatgactgttcttcactctacggtacatttctttctttctttgtttctttctttcttttttttttttgagacaaagtctccttgtgtcatccaggctggagtgcagtggtgcaatctcagctcacagcagccctgacctccccaactcaagcaatcctcacacctcagcttcccaagatgctgggactgctggcatgtgccaccacacctggctaattttttttgtattttttgtagaaatgggatttcaccatgttgctcaggctggtcttgaacttctgggctcaagcagtccacccatctcagcctaccaaagtactgggattgcagtgtgagccaccacgcctggcctactgtatgtttcttgaggtcaagattgggcactgggtaactgattacttgaattgaaccttgggattcagccagtgaaagtggtccacctggcagtagtgaacctctggctcctgacctctgctgctggtgaatctgtttctcctatggctgcacagacacagggtttcctgcctccaaagagcttttccactctgtacatgggacctgaaccggctccagaaaccttggagcctggcaccacttttcacatcacccagcaggagcagaacttagatggaccaggcatagatgggaaacatgggtttattgctaaggtcatggttagttctcggcggtggggcgggggggtttagtgggcaattgctttttggatttttgttttgttttagaagtaaaaaatatgggccaggcgcggtggctcatgcctgtaatcccagcactttgggaggccgaggcgggcggatcacaaggtcaggagattgagaccatcctggctaacacggtgaaaccccatctctactaaaaaatataaaaaattagccgggcatggtggcaggcacctgtagtcccagctactcgggaggctgaggcaggagaatggcgtgaacccgggacacagagcttgcagtgagctgagatcgcgcccctgcactccagcctgggcgacagagcgagactctgtctcaaaaaaaaaaaaaaagaaaaggaaaaatatgtacatttttaatagtggtagtaagaattttctgtaactacttacgggacatcttcactgaggggtctccagagctcctaaaactcagcactcccccagtgattcttacattttcctgccagacttgctcttcttcccacaatccccaccttaatggaatcatccacatccccctggtcacctgacagttgccctctatttctttattctcctcagcctcttttaatcagccaccaagtcttgtttgtccttcctccctaatgtcactcctgttttttgccgtgaggtctgatggcactagtgctgcctggggttgctactgcctcatctcttcaacctttttgtgtcacgatgtttaggagtttctttcataaacagaatgtggctggatttaaatcaaatctgacaatctgtcttaagtaatttatgtacatttttgggatttaacttaacgtattactgtattatattttttagtactttccatgtatttccatttttgcctatttttctccttccgagtttttttttttttttttttttttttggagatggagtcttgctctgtcacccaggctggagtgcagtggtgtaatctcagctcagcgcaacctctgcctcccaggttcaagtgattctcctgcctcagcctcccaagtagctgggactacaggcacgtgccaccacacgcggctaatttgtatttttagtagagacagggtttcgccatgttggccaggctggtcttgaactcctgacctcaggtgatccacccacctcggcctcccaaagtgctgggattacaggcatgagccactgctcccggcccggaattttctttatttctatacattttacttccgttgtttttttcttttttgagacagggtctagctcttttgcctaggctgaagtgcagtggtgtgatcacagctcactgtagctttgacctcctgggctcaagcaatcctcccacctcagcctcctaagtagctgagattataggtgcacaccaccatgctcagataatttaaaaaaaaatgttttctagagatgggatgttactgtgttgcccaggctcgtcttgaactcctcactcaagccctcctcccaccttggcctccaaaagtgctgggattacaggtgtgagccaccttacctggcctttatttctgttcttactccaacattttctcatcttttctcccatccttttacttagaaaaatgttaaaattagaggaaatagtacaatgaacatgagtattctctttaatcttattcaattaatatatttctctgtatatgtatatatgcttttgtttggaatcatttgaaattaagtgtggatttgttctccatcttcttgctcaggatttggtgtgctgcttttatctgaggactcatttataaaagaaaaaacaaagaaaaagcctttttactttaaaatgattgtagataaacttagctttacacagagtttctgtattccttcacccagcttcccctaatgttaatctcttacatttaattctttcttaagttctggaaaatttcagccattgcctctttggctttctcgttttctctacagtggcctctggaatgcctcttagacatattgttgagcattttaccaccaaagtctctatatttgttctttctgtgttcctttatctgtttaatcatccaagttttcttgtgtagtttctttgagactgtcttatttctgattcttgggatgctacttctctttttgtgtctgaggcttgcccctcttggtggtttatttccttgtgtggtttgtaactttgggtgtgagttcatctccaggagggattctcttttctggctgagacttgggtcctgaattatgaaagtatacctcagagcagcttgtttgcctctggcggggccatgagtgtttcagtggtcctggctcagtttttgttcactgcttagtgcggcacccctttactaccctagtagtgtaagttcagttttatatccatgggcaggactagcttggtggcttaagaaagggtgacctcccgccgggcatggtggctcacacctgtaatcccagcactttgggaggccgaggcagggggatcatgaggtcaggagattgagaccatcctggctaacgcggtgaaaccccgtctctactaaaaatacaaaaaattagccgggtgaggtggtgggtgcctgtagtcccagctgctgggaaggctgaggcaggagaatggcatgaacccgggaggcagagcttgcagtgagctgagatcacgccactgcactgcagcccgggcgacagagtgagactctgtctcaaaaaaaaaaaaagaaagggtgacctcccacccatacctgacccacagagccttggagaagtgttcagcttcttgttgctttcctttactgggcagccctttgaggctctcttcttgatactggggctcaaagccacaggcaggctttaaaccgcttcatttgtgggtgcgaaagtccacaggccattgtggtgtcagttccactcactgtttatgtttcaattcttctcgcacataggcatttctctttccaatttggctgcatgtctacggacgtcatttgttttattttatctggtatttttctgtgatagtggtggaaaggggaagctctttcacgttaatttagtcccgtatcctactgaaagtttgttcaaatgcttagcgtgtcatatgaagcttttcatgatgcagcccattctacctctcctgcataaacttagctcttaaattttacacttcagcaaattgaactatttgcataccatgtactgtaatgtttaaaagcacaggttttagggtccagctgtttggcttggaacctgtcttttcataaggtatgattttggacaagttacttatcccttccataactcagctttctcatctgtaaaatggcagcgtccggcatgcagtaaccctgatccctgttggctgcctctgtggttgctgcccccagcagttgaggctgccaggcctctgcgcaattgcactgtttattcctttgctggaattgcctgtctcccctcctctccttgatccctcccaggagagcagcctttactccttcagagcttggggtctctgtctgtagtaactatcactctgtgggtcgctgcttgtttacgtatctttttttttttgagacagagtgttgctctgtcgccaggctggagtgcagtggtgcgatcttggctcacggcaacctctgccttctgggttcaggccattctcttgcctcagcctcccacgtagctgggactacaggcgtgcaccaccatgcccagctaatttttgtatttttagtagagacggggtttcaccctgttggccaggatggtctccatctcttgactttgtgatccgcccgcctcggcctcccaaagtgctgggattacaggcatgagctactgcgcctggccacgtatctccttttttcagccgactctgacccccttgagagcagggtcttgtttttcttggtacttgaaactccttacattctacctgtcatttggtgggcattcagtgttggtagtttaattgcattgaatttctctggctgagtagaggcaagtgctgggagtggtatgggacgcagaggcagggaatgacagcaggaaagcttgttttttggcacattttgtgccaagttgatggaaatgtgaatcagtatggctgggacacaaggtaacaattcttagtctagctgaggatgccagagacttaaaacaagccagtggccagaaaaagccactaaatcttgcaaattaaagtggtttccagacttaagaatgcatgccccacattcccttcccaaactcagcgtctctgagtgccaggtggaggaatacaaactaattataatcctagtgggccctgagaatctttaattttagaataaggctgcacttctgaaaggcgcagttgctttaggagtaggtgactctgtatgcccggggcctccgaggagaccaggatgtgaaaactcagtacctggcatttagagctgtgtcacccatcacttctgacctcgttaagatttctaccctactgcgacttaacaactaaaaagggcagatgagataggtccggggcagagcttaatggcctgtgtcattctcctcagctttgcctgaattctctggactcttgagactctatcataggaatattctcagaagagaaggcaatcgaacctttaaagatccccagattatccatcagataacagtctcatgagagtgatgaacaatgacagcaccaactctcaattcccttggctggaatttcaggaatcagcttgaactcagaggtgggcacagggttagggcttggagtaggcgtcttttctttctttttttttttttttttcttttttgagatagcgtctcactcttgttgcccaggctggagtgcaatggctcaatctctgctcactgcaacctacgcctcctggtttcaagcgattctcctgcctcagcctcccgagtagctggggttacaggcatccgccaccacgctcggctaatttttgtatttttagtagagatggggttttaccatgttgcccaggctagtctcgaactcctgaccttgtggtctgcccaccttagcctcccaaagtgctggtattacaggcatgagccaccgcgcctggcttgcagtaggcatctttgcccaacccacgtgaatcccattagttctttcttgacagctctcagtctgtggtcatatattaagcaactatgtgttcagtactgtgctgggtgctattgctgaagatacggaaatagtaatgccacaagtccctcttcttagagaggagagcttgcactctagttggagagaattcctagcacacagaaagctgcaaccagtggtgcccaacagtaatgctgtctgatgccactgcatgcaagtgtgtccctttgacaacttggtgcttttgcccaaaaggagctgttctctttctgaggcttggactattcgtttgttttttctcagatgacttgctggcactgttacagactggtctgaattaactaggactaccttttatctgtttctgaggaatagccccaaatgtgctctctcttggtctttatgaacttttcctttcttccatttctccaaattatgatagattaactttgcagtgtcatctgctaatctccaaggtcttctaggggcacgtcatcagcagttgctgcttttgaggtatcaaggtttgtcctgtggagtctcagatagtttctttacctgttcaatgaatctgattttccatttttctaggagagtgtatctcaaagtgattgctgaatcagaatgtctgggagtgtgacttggaatctattactgaagattagaggaaaatgtagcaaattgtgatctgaagcatttatggatggattgatggattgatggatagggattctgactgagttaggtagtctatagtctcagacagttgtggaagctccattaggtcatgagcaacccagactccttccaattctgtgccctgccattcttagggtgtggctgctgtcctcatggtccaaaatggttgccgtggttccacatctcacagtgagatagaagaagacagaagaatgatgtctcacctcccttctaaggagacttcagcaaagcctgcctctaccactttctgtgactgagggaaagttaattcatactcagagccaattaacctcgtgttttttttttttgtttgttttttttttttttttttttttttttttttgagacaaggtcttactttgtcgcccaggctgtagtgcagtagcacaatctcggctcactgcagcctcgacctttcgggctcaagcagggctcctccctgctcagcctcccgagtagctggaactacaggcacatgcaccacacccggctaatttttaaattttttcgtagagattgggggtcttgttatgttgcccaggttggtctggaactcctgggctcaagtgatcctcctgccctggcctcccaaagtgctgggattacaggagtgagccactgcacccaaccagttacctcatttgtaaaacaggcatggtaacacttagtgcaggagcaagaggatcagggagcacacatacatacaaagtgcttggtgctgatgcccagcctgcagcacctgttctctaaatcatagcagcaattgctgctgcagcacacttctctttctcctctctccaccgctccatctctccagggtctctaccttgcctgtcaggctccactttcctttgctcctgccttttgcatctgttcctctctgcattctcccctcatctcctctcttccgtgcacctcattttcctgctcccctcctgcctctgtccctcatcttcttttcagagacttaaaaccagccagtggccactggcttttcagtgtctcctcctcctccttgaactacctcttccttctagtgcttctgtccttccctcctcctgacctccagtgaacaataattatttgtaacgtaatgacaaattatcgttacgttacaaagaccagaggttagaggtggtgattggccttgtaaactgtaggtcagcgatgagtaatttaagaaaactaaatttaattggtttactcatgagtcagttaggaattctatttggcagctagaacagaaatagcagtggcttaaaccagtagaaattttttctattgtgaaaagaaatctagggggacagtctagggcttgtctctccgctctgccatccttagtgcagggcgtccaaccccaaggttgtatcatggtctaagatggctgcgggagccccaaccatcatgtcaggttctaggaagaaagcaggaagaagagaggaaaggcaaaaagaacacatgctccatcttaaggagctttcctgcaagtcccaccaaatagcttcagcttctcctccttgcctccattagttgcaagggaggctgagacatcatttagctgagcacattgctacctgaggtagaattgggattctgtcaccaagaaagaaggggagaatggatattgtgtaaacaattagcaaggtctgccgccattcattcaacattaatttagcacctacaatctactagttatgaagaacagtcaaggtgccccattccagagggaagacatagataagtaaacaagtacagtacacaggatgggtgaggaagagggggagagtggagaaaggcatgaagtgggtatcttacataccctccaagggcgcattctagagttcgtcatgcagacattcttgcctgtggtttgtttcctcttctgctctctcctttttgtcattgtcgccattgttgttgttggggtttgtttttgcccctccattctgacgtcagcagtagcccctagaaccttaggaaacagaaacagttggcctagtgggaagctctgggatgggagccatgtgtttgaagagccaagtcccagggccattaggcaattagaggcctgtggcaggagagcattcgttcctggacatgccgtggcactgccaggagactttactccaggaatggggtcgttgtcaggaggcatgttctaaccaggcacctggcatcacctatactgtgcttgccataaaatgaaattttggagcagtaaaattctccaggtcccgtgaaatgggtataattgtttcacccacattaatttaaccagaggtcttggtatgctatagtgttaattatgtgtaaaaatacttctacttactataaaatgtattgacagttagacattgatattccttcttagaactcaaaaattctaggaataacttgggagacccacattatctttcattttgatcccaagaacatctattgctgtttcctttgggaagttagagaggcaatgggaagcctgctgcagagattttctaaacaggcatatcccagcccctaaggagtttgaaagtgtcagagaaggctaaaggattaaaagatcgtttgttctggcacagtgcaatccttatgaggttgtactgtgaccctgggcaagttaccatcctatcctcagtttcttcatctgtcaaattttgatcctgtggaccctccccaacagggctgtgatggaaatgaagagacacatgggaagcattcagtatgtgttgttgttattatcatcattattgttatttttattattattagtgctactggtagtgctagcccactagcccactgggcagcgactgcacccgtatcagagtgtggaaagccttggatgccacattaaggagttggattttgtgggcaagggtgtgacaggtcatggctgggcttagaaatgtcactgacaggagtggagaggcagatctaggtgaggagtgggcagggcttgaacctggccagtcaaggaaaggggagaatggatacctgagtggtgagggaggacccactggtgctggagttcagcctgtgtgcccaagggatggtgtcccattgacttgggtgggaagcactagaggtggagcagttggggtggcaggaggggaaagaagcatatggtgatcagctcagcaaacaaatgggtaacttgcgcactcagtgctcggtggtgcccaggctggagtgcagtggcgtggtcccggctcgctacaacctccacctcccagccgcctgccttggcctcccaaagtgctgagattgcagcctctgcccggccgccaccccgtctgggaagtgaggagcgtctctgcttggccacccatcgtctgggatgtggggagcccctctgcctggctgcccagtctgggaggtgaggagcgtctccgaccggccgccatcccatctaggaggtgaggagcgcctctttccggccgccatcacatctaggaaggaggagcgtctctgcccggccgcccatcgtctgagatgtggggagcgcctctgccccgccgccccgtctgggatgtgaggagcacctctgcccggccacgaccccgtctgggaggtgaggagcatctctgccccgccgccccgtctgagaagtgaggagaccctctgcccggcaaccaccccgtctgagaagtgaggagaccctccacccggcagctgccccgtctgagaaatgaggagcctctccgcccggcagccaccccgtctgggaagtgaggagcgtctccgcccggcagccaccccgtccgggagggaggtggggggggtcagcccccccgccaggccagcagccccatccgggagggaggtgggggggtcagccccacgccccgccagccgccccgtcagggagggaggtgggggggtcagccccccgccaggccagccgccccgtccgggagggaggtcggggcgtcagcctcccgcccggccagccgccccgtccgggaggtgaggggcgcctctgcctggccacccctactgggaagtgaggagcccctctgcccggccagcggccccgtccgggagggaggtgggggggtcagccccccgcccggccagccgccccgtcagggagggaggtaggttcagccccccgccaggccagccgccccgtccgggagggaggtcggggcgtcagcctcccgcccggccagccgccccgtctgggaggtgaggggcgcctctgcctggctgcccctactgggaagtgaggagcccctctgccaggccagccgccccgtccgggagggaggtggcggggtcagccccccgcccggccagccgccccgtccgggagggaggtgggggggtcagccccccgcccggccagccgccccgtccgggaggtgaggggcgcctctgcccggccgcccctactgggaagtgaggagcccctctgcccggccagccgccccatccgggagggaggtgggggggtcaggccccgcccggccagccgccccgtccgggagggaggtgggggggtcagccccccgcctggccagccgccccgtctgggaggtgaggggcgcctctgcccggccgcccctactgggaagtgaggagcccctctgcccggccagccgccccatccgggagggaggtgggggggtcaggccccgcccggccagccgccccgtccgggagggaggtgggggggtcagccccccgcctggccagccgccccgtctgggaggtgaggggcgcctctgcctggccgcccctactgggaagtgaggagcccctctgccaggccagccgccccatccgggagggaggtgggggggtcagccccccgccgggccagccgccccgtccgggagggaggtgggaggggtcagccccccacccggccagccgccccgtccgggaggtgacgggcgcctctgcccggccgcccctactgggaagtgaggagcccctctgcccggccaccaccccgtctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgtactaagaaaacttctgccttgggatcctgttgatctgtgaccttacccccaaccctgtgctctctgaaacatgtgctgtgtccactcagggttaaacggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgtgagaaacacccaagaattatcaataaaaaataaataaatttaaaaaaaaaaaaaaaaaaaaacaaatgggtaacttgctgcctgccagggactcctgtggcctggcatgaagataattgactgtgttttgaacgcattataaggcccctgcgaggcctccgtgtggtatttagacagtcagcaggagagaggccccggacagtggtgtgggatgcagtcccggtgtgtgaaattgccagtggttggattgtgcagcggatggattgagcagggaagccagccaagaacagaatggggtggggagggcgttgggggtaggaaaggaggatcatcatttcaagggcgggtgagggaagaacaagcagcagagtgcaaagcccccagagggaagggcgatccttatgaggttggactgtgaccctgggcaagttaccctcctgtcctcgggaggaagtggttgacagaatcattgcagcagtgagatggaagcaggaccagggcagcagccaagggcctcttagatggcggggcgagaggaggtcatccaggacctccaagagaactgtttcaaaatgggaggagaaagcagtgttcctctggtggtggttctaatgctttgtatttgtagttcttagtcgttttcaaggccctttgcattctttgcatcgtgctctcttaccacgatgcatagtgagaccccacctctacaatttttttttttttttttttttttcagtgagccaggtgtggcagtacacacctgtagtcccagctacttgggaggctgaggtggaaggattgcttgagcccaggaggttgaggctgcagtgagctgtggtcatgccactgcattccaacctgggtgacagagcgagaccccatcttaaaaacaaacaaacaaacaaatacttggttcatttggtacttggctttttggatcttggggaatattggagatgacggaataacttcaaggagactaacttcaaggtcaagactcctgccaagactccaccagacataaaataggaaaatgatgatagaatctacctcactgttggcctggcagtgggagtttgttgataaccctgaagatgaactcctcaaggtgaagagcaaggcttcagaatgggctgctctatagatgtgagagacagagacagacctagccttgcaaaaaggttgctgtagtctttctcctaccatttccagcacaggatggtttctggtcccaggaggccctgtcttgtgctgtgtgggacccttagtgctgtgaagactagcagcaccctggaggtctttgttccttctgccctttcccttagattgcatctcctaaccttggtttatatatttgtcaggaggtgggggaaacctgctttcccccacctcctgacaaatatataaactggaaattgatccagtcctggatcagtttgggtcacacaacagggtcggcagtgttggcccacagagggccctgggccccttatttcccctttggccctaggctctgagctctcaggttttggctaccaagcaaaaggtggagttgcatcagttgttgctctttaccaggcccccaggggttgctgtcggtgagctcacaggatgttttcttctctctgctttgacttgtgctgaatttctgactgaccccatgcagcatctgcgtggcttctggggcccgagcccaggtttcagcaagctgcccatggtttaccctcaggatgaactctaggaagctggggagcactgtggtggtggtataagttcagcccctcattttagtttatttttatgttaaaatgtttattaatacaaaataacacatagatcagaatgttgtatgacagaaagggactgactggactcaggatctcccaccccagccccaggggtgaaggtgaaggtgattggtttcctgggtatcgttccttccacggtttttccatgcacgctctcatgtgcgtgtgtttttatcctcatcctgctcttcaccgtggcagtggggagcacactaaattgctctgacacctagttagttttttttttgattgagtgtatcttgggaatctttccatatcagcatatacagatacactgcattctttttttttttttttttttttttgagatggagtcttgtgctgtctcccaggctagagtggaatggcacgatctctgctcactgcaacctccacctctcaggctcaagcgattctcctgcctcagcctcccaagtagctgggattacaggcacccaccaccacgcctggctcatttttgtattttgggtagagatggggtttcaccatgttggccaggctggtttcaaactcctgacctcaaatgatctgcccacctcggcctcccaaagtgctgagattacaggtgcgagccaccacacctggccattcttttttttttttttttaaagcttttttgttgtacatatgatgtatgttaggtggactgtggcttataaaacctcttcatagctgttttccagtgcgatccttctagccctgtgaggaagacagaccagaagaaattttttgcagcttaggatactctgcaaacaaggaggaagtgagaggagttggggctcatttaatgcagactaaaacaggatctttcctttgagagactgagacaggatgaggagcaggctgtagatgtgcacacatatccactcagagagaacatgagaggcagcatctgcagaggagcctggtgggcagcacgtgccgcgggggcaggaaggggagagcttccgggaaggggatggaacttgagccaaacctttttctcaaaaagaggggaggccgggtgtagtggctcacacctgtacccagcactttgggaggctgaggtgtgcagatcacttgaggtcaggagtttgagaccagcctgggcaacatagcaaaaccccatgtctattaaaattacaaaaagtagccgggcgtggtggcgcacacgtgtaatcccaactactcaggaggctgaggtgggacgatcacttgaacctgggatgcggaggttgcagtgagccgagatcgcgccactgcactccagcctgggtgacagagtgagactctgtctcaaacaaaagaggggaaggtaggaatgagacaaaggaaaaggggaggcgggcatttcaggcaggagagcagcataggcagaaggtgcaaacatgtggcagagggtcggtgtccatggacacgcttccaccacctggtctaatcattgacttatcagacatctaaatgcctgctgcgtgcccagcactgtagagggccacaaggcagcaggaacctctcagtgcctgccctctgtgggctctgactccaaccaggagaaactggacgcacaacagcaggcaaaactagctgatggtgatagaggtcagaagagtggtttacagccaggcacagtgactcacacctgtaatcccagtactttgggaggctgaggtgggaggatagcttgagcctaggaggctgaggctgcagtgagctgtgatcaggccaccactgcattccagcttggcctggacaacagagcaagaccctgtctcaaaaaaagcggagtagttacttattgtggagattagctgttcaggggcacaaagaaccttgtagggtgctggaaatgtttactgtcttgacctgggtgatgggtttttttggtttgttttttgtttgtttattttgtttttttgagatggagtcttgctcttgtgccccaggctggagtgcaatagcactatctcggctcactgcaacctccacctcctggcttcaggcaattctcctgcctcagcctctcgagtagctgggactacaggcgcctgccaccatgcccggctaatttttgtatttttagtagagacaggggtttcaccatgttggccaggctgatcttgaactcctgaccccaggtgatccgcccgcctcggccttccaaagtgctaggattacaggcgtgagccaccgcgcccagcctgggtgatggttttatggtggtatataaatgtaggaattcatggggcttattatgtttaagattaatgcagattgcatactctaaccatgagtatgttataccccaattataaatcaagcaggcaaataaatagcatattccccaaaataaagaagtaaaatgcaatagcaagaaagtgtgcaaagagctatgcctgggaaaatacaggaactgtatcattttgaaagggtgagagatgagatttcagaccctcaccctctctcactgtgtcatttctgaagggccctggtgactttctttgcccctctccactcttacagtcattggaaccagagggcagaaccccgggcctcaaaattaagtctatacaccttagaaactaggaattcaaggctagccaggtcctggccctttatctgtccttcagagagtggggtgccccagccaaagcggacagctcgccattcccagatgtgccctgtgttctcggctgcgttgcctgactcaccttggccttccctgggagtgccttttctagttttctggcccagctagaagaaagggccattacacctactccagaatcatccctgctgctcccaagttggaatatttcttcctccacagtggccacctcttatgtgccctccatcacacagtttgtatacttacctcttcaagggcaggctgtgttttactccttttgtcatctctccccataggggtctaggtcagtgcttttgtacatggtgcctgaaacagtcccataaatgatattttatttgagtggggctctctggctggagctactaggtggaatgttgccatgtgggagcaggggtcataacgaaggctggccatcaagatgctggtacttccaaattcccaacagttattaactttcaggattgaggaacaagtaatagaaattccctggaatgcccaaaatcataactttttctatatctttcctaacactttatgagtttttaaataaggagtggtcataataataaatggaattattttttctgtgataaaatttcagaggtgtttctgtaaaaaaaaaagaaagaaaagaaaaagagaaaaaaagatgtaacattaaatgcgtggtttggtggtttggttgggcacagtggctcacacctgtaatcccagcactttgagaggccaaggcaggaggatggcttgagctcaggagtttgagaccagcctgttaacagagaaagattttgtctctattaaaaataaaaaaaattagccagcatggtggcatgtgcctgtagtcccagttactcaggaggctgaggcaggaggatcactggagcccaggagtttgtggctgcagtgagctatgatagcaccactccgggtggtgacagtcttggtgacagagtgagaccccatctaaaaaattaaaataataaaaataaaataaatgcatagtttattgttattatggacaaatatattgtgatatatgattgtatatatttcattagcatgtaaaaatgatctctatctgatatagacatctgataatagaaaatgcggaagagagcattaacacaaaatgaataccaaataaaaatcacttaatgatttaagagtaatactacacatatttaatatttaaaagttactcttaaaggttaaaactagagaaaagttaaaagaataaaacaatgaatttctgtatttccttcaccaagattcaccagttgctaacagtttggcgcatttgcttgatgtgtcatagattgtccacattccatatctgttggattgtttccttgtgattagattcgggtttacgttgttggtgggaacccacatagatgaggtgtgcttcctgttgcttacatcaggaggcacagtggtgccagttggccctagtaaaagtgatgctaacttgattcacctagttaagttggcatctgtgaaggctacttttgtattaaggcagtgaacttcgaaaggaacttttccctgactttgggaattgctgacagccatttaggaaaagagacgactgttttctctgtcacgtgtagctgcagttaagaaacatcctagtatagtcagacaagctctggaagccagtatgtcaggacctgggaccaagctctacagccatctctccctgtgaccatagccaagtcatttctgagctatgtgagactgtacgtataaggaaatagacactcagagaagtgaagcagtttgcccaaagctactcagctagtgagtgacagagctaggattcaaacccatttttgtctggggacaaagccctgcccttgtccttatgccaagctgcctcctttgtgaggcagctggttgttatgattgtggcactgaccactcagatgttgtgctcggaaccaagcagaagagcaccaagccttataggccctgacaggtgagagggaagagagaggtgccttccttcatccatctggactgcccttggaattcctgggccaatttggggaaccctggcaccaaccctaacatgggccagtgccagcaccaggtatatgcagcctgtacttcccagtctgggcaggcaaaggctggaaccgcaccagcagctctcctctgtaacgcagcacggaagtatttatttcaagggtggctcagagaagtgaagcagtttgcccaaagcaaactggttcctcccctgcatgtggcaggctgtcctgcaagctgggaggcgggctgttggacgctccccagccacccttgaaataaatgcttccatgctgtgttgcagaggtgagttgctggcaccgttccagcctccgcctgcccagactgggaagtacaggctgcacatacctggcactggcccactttagggttgatgcatgggatccccagattggcccaggaattccaaggccagtccagatggatgaaggaaggtattgcctcagcctgcctgggttcctcgggggagagagggagacaggaagcattaatgggggaaaggtgtgccaagccttgccaagcaggtcattgtgggtggggagacaccgcctacgtgctcgggacgccccaggatttgggtggaggttcttgaggaggcagcgagaaaggagagctgtgacagcgactctggagcactctagaatggctcttagtgaccttctgctctggtgacccaccagcagcccaccaacctgtcatcttccagttagcagccatccccagggccagtagcacctgagcacttggtaagtagaaagacccagtgtctgctcctcatgttaccctggtgtccttccccagagcagttgttttgggaaaaactggctccggctgaagcaggaaatggtgctccttgtcaaggtcatgttgtcctgttgctatagaactgagagaccctgaggatcagccctctgaggttcctgttacctctctttacactattcatcctcataggcctccaggaagggggccaaattcagggccaggaccagggccagtggcttggtgaggcataggctttgctgtatgggccctgtggggagctctggggagttcttattcccctggctcatggccaccatcatggagagacccccagggctctggcagccaagtgggcaggagcggagggagggggcatcttgggagggagagccccgaaaggaaacagggtttatagacagactcccggtcatcactgcttgtaatgcttgctcagtgaacagtggcagtgcttttcctgactctttcaagagagtcccttctctctcctgctaggtgggctgagatccagactggttagaagcctaacatgacctggcgtgtgagaccttgcactctctgaatgtattccccaagtgtcatcaataagtcactccggttctggcatttccctatcttatcctgcatacccctcctcctggctctgagtcctgaggagtgagattgcagtttttgacccatgttcttactgagaagtgggctgtcatgcaggtataatataaaatccagaagctgctgtcagaattatgtgagaattgggaggtgacagcatgggccaattttctgaatctctagggtgctttgatgcttaagaagtctttctgggctccctgagatttgaaacctcttgttttatctgtcctttcactctggttcttcctttcctttcttggggacttcatgcttctcaaatatttgttaagtgggtgcttatatgggaccttagaaagcaaccagctaggcatgcacttggaaagggacaggaggactgagaacaagactaaacatttctgtgagattgagcagcaggagagctttgcttctttactggtgtcagtatgtgcctgcagctcctgggctgcctttactcgagtgagatccatttacaagactcctgactcttctactccactttattacaaaagatgttgatgctcgttttaaaaacaatttaaactacaaacatgaataaaggtatttatctccccaccagtccccctcattctcccttccctcctgttcttagactggtttcccctcccagtagtttaggttgtggggcaagtgtgtgtagctctgcatcagtgtcttaaacaaaatgagtgtgtcgcggatgcgcagctcggccacttcctgttttcttcggctgtatgtcacggccatcctgccatggcaccatgtctgtgccacctgctgctcttgggcatctgcagagaattccatgacatggatcttgaggtagtcttcttcagctttttctacttcatcttattttctacaatcatttatatctgcttgtaaaacctttttttaaaaaacttgcttactagacacagcacatgttcattttagaaaatgtagaaaaatcagataagcagccgggcatgatgactcatgcctgtaatctcagcactttgggaggccaaggcaggcagatcacctgaggtcaggagttcgagaccagcctggccaacatggtgaaaccccatctctactaaaaatacaaaaattatctgggtgtggtggtgcgtacctgtagtctcagttacctgggaggctgaggtgggagaatcacttgaacccaggaggtggaggttccagtgagccgagatcatgccactgtactccaacctacgtgacagagtgagaccctgtctccccgccccccccaccaaaaaaaaaaaaaatcagataagcaataaaaaaagtagaaatgacccctaagaggtaacattttggtgtgtataatacaaatgtcttttacatttgctccctcatctcagcattgccactgccattaaagaaggcacatggtcattagtcccatctcacagatagaaagcctgagccacagagagggtagcaggttgcccagaggtacacagcatagtaaagacagagctgggggtgtacctgtcatataactcagcactaatgctctctccactgtagcccacttgctgtcttcgcaccttgggacagagaggggggtgccaggcattggatttcagatgcattgaactgccttatccgaaggttaatagacagatgactgcttgaggaaagcccctgattgacttaggagaagaggtagaagacacgctcttcaggtttacagacaatatgagacaagggattgtttgcgctttagagaacagaatcgggcttagaaaaccctcaaagagctctaatgacaggtcaggagcaacaggataaactttggaaggggtggatgtaaaggggcccccttctatttccgtaagcacaggaaggcctgacttgatgttcaggcagtgatgactggtctgcctgggagtcatagtggactgtaagcagggggacatgtcatttcaacactttaacttcatcttacttcctgggagtgttaggagccacacatcaagaggacgtgatgaactaaggaagagggtttgggaacctgtcaaatgacaaatgctgcagtgacagaggtttcacctagagaagatgggtttggggaggaaaaggtgcaggccaagacttggtgaccagggccaggcaggacaggaccaggaatggcagttagttgaagggagagtctaattggtcaggatacagaacacctttttagcattagagttcaggaatagtagcgagaggcagtacagtagagtggttaagagctcctgctctgatggcttactggctcccggctcccagagtcttggaagttacctcactcttccatgttccaattttctcatctgtaaatggggataatgggtacctgccttatagtccacttgtaaaacctaagggagttactccatgaaagcagcttagaataatgcctggcacacagaggtgctgtgcactgtttgattcacacggaagctgggtaggctccatggaagaagagttgtagaaggtcttctgcatgcatttggtatgacctgcttacccagccttttccattccctgcctccctgtctccttctttctttctccatcttcctctcctgggtctaggatcctacatttcccctacctaggacaccctacccctcaatctttattttcttctttgaaactcttaagtattttatttcttcttcttcttctttttttttttagacagagtctcgctctgtcgcccaggctggagtgcagtggcacgatcttggcttactgcaagctccacctcccaggttcacgccattctcctgcctcagcctcccgagtagctgggactataggcgcccgccaccacgcctggccaattttttgtatttttagtagagacagggtgtcaccgtgttagccaggatggtctcgatctcctgacctcgtgatccacacacctcggcctcccaaagtgctgggattacaggcgtgagccaccgcgcctagccctatttcttcttctttaaattgtttttattaaaaaaaaaaaaaaaggccaggcgtggtggctcatgcctataatcccagcactttgggaggccgaggcgggcagatcatgaggtcaggagacagagaccatcctggttaacgtggtgaaatcccgtctttactaaaaatacaaaaaattagctgggcgtggtagcatgcgcctgtagtcccagctactcaggagactgaggcaggagaatcgctttaacccaggaggcagaggttgcagtgagccgagattgcaccactgcactccaacctgggcaacagagtgagactctgtctcaataaagaaaaaaatgagacagggtctttctgtgttgcccagggtggtctggaactcctgggctcaagcaatcctcccatctcaacctccctgcccagctgctgtgcccagcagtattttctataattagcatagtgtacttttcagattatcttgaagacccagctctccttgaccttgaaccttccctgaggcctccagaggcaatttcctcctcaggactcagctgcccttcactcttccctcgtgcacagcctgtcctgtgagtaggtgcaggtactgactggtcttatctttcgccctgaaaatataaacgttttaaaggcacctgaggatttgtcagcacctccccacccccaccctgggtctgacctaggactctgagtcagggaggcctccctccactgagtaatagtagccttgggatctgctcagcaagaggattgtatagtttaagggaggaagaagcaccagtgctgcctccccatgggaaaaatgaagccccccctcccgcaaccaccaccaccacagaaccaccaaccccaacgtcacttggcagattagcaaaagaactagccagacgctgctaggcccctcaggcttctagattcgctctccaccacatttctaccaatttatgctcatcttgataagctcctcctttgaagggtctggaatggtctggagtggtctggaaagcagggtcagatacccctggaaaactgaagcccgtggagcagtgatctctacaggactgcttcaaggtgcgtggtgaacagacgtctttttgcaattatgccagttgctcctctgatacttgagggttatgtgaatctaacaacagacaaaaatctctgcctcctggggcttatattctttgggaagagacaagcactaaacaaataaggaaatatatatacactctgccagatagccataagacggatggagaaagttgaagcagggaagggagatggaagtacctgagggtggactacgcatatttgaaatagggaagccagggaagacctcactgagatggccacatttgagaaaggacctgaagaaggtgaggcagtgagctgtggaggtgggtaactggggagggggaagaactttagctagagagaaaagccgctgcaaaggcccactgaaggcaggatatgcctgctgtgtcgagaccagcaggaggccgtgtgcctggtacttaatataccagaaggagtggagcaggcaggggtaccagttccagaaggacttgctggcaggtattaagatgggctttttctctgtgataggaagctccaggaaggatttgatcacaggagggacagaatctgaattgtattttagaaggatcactttgactgctgtacagagagtgggtggtgaggtgggaggcagaagccagaaagccagttaggaggctgttaagtaatccaggcaggagatggtgttggctgggaccagggtcatagcagtagaggtggtgagaagtaattagattccgtatatttattaaaggcaaagccagcaagattccttgactctaacttaaaggttggagttgtcatttactgagatgagagagaccatggggggaaggtaaagggctcggttttggatgtgttaggcttgtgctgccattggacatccgtgtggaggtgtcagagaagctggcctggagaaataaattggggaatcatcagcatactgaaggcattggaaggcacaagctggcataagatcagaaagagatggagcgtagatggagaatgaaagagacctttagagattaggaagaaaattactgactgagaccaacaaagtagattgatacggagcagccagtgatatcagagcaaaacctgggaggaagccaaatgaagagaaggcgtagaggaggagggatcgagcagtcatatcactatcacatgctatcgtgggtcaagtaaaataaagatcataagtgttaccgaaagtttcaaagtacagtgacattggccaggcgcggtggcttatgtctgtaatcccagcactttgggaggccaaggtgggtggatcacttgaggttatgagttcaagatcagcctggcccacatggtgaaaccctgactctaccaaaaaatataaaaattagccgggcgtggtgacgcatgtctgtagtcccagctatgggagtctgaggtgggagaattgcttgaatccaggaggcagaagttgcagtgagctgagatcgagccattgcactccagcctgggcaacagtgagaccctgtcccccaaaaaaaaggccgggcgtagtggctcatgcctgtaatcccagcactttgggaggccgaggtaggcggataacttgaggtgggttcaagactagcctggccaacgtggtgaaactccatctctactaaaaatacaaaaattagctgggtgtggtggcaggtgcctgtaatcccagctactctggaggctgagacaggagaatcacttgaaccggggaggcagagtttgcactgagctgagatcgtgccactatactccagcctggacgacaaagtgagactctgtctcaaaaaaaaaaaaaaaaaaaacaaaggctgggtgcagtggctcatgcctgtaattccaacactttgagatgccaaggcgggaggatcacttgtgatccgggaggagttcagttcaagaccagcctggccaacatggtgaaaacccatctctactaaaaatacaaaaattagttgggtgtggtggcatgaatctgtagtcccagctactctggaggctgaagtaggaggatcacttgagcctaggaggtggttcagtgaactgaggtcacacctgcaccccagcctagtgacagagcaagactctgtctcaaaaaaatcacctaccaccctcttcatacaggggaactttcttctattctttttctagtcattttcatgagaatcatgatctttatgtaaattcgtattgtatttttcacttatgttattaaatattctatgaaaacatgagtttaatgactaggtaatactcagttgtctgggtgtgccctaatatatttaaccattcctctattattgggcattgggccatttctgattttttgttattataaataacattgcagtgaacagctcagtgttttcctataaggggaagtatagggtcaaagaacgtgaacgcttttaggtgagacttgaacttgagatccctgggttctcctggacagaccgaccaatcacagcttaactgtgggatttttccatgtctcctctctccctgggaaggttgagaagtctctctgccctgcagatccctattcctgcctccccgctgcaattgcacgtcccatttctcctgggccagtcagagtttcattgcctctcatggggcctgctggccacccactcagtggctgcccttctccttaccaccagccttcgtcccctcacctagagcattcacaggcgagcaagagccagtcagagcttccctcagagtagggggtgtagtgataaatgaaatagccctgccttcactcatctcactgggtcgattaagtgatgtgtgatgtacctgaaagcacttcaggaacttaagagtctcatgctctaccaactgagctagccaggtgcccttaaagggctgtcctagtcttaattgtttgtaaagaaataggtagctgggcatggtggctcacacctgtaatctcagcactttgggaggctgaggcgggtggataacctgagcccaggagttcgagaccagcctgggcaacatggcaaaaccccgtctctacaaaaaatacaaaaatttgccaggcgtggtggtgcacacctgtggtcccagctactcaggaggctgaagtgggagaatcacctgatcctaggaaatcgaggctgcagtgagctgtgattgtgccactgcactctagcctgggtgacagggagatcttgtcttaaaaaaaaaaaaagaaaagaaaaaggtataagtggtggtgtccacattgtaaccacagagcccctaaagcagggctgttgacctatggttggcatcctggtcacaagagctctgtgtcagatgtgtgaggggcttgggtgtagttgtcaagcctgggaatgtggctgttagtatcgattggcctcatgccaagcagtgccaagcgccacgtctgctccccagatacctgtgtttgtatgtgtgtgtcatagtcgggaatcactgagaccaggacctctgggaggctgaaccctgggagggcagagcaggaacaggccttggagatgatctaattctgacattttactcagtgaggacacaggtggggcagccagagaggtactcagctctgagtcagggccccatccctcaactcctcagcctgagtcttcccaggaacacaacaggcagctgcttcccagaccttgcagggctccaggtggccttcccctcctgccgactcccttgccaggtttgctgtaactattgctcctccgagcctggctgaaatcatcttcagtctgttatcaccttcagtctgttctcatcttcagtctgttctccacagcagcctgaaaagtctttgtaaaaatgcagctctgttcctccccatcctcttcataacccccttggctctctgctcctcccagaataaatacccacatcctcagcttacccttcaagacgctgagtgacctctagccacagcccttctctctacccacagacagcccaggtcctcattccttgggccttttcacatcactgttcccatcaccctggaatcccactcagcctgcctgggccagaggctacgtaaggtcctcaggaaagcgtctcctggccactcgcacctgactcatgtgctctgagtgccacaccttgcttggcatttgtccttcatagccctggtcattgctggctaatgtagcctggcacatggtggtaggtacttgacaaatatttgttgaacaagtgaatgaaaccagctggcagggaccagaagggcagaggggcagggacagtgtccacaaccatagcccctgtggtcttagctgagaagggctctggctcggtctctggtgagtctctctgctggccggcagaaccaccctaccctggaagccctctccatgtagtgtgaggggtctcaggcccattcaggcttcagtaggagagatctgggtctcttctgggacctgagcaggcctttcctttacctcgttggcatctctcagcattttatttggttttaaaaatgtctcccccttcccccgaccaaccccagattataaaggtatcccacgctcactgtgaagaaattggataacataggaaaatataattaagaaaatcgaaatcacctacagctccacccctcagagaaaagtacccttaacatttgtggccatgtcttttcagttttgtttttatgcatgtgtatgtgctttgacattgctgagcttctctttgtgaaaaccacagatttttcgcagtcttcagtggctgcggtcagaggtggtcagcacgttagtgctcccagtggagaggtgatgcagggatctgggtgcccctttctccctactgcaggtgggtgggtgggcacacccaaggcccccttctgtggcagctttcctatccctggtgaagagtaccctcctgtctctggtctcttctccaggacattctccagccctggaggctgttcctagggggctgcctcttggggcaatgggaagaattgtggaatgcgtgggtggcctcctggctgtcttttctctggttccagcactctctgaacaaaaccagccccaggccactcctggggattggcctcaggtgactctctgggctgactctggccagctagaaggccacccgggcttctcctgtgtccttaagagggtggggtgacctggattggcaaatagtaagcagagaacacggcagagttgctggcctagaaaaccaggtcactaggtcagcacttggattaatgattgataagaaaggttgggagagaatcagccagacccattctcccatgacatccctcacttctgatcccaaaagcacctgccacggagacggggcaacctctgtcttgtatccagaggctgccccttattccgttgcagtatgggaggaaggaggtgacagcaactgggtcacctgcatgtggggcgagaaggggaggaaggtttaggcccttctccctgaaaaaagaagcatgtgcccagagtagggggctccctgccggttctctccccacaattgatggtgaggcagggaactgggaagttctgtctgtggaggtcccttgggtttcagcaggctagcacatttctaggactggaatatcaccatacaatcccttaacacaagccatgggtgataataatagcagcagccactgtggtccttatttgtaggacccttactatctacctggcactgttaagcagttactgcatcgttatttattccacacagcagcctctcaggttaggtggtagtattccagttttaatgtcttccccaagtcataggatgggagggatgagccagggtgtgaacccaggcctgactgaagccggtggaattcacttctttggagtattgcatctcgatggcagtaatatatgaaaactgatacagtggcaagtgctacaactcagaatagtgtggctaaggctcatgtttttagtatatttattcatccagcaaacgtatgttgaggacccactaaatgccaggcaccgtgccaggtgctgggacctacctcagtaagatacagggcattctctgggaaactgataacatggtgaggccagagcagttagcagacattgcagtttggtgtagtgattgcagatctggagggcccgggtcagggttgtggtgagaaggaacagaatggagctagtccaggagagcttcccggaagaggaggtgcagacaggtcgcgaaggagagaaggttttagctagtggaggggatggcattcaaggcaggtgccagttcaagcctccatgctcagggagtgatgtgggatcatgaggcacataggcaggcagagcaggaggataggcctggagagggaggcagggacgagagcctgtggctgtcttcagcacacaggagtcattttctggcagtaatgtccagaagggctttgaccaaggtgttcttgacagaaacagctggggactggcagccagacagaggattcagaggtgatggctccagactgagactaaggagccccagctgggcaaggacatgccagctcctggtccagtcttacccagcaccatatatgaggcacacagtagagtggctaagacttgagccaacctgccttgactcaaatcctgcttctctagttactgtgtgaccttgagccaattactttgcctctctgtgccataatttccacgtcagttaaatggagatgataatagtacctgcctcttagggttgttgtgaggattacatttgccaacatacacagagcatggtgtgtaataagtccttggagaagggaagctagtactattgtgatggaggtggtgatccagcttaggctctggtacagtaagaaggtccatcaggctgtaccatgtggcagatggagcccatggaggatggaggcccctggcacactgactgtccccactcatcccctgggtagggcagaagtgttcccacaccgtacagcctgccagtgggcatcagggaaacacctgagtcaccacgaggagtacgaggcacttgggggttgcccagctgaccaggagcacagagggctgccctgaaagtgagcccctccctactcctagcagagacggggaagggagacaactggacttggtgggaaggactgggccccaggtggcttagttgctctggccccagaccaggtctctctagagctctgggccatttgggttaagcttctaactaccactgcccatgaaattcacctgccaatgggcaatggatggagtcatgcccctccctgcacctaagttctctgaagggctgagtttcttcttggggccagacagtgggtattggaatgggagcatgggggctgcatgtgcactgcaggctttgtgtgtgtgtgtgtgtgtgtgtgtgtgtgtgtgtgtgtgtgtgtgtacacacatacatatatgtcagaattggaatagtccaggggtttgttttgcaagaaatccttttatttttattttttgagatggagtcttgctctgttgccaggctagagtgcagtggtgtgattttggctcactgcaacctctgtctccctagttcaagcgattctcttgcctcagcctcccaggtagctgggattacaggtgcgtgccaccacacccggataaccaggggttttgccatgttggccagggtagtcttgaactcctgacctcaggtgatctgcctgcctcagcctcccaaagtgctgggattataggtgtgagcccccttgcccttcccccatgccccatgcaagaaattattttgctagggactactttttggtgaggggctacattgctgcattcgtgccccctcattctggctcagggcccttgtgttgtctgggggtctgaagctccagcctcttaagtggggcaaagctgtgacatgatcagagggcttctggctctggcatagtgctggggcgtggagaggggagatagccaacactgggagccagaccaaaaaaaaaaaaagccagggttttttgccggcatacaaattaaacttagtgcctggctgtattgtggttgttgttgttgttttgagacagagtctcctctgtcacccaggctggagtgcagtggtgcgatctcggcccactgcaacctctgtctcccaggttcaggcgattctcgtgcctcagccacccacgtagctgggattacaggcgtgcgccaccatgcctggctaatttttgtatttttagtagagatggggtttcaccatgttggccaggctggtctcgaacacctgacctcaagtgatccacccaccttggcctcccaaagtgctgggattacaggcatgaaccaccgcacctggacttttttttttgtttttgagacagggtctcaatctgtcctcaggctggagtgcagcagtgcgatcttggctcactgaaacctctcccctccgggttcaagtgattctcgtgcctcagcctccgagtagctgggattacaaatgtgcaccaccgcacctatctgatttttgtgtttttagtagagacagggttttgccatgttgcccaggctggtctcgaactcctagcctcatgtgatctgcctgcctcagcctctcaaagtgctgggattacaggcatgagccatgcccagcccagcctgtgctatctttagtgccagggcttaagaaaggaagaggagaatagggttcattgcaggaattgtggtgggtggggtggcagctacctgagaaaatctagacagtgggcctaggtccagtgggtcaggggagagagcctaggggtcaaggttgctcctggctgggcaagctgagaacagggagcaaccttggctcagggtagatgacagacctcagctgtagatggagcaaggaggccatatgaaaatggcaggcttctggcaaaatgcagggatgggctgcagcacagcagttcaatctaaataggagcagcccaagggacgtgggtaggttttagaacagccaggctacagctccccttcctcttcactggtgtccttgagaggccacagtcagaagagacaattccaggctagggagagatgtcagcgtgggaactagagaccctggtcccaaattcagaactctagccagagtccagaactgcatctgagtctaagaggcaaccacttacttacacctcccgaaactgagaacagttttaccggttctggtgaaaaaaacccactaccagctcatatgtgggagtgggagctgaggctctgctgagtaacacggcccagtgcacacagctgtcagggcctggcccggctcgagtcctgctgtgtccgaagctctgccgttttctgcttcgtcctctagcatgttctgagatgccctgttgggatcctcaggcctgtcacttttgtcatctgcaaggggggcctataaggccttaatgggggctggcgaggcttgagtgggagcgtgacgcatagtgggagctcagtcagctccctcccctccctccaggatttggtcctgacagggagctccatcaggtcttccccagggtcaccagaggctcagatgctgtgttgtcaagtatatataccaggcagtattgtagcttttcctcctctgttactgcctgctaagcggggaccccacatcttcacgtcctcctcttcctggctctcatcaccacagcctggtgtgcattgccccgtgtccactgacacccacgccacatgggtccaaaaacagagtgtgttctcattgcctcatcccactcaccctgggctctgccgccactgcgctgtggctctcgggggtcccaccatctgacccttgtcacccgtgctgctccttctcttgggactcatcccttctgaggcctcccgtggccccttctcaccctcccctacctcctccatctccaggctttcaatctggtggagcataaagaatcagtgtttctggtacttgttatttggataatggcacctaatgctaaatgacgagttaatgggtgcagcacaccagcatcgcacatgtatatataggtaactaacctgcacattgtgcacatgtaccctaaaacttaaagtataataataataaaataaataaataaataaaataaaataaaataaactttgaaaaaaaagatttcagctaaaattagtttcctctccatgccgagtctgaatatattataaaaataaaagaataattgtctttcacacaattaaaaaaaaaaaaagctgactaatgccactacagtcacacactgctgttggtaattgctagggtcctttttccagtattgtggccaacttccaccccagaaccccactctactcttgagctaagtgtctttatgtctcctattttaaattaggattgcgttcagttgcatgcaacagaaatccggcaatcagtgcctggtaaaacaagtttgattttttcacctaacaagcagtctggaggccggcattgcagggtgggtccagcagctttgggaggccacagtggccaggtgctttcggacttttcacccaccctcctaccctgtcttctgctgctccgaaggcagctgctacacctctaggcatagtattcctgttccaggcaggaagatgggaggggcagaagtttgtctctctattaggaaataatagctttttcggaagctcctcctggtagatttctgttcacatattgctggtcagaattatgccaatgaacactgtagctgcaagagagcttggggaaattgagtgtttaggtaggcacagattgctgatccagagaagactgagactcagaaggaaggagaatggagctggggagaagtaggagtgactgccccagctgccacttggagaaagccacggggtgagcaggacagcacctgtgaacatttcctgtgctctgggtctggtgcttctcaagtttaacacccaggggcgagtggtcagggactgatccttgaggaactgatgtacattaaacaaactatcaagtccctgcaatgcagtgtaaatgagtaaagagcctgcaggggagaaactgccactagtggagaccatgcgagtgggcagccgattgcttggctctgggggtgggtgccagaggcatgcaggtgcccaagggccaggtctgcccaattttcaagagaagccagaaaaccaaaatttttaaaggttttttcgttctaactctattttgaaaaaagttcggtgttacagagtaagttgcagagattgtacagagtccccacatatcctttacccagctcacattaaatcttacataaaggaacactggtacaatactattaaccaaagtcagtgtgttgttcagaccttaccagtttttctgccactgccccctttctgcttcggggatctggtccaggatcccacattcatttagttgtgtctctgtggtctgctcctgtctgtgaggcttcctcagtcacaaagctagaggtttacgtgaccttttccaggttttcccactctaatgatttggaaatcatacatcggcatcttgagacatcttttgagaagtaaagggacttgagctgattgaatgttgatcactccctctcatcttccacattattaagttttgccttcttattttattataatttaaattatttttaagccaggcacagtggctcatgcctgtaattccaataccttggtaggccaaggtgggcagattgcttgagcccaggagtccaaaaccagccggggcaacatagcaaaaccttatccctaaaaaaaaatacagaaattagctggtgtggtagtgcacacctgtggtcccagctacttgggtggctgaggtgggaggatcccttgagcacgggagataaaggctgcagtgagccatgattgcgccactgcactccagcctaggcgacagagtgagactgtctcaaaaaacaataacaacaacaacaaaaaaacccatcagaaaacagctaagagttttgtggtggtgttttattttaggttcagggtacagatgcaggtttgttatgtgggtgaacttgtgtcacaggcgtttattatacagattatttcatcacccaggtactaagactagtacccgatagttattttttctgctcctctcctcctcccagcctccaccctcaagtaggccccgaggttattgttaagtccaagcaagggaaggcctggtggaaatgaatgtgtagccttaacatgttttgtacaaacttggctgtacattacaatcaccaggacaattaaaaaataagaaacccaatgtccaagctgctccccaaaccaatcaaaggagaatctctggggatgggaccaggcatctgtctttttaaaaactccccagtgactacagtgtacagccgagttggcaggtctagagcagggagagagagcagaaggagtctctgatcactccaggttctggttctgatgagtgggtagacaggcaggtgggttgctaaagtaaagattactagaggacgaatgggtttggggaaaatgatgggttctgtttggatagattgagtttgagctgtcggtaaaatatctgagagttggggtcccacagatgcttaacatcttaaagcagatcttttcttctcctgatccttccacaaggtctggtgcagacatttccccgctgggagactctccacagtacctcatgatcttatcatctctgactgtggcatttgtggataatgttttacttgctaagggttggaactgtctcctcctgggtgatgtggacgtggcatcaccacccagtaagttgtcaccttggaaagactccaggatggagcacatcttcctttttctgatgtctctgctattgaggccatggttgcagatctgctgtcaacatgagccaagaacagcagggctttatgtcttttttccacacccaaccactgaaaggatgggactcaccccttcaggaacagtagcacagcagagccgtgattcttgggcctgagtgctgatagggacagggtcggggatgggaggcgtgatgcatatctggatctccaggtgggctggagagttgggaaaagcccctcaagtcattccaatgtgcttcctggagactcagaacagaaggcagcagaggaggcagggaagggtggcacagtgatgtgtcacctctctagtttatggagcctgctccgaaccccacaaacccactacaagagccaggtgggaagggtgatagggcaggtgacttgtgatacaaggagcagagaccatggtatagcactgcaggaactagggaaggagcaggagcagaagaaccccctccatgacagcagcccccaagcgtgccccactcgcaccatcctcttccttgtcactgcctcccctgacctcttcctgtcttctcctctgcccaggctgatgggaaccaccctgtagaggtccatctgcgttcagacccagacgatgccagagctatgactgggcctgcaggtgtggcgccgaggggagatcagccatggagcagccacaggaggaagcccctgaggtccgggaagaggaggagaaagaggaagtggcagaggcagaaggagccccagagctcaatgggggaccacagcatgcacttccttccagcagctacacaggtgaggagaggactggcaggggacacggggcagaggaggcacagcccagtgcagtggggatcctggccctctgcaaacgccatcatgtggggcgcagagtagcagagtgctgaaggactggagccggaagcctgggttcacgcccagtgcggtggggatctgctctgccactcaccagcagtggggcctggagcaagctgcaccacttccttctgtaaaacaggccaaaggatggtaggtgatgtggatatgggctttcgtgagaattaaatgagtgggcatctgtaacacatgtcatcatcattattagtattcccaccactgttaacacaaggcatctgagaccaatctccactaacagcacactagaaagatcagctgtacctgggattgttatgatcagtcgaaacacacagttcaattggtctggtaataattatacacatcatcattgagccgtatcataattagataaaaatgctaagcagttagtatgaataactcaactaatattatttttatgcagccaagcagttgtagcttctcctgtctcacttattggttcccctttatttatcagcagtgcagacagttttctctagtaccctgtactgttctgtcatcttcatcatcatcatgttatgtttaccttcaaaagcacccagaatccatgcagcccctggctttccctgctgcagttccccctgcttttttgtttttgtggtttttgagacaaagtctccttctgttgcccagactagagtgcagtggcacagtctcagctcactgcaacctctgcctcctgggttcaagtgattctcctgcctcagcctcccgagtagctgggattataggcgtgcaccaccacgcccggctaatttttgtatttttttagtaaagatggggtttcaccatgttggccaggctggtctcgaaccgctgggctcaagcaatccacccacctcagcctcccaaagtgctgggattacaagcaggagccaccgcgcctggcctgatccctctgcttcttgctttctcccaccacttctctccttacccaagtgctgcaggcctgcacatgcagctcatcctcgctcctccccttagagggaactcagggtcataaggatatactgctgggagtagacaccctgcactcgctgctgctttcagctgcaggagatcctagccacaggcggtgactcaggcagaggagcaagcccaccccgcagaaatgggctctggacccctgtgactgcatggagcaggaggaggcagttagtgtccaagctaaggcagggtgaaggctgtggaggtagcgcaggctcctgtttgggtctgcagctaagatgggtctgaatcctggagccacaccaccttgaacctgcaaagcaagtcccagaattttgcagaagttcttcctcttcagtgtatagagttgggtggagggagtatagagccatcattcagtccttctcatctcacccaggatcacctgggagtgaccaaagtaggccaaatgtgattctagggccaaagtgaaggtgtccgccattccccgagtaagcaacttcctgtctattggctggtaactgggatggctttggagacacagcctgtctcagaagagaggaacagctaaccaggagtgataattcactcagtgccagtagcacatactgttctaaatctgaagaaggtagggagggttagaaagcaaagggaagacagtggggactaagaatgagtgtgggatgtcatgaggattcaggggagaatgcaaggagaagagacggccacagggtttgtggctatgccgcctgccgtggcccacctcatccccacatctgagcccaggcagatggaagtcccctgcagagcagtgttctgtcctggagtttcctccacaccccttcttgggaccagggctgtttcccaaatagcatcactgttcccgtgcaggccaggtgaggtgcctgggagcaggggtagggtgaggcaggcatggcggtgacctctcaggcagcttcgttgtgggatttagggcacagcgggaaacgtccagggcagaggttgcctcaccagtcacatggtactatgtaggcggtggtgtttaatagattctgtttatcaataagtggatgaagtggagatagacttccttgttcagtcattgaaacaggagagagggttacttgacataatcactttgtgttaaagctgtagtgtatgaaaagttcccaaaaattctacaagacaagcaacctagcaggaaaatcagaacaggtaacagtaagacaaatacgaatggcctgaaatcccgacaggtttttcagtctaaccaactcaaagaaagcaccttaagttgcaatgccatttcacctgtcagatgggtggggaggacttggtcctcccaccaccaggggtgaaagggtagtgtgggccaacacttcttaatgtgtgattctttttttttttttttgagacagagcctggctctgtcgctcaggctggagtgcagtggcacacgatctcaactcactgaaacctctgcctcccgggctcaagcgattctcctgcctcagcctcccaagtagctggaattacaggcgtgcaccaccgtgcctggctaatttttgtatttttagtagagatggggttccactgtgttggccaggctagtcacgaactcctcaggtgatcctcccgcctcggcctcccaaagtgttgggatttcaggtgtgagccaccacacctggccaagtgtgcatttcttttaccctgcattcccacttctaggaacgtgtcctgtgtaagtacttgctcagcatgctcagagattcccatgccagcttatttactgcaggactgctcataagagcaaaaataggaacgtgcccatctgtggggaactggttatgtaaactgtggtagagccatatggtggaatactctggagtcattgaaaaggataaggctggtttatatatatattaaataagttcctgacaagttggggatcccattgtttaaaatccttatgtttcatagaaggcaccggaagagtctataccgaaggactcaggggctaactctgaggagcaggatcatggttaaggaggctgtgtcataagatcctgcatacccttctgtgtttttctcaacaagtctgcactacttccataatttgaaaggcaactgtactttttttaagggtaaaattaactgtttaaaaggggggtgaggatctggcaggtgaggggccctggagacagagcctgatcatgtgtccagagcagaagggcttggagatcacagagaccagggcaggcatcccaggtctgtcactgtgagctgtagccctcgccagtgccatcacttctccaagtctcattctcttcacctttataggctgtgtcctacccagcctgagggccagccaggtgagagtcagtgggggtatgtgacacatcgcaggtctcagcacctgctagttctctgccccatccccatgagttattactttggcctcgggagtcccctgagggacccataaggacagcgcacagctttgagccctgaaacagcaggaaggctccacagtcacccctgaccaccctcctcagcagttcagcactgactctcagtgcagatattgagctcaacacctgccatgcaccttctcaccctccccccagccaggcaggacagaccttcccatcaacaaggaaactgaggttaccagaaacccacttgccagggtcccctgggcgtgtaggagtagagacagctagagccaggattcacctcccattcccattctcatccctcctgcttcagtgacatccatcccaatcacccttgagaaagaggaagataaagtgtccttcctcctggcctcagcacctcctcacttggcaagcacttggtgggcatcaggctgggcccagcactgtgcccagggctggccatacagtggtggacaaggctgagtgcctgtcccaaggagcccacagttcaggcaaacaggacagcagaagtaaagaggctgctcagtaacccagcctcaaatccctgcagaatttggcctgacttcagaagctgctgggtgcttgtttgcctgtgagctctgccagcaaagtaaatagaccaatcgggcgcctcctggctgtcttcacagccatgacaacggcattctcccagcattggaggctagatatgcaggagagctctcagccacaaatgatgtgaataaggtcaatagtgtctatttgctgaacttgtcatcaaagatggtgaaactgatactttactctctgggtgagagggctagtgtttacactgaatccaaacatttggataatgacatggtgcctcctcagcagtgactgtgtcttcttgttcatcataataatgttattgattagcggtactgaacatgtaggtatgcgtagtagtgagatgccgaggttaagagctcagctccaggaattgcatggttctaggttataattcttgctctgtcactgtattagtcagggttctccagagaaggagaacctgtgtgtgtgtgtgtgtgtgtgtgttgaaagaaagagatgtgttttaacgaattggttcacacagttgttggagtggcaagtccaaattttgaaaggcaggcaggctggagagccggggaagttgatgttgcagctcaagtccaaaggcagcctggaggcagaatttcctgttccacagtggggccacggtaggcactcagtcttttttcttaaggccttcagttgttggatgagggccactcacattatggagggtaatctgctttactcaaagtcttctgatttaaatgttaattgcatctaaaaaatatcttcttagtggccgggcacagtggctcatgcctgtaatcccagcactttgggaggccaaggtgggtggatcacctgaggtcaggaattcaagaccagcccagccaacatggtgaaaccccatctctactaaaaataccaaaaaaaactagctgggcgcctgtaatcccagctactcggggggctgaggcaggagaatcgcttgaacccgggaggcagaagttgcagtgagctgagatcgcgccattgcactccagcctggggaacaaaagcgagacttcatctcaaaaaaaaaaaaaaaaaaaaaaaaaaaaaaaaaaaacaccttcttagcacattgtttggtcaaacaactgggcaccgtggcctaatcaagttgatatgtaagaccaacatagccgctgccagcaagttactaacacttctgagccttggagcctcggcttccttgcctgtaaagtgggggtaagaagaccatcttgaaaggttgttttgaggttttacgtgagatgaaatgggtgtccaatggagtgcctttagcaggacacctgcttacccccacctctacccaggacatcatgatgcgggggaagtggtggaaccttcagaacccagcccctagtatgagaagaattctgccatcacctttctttcagcagagagggaagcagtccccttccgtgacagtcacatgcgtgagtgatggctccttccaatatcctgcacttcttactgccccttacctggcgttgctccactctgtctcatgttctagttttcttatctctttctctttttttttctattttatttttttcctgtaggcacaagtgagttacagtaggttaagttacaccttacctttccttgtttttcttgtttatttatttgtttatttatttttttgagacaaggtcttgttctgtcaccacaggctggagtacagtggtgcaatcacagctcactgcaacctggacctcccaggctcaagtcatcttcccacattcaggcaatcctcccacctcagcctcccaagtatctgggactacaggcatgtgccaccacacccagctagtttttaaaattttttatagagatagagacagggtctcactatgttgcccaggctggtctcaaactcctgggctcaagtgatcctcccgcctcagcctcccaaagtgttgggatcacaggtgtgagccactgcacctggccttttgttttttttaagtagagacagtcttgctttatcacccaggctggtatacgatggcacaatcacagctctcctaggctcaaggattttcctgcctcagcctcctcagtagctggcactataggcaggtgccacgacacccaactatttttttttttttactttttatagagacagggtctcactatgttgctcctggcctcaggtaatcctcctgccttggcctcccaaagtactgcgattactggcgtgagccaccacactcagccgagtgcaatggcgcgatctcagctcactgcagcctccgcccccctgcccccgggttcaagtgattctccttccttagcctcccgagtagctgggactacaggcatgtgccaccacgcccagctaatttttgtatttttagtagagatggggtttcaccatgttggccaggatggtttcaatctcttgacctcgtgatccgcccgcgtcggcctcccaaagtgctgggattacaggcgtgagccaccacacccagccctgctgttacctctttcttacctcagctatttgaggatagagtctaggtcctgtcctgcatatagaaggtgcttatcatgtgtcttttgagtgaacacagagggtgacattgtcacgtgcagtgccaacagaaaccaaatgactagacacctgctgaccttccatggccacagggaggatgagaaaggcacctccaggaggtgtgaataatctgagggtattggccactgtggacaagactcggtggtggaagtgagctcagagatccaaagggaacgtgagtagagacatgcagagtctcgcagaggaagcagacgtgcaggccacaaagacaaaattacaagaaatgccccaacacgagcatatgctcacggactgcacagattcaaggaggaagtgccagaaaccctgcctgccccagcatctgcacaggcatccacaaagggtttctgtcatgttatctctttttcttccaacatccggtgctgtgagttttattgtccctgttataaatgcctccaggagtggcaggtcctgcccagccccatcagccagttggtgctgcagtcaggacacccaggcagcctgaggactgccagatgtgcagagagctatcgcgtgcctgctgcgtgcccagcacctcacacagctctcagtgtctgaccacgctggtgccctggtggacaaagttcctgcccttgtggcccttttgtctagtgggtggcttccaacaatgaacacacacaggatatgtcaggcggtgacaaaggctactgagaagaccaaagcggcttcaccctcccagagcacagcttttccctcccaggcccgagagatgtagggagcccactgtcccagtctgggtcaagaggaacagttacaacaccttggaatgactgaagttgggagctaaggtgccaggacaagacaggccattttaggaaccagagacttgtgttacccctaaacctcaccagccaggaggggagcagcccactgggtcctctctgccacagttgggtgcttcttgtgctccccctcctgtggtcaggataggggaagcaggctttcctgctgccactcctaggacccaaggggaagctgggggagtggggagaccatgtgggaaggatggagtgcactttgattggtagcaggtggataggtactcccatggtggggaaatcaaagttgcttggcctgtgtagtagacaggtattaccacaggcctggaaaacattagcctgggtttatctctgtggcttcggtcccccaacatccccttctactcaaaatggctgattctctggtttggaggtttggcacctgcttttggggaggttgctcagtcattagagaagagtgcagaggttggacggtcatcatggcagaggtaggacagctggtatgtggggccatgaaaccagctttgggctaggagtcaggaagctgagactcagttcaggtcccctttccaagatgaagagatcatttccgagtgtccaaagggcactgggaagagaatcctagcagttcttatgaaatcatctgacagcagatatatcctgaagtcatagccttagcaaactgcctttctcgccaacacactcaacaccccgtggttcaaacatctatacgtctgatagaaaaacttggagaaattcagtgtgttgcttaatcaatatgactgatacctaagctgttctactcaagaagttttcatgggaatgaacttgagcttcttgaagagattgtttacagcatccctggagtctatgcaagaatagaacttcctgtgggggatggtggggaggctagctctgcagaggtctacagtcctgcagtttctgcaaaacacgttgcacacatctccatatgggccacacggtggcaacctctgaaccaggagagctgcttcctaagggctaagaccctctgtctgctttctctctcttgctttcctcccaaaacacagccatcctcctccccactgctaccccatggtgagttcagcccaggaagcctctgacccagccctgatggtaatagctgctgtgtactggacatcttctgtatgttaggctctgggagaaatgctgtggagactttttgcccatcctcccagagaagctgtcagtaccccctgttctaggtgaagaaactggtcctcagaaaggttgactccctgaggccacacagctgttaagtggctgaggcgagggctgtggggctgttcccacgccctggcttccaggcctggcagcatgtggagctgcccctccatcgtgtgtccgcagacctctcccggagctcctcgccaccctcactgctggaccaactgcagatgggctgtgacggggcctcatgcggcagcctcaacatggagtgccgggtgtgcggggacaaggcatcgggcttccactacggtgttcatgcatgtgaggggtgcaaggtacggactggggggagcggtggctggccactgaggctgtggtcacatggtgaattgaccctccacaaagctttccttgccttggggtggggccctgactgtacctattgcagaattcctgcccaggaggcagccaggcccttgtgctccagacctcagctctgggcactgcaggagaagagggggttcccttgtcaagcctaccctgctgggcacctgtgttgacccagctctgtgggtgattgtgtccccctggggaccaggcagctagggcagaatgagggtcttgggctgagccatcgtcttacctgaggtctgggtttcttgtttctcaaggctcaaagcgggctctgagaaaaaaggacagacatttgtttttccagtgatatttgtgggtccttcctaacttcacacccatcaaaatctcacagattattttattgaatcaccacctcacaaatacacagaaccagatacatttatgaagaaatcaagttagccgtgagacaatcttatgttaccaaactaacaaagaagctttttttttttttttttttttttttgagatggaatctcgatctgtcgcccaggctggagtgcagtggcgtgatctcagttaactgcaacctccacctcccgggttcaggagattctcctgcctgagcctccagagtagctgggattacaggtacatgccaccatgcctggctaatttttgtatttttagtagagatggggtttcaccacattggccaggctggtctcgaactcctgacctcaggtgatccacctgccttggcctcccaaagtgctaggattacaggtgtgaaccactgtgcctgacccaatttttgtagttttaatagggacggggtttcaccatgttggctaggctggtcttgaactcctgacctcaggtgatccacccacctcggcctcccaaagtgctgggattacaggcgtgagccactgtgtccagccccaacaaagaagctttaggacttctttagacatttaaaatagttgtgttttttttttgttttgttttgttttattttgttttgttttgttttgagatggagtttcactcttgttgtccaggctggagtgtaatggcgcgatcttggctgactgcaacctccacctcccgggttcaagcgattcccctgcctcagcctcctgagtagctgggattacaggggtgtgccactacacccagctaatttttctgtatttttagtagagacggggtttcaccatgttggccaggctggtctcaaactcctgacctcaggtgatccgcccacctcggcctctcaaagtgctgggattacaggcgtgagccactgtgcctgaactaaaatagttttaattaaagttttagaattactttccttctccatctcccctccaaaaaaatttcttctcgttacttccaaatgtcaggagtgtttacaccttatacataatcgggccctttggcacagcctccctcccacctcctggtggcctttcctcacctgttcttggtgcttcagggcttcttccgtcgtacgatccgcatgaagctggagtacgagaagtgtgagcgcagctgcaagattcagaagaagaaccgcaacaagtgccagtactgccgcttccagaagtgcctggcactgggcatgtcacacaacggtgagagctgaccagggcaactcacgggctgctggctccacacagcctgaaaccaaggtccagggagcccttggggcagcctagagggggcacctgtagagcagtgcctggcgcacagtaagcaccatggctgttggctgttggctttgctgatctggaccttggatcttagagcctaagacctgccacttcctcagactgccagcatctaccatgggtcccaggcgtggggtagtgtttacctccctatacctgaggtttacgcattctggcccagaagggaactgataattgataccagcttgaacaatttggggaacaccagtcccagaaactcaagcctgtctcagatgacctgacacagcatgaaagctactgccaaggccaggtggcccttcttggttatagaaggcaggcagtaaccagtaagtaaccacatttgtcaactgccaggagccaggcagaagtttcttggaggtcacccactcccaggagacagagccttctctgccctgtgctccaggcctcctgcagagccttgtcttcggaccccagggtaggatattgcaaagcccacctgtcccctcagtacctctctgagtaagacccctagaggacaggggagagcctcttgtgatctctacaggcaggttagctgcttggccagcttttacccagggatgccctaactgccttgcatcttagagggtagcagtacctgagccctccatttgcggctctcctgggtaatggggtctggcaggtctgggtttgactcctttcttaggaaatctcggaactgactgaatccctctccttacgctaactccaggagaagtcgaattcgtatcctactcaattactaatgacaacaatttttgagtgcttactatgtgaggattcttatttaattgatctaataactcagtaagttttaaaaagtattagcctcatttttctgattaaaaaagaaaagtggccaggtgcagtggctcacacctgtaatcccatcactttgggaggccaaggtaggaggattgcttgagtccaggagtttaagaccagcctgagcaacatagtgagacctcatctctacaaaaaaaaaaaaaaaaaaaaaaaaaatttagccaggcttggtggcgtgcacctgtagtcccagctactcagaaggctgaggcgggaggatcactttagcccaggaggtcaaggctgcagtgagccatgattgtgccactgtactccagcctggatgagagtgagaccctgtctcaaaacaaaaaaagaaaaaggctgggcatggtggcacatgcctataatcctagcactttgggaggccaaggcgagtggatcacctgaggtcagcagttcaagaccagcctggccaagatggtgaaactctgtctctactaaaaaaaaaatacaaaaattagccaggcatggtggtgggcgcctataatcccagctactcgggaggctgagacagagaattgcttgaacccgggaggcagaggttgcagtgagccgagatcgtgccactgcactccagcctgggagacagagcgagactctgtctcaaaaaaaaaaaaagaaaagaaaaagaaaagtgaaggagtctgccccaagtcacaaagctagtaaactgctgagctggaactcaagcccaggcctttgtcaccaaagtctgtcttaccccagctagcgtagctcagtcactcagtaagttagagtccttgtgtgctgggcactgtgaacaaaacagacaaaatcactgctcttgcaaagatacaccaaaaaaaaaaaaaaatcacatcttgtggagcttgcgatctggaggggccaccccatcattcctaccttgctgactctagagcttctgggggccttaggctccaaaaggatttggcccatgcacctgtaaagggatggggatgtcagaggtgctggggcctgcctgggctccttgctgactgcccccttccctgtgcagctatccgttttggtcggatgccggaggctgagaagaggaagctggtggcagggctgactgcaaacgaggggagccagtacaacccacaggtggccgacctgaaggccttctccaagcacatctacaatgcctacctgaaaaacttcaacatgaccaaaaagaaggcccgcagcatcctcaccggcaaagccagccacacggcggtgagtgttgctgctgcttggcctggcagcatcctgggctctgggtcccactgccgcctgcctgactccgggagagccaggccttctccctccctcaacttcatggtgcaggcaagggacatggggagcacagggtgggggtctcccgaggcctgatctctaacggggcctggttttcagccctttgtgatccacgacatcgagacattgtggcaggcagagaaggggctggtgtggaagcagttggtgaatggcctgcctccctacaaggagatcagcgtgcacgtcttctaccgctgccagtgcaccacagtggagaccgtgcgggagctcactgagttcgccaagagcatccccagcttcagcagcctcttcctcaacgaccaggttacccttctcaagtatggcgtgcacgaggccatcttcgccatgctggcctctatcgtcaacaaggacgggctgctggtagccaacggcagtggctttgtcacccgtgagttcctgcgcagcctccgcaaacccttcagtgatatcattgagcctaagtttgaatttgctgtcaagttcaacgccctggaacttgatgacagtgacctggccctattcattgcggccatcattctgtgtggaggtgagtgagagtggggcaggtgggctggcctggcacacccagtcgtcctgggggttggccctcactgcagggcactgtgcctgagctctgacagtgtggggaagtgtccctgtgatcttggcagtggaacatgcaaggcactgactgagcatgcaggatcagctccatctcattatgtacgtagatagaggtggagacaggaaaaagactaagccagacgtggtggctcacacctgtaatcccagcactttggcaggccgaggcgggtggatcacttgaggtcaggagttcgaaaccagcctggccaacatggtgaaaccccgtctctactaaaaatacaaaaaattagccagatgtggtggcacgcgcctgtaatcccagctacttgggaggctgagccaggagaatcgcttgaacccgagaggtggaggttgcagtgagccaaaatcccaccactgcactccagcctgggtgacagagtgagaccctgtctcaaaaaaaaggaaaaggactaacaggcagtatgctgtcatgttaatgtggggtggaaaaattgtctgcattttttctgcatttttaaaattccaacacaataaatacaataataactatgctaactaacagtggtctagagcttacttcatgccaggcactgttcttttcatcgatgatgactcacttgatcctcacaacaaccctgtgcaggaagaatgttttgtgtctccattttacacatcagagaggctgaatgacctgcctatagcctcacaggcagacacaggatttgaattaagcattgagtctcttaaccacaatactacgttgcctaatcgggggggaggtggggacaaattggcaaaaaacaaaagaagtggattaagaccaggggtagggagattagaacacccagtggagcattgctgatgggacagggcttggtctgtcacggccaaggaggcctgccgtcccctgggccaagtcacctcttggggtggaagtaggggagctccactgcctttctgagctccctggcgtgccctgtgtccccacagaccggccaggcctcatgaacgttccacgggtggaggctatccaggacaccatcctgcgtgccctcgaattccacctgcaggccaaccaccctgatgcccagtacctcttccccaagctgctgcagaagatggctgacctgcggcaactggtcaccgagcacgcccagatgatgcagcggatcaagaagaccgaaaccgagacctcgctgcaccctctgctccaggagatctacaaggacatgtactaacggcggcacccaggcctccctgcagactccaatggggccagcactggaggggcccacccacatgacttttccattgaccagcccttgagcacccggcctggagcagcagagtcccacgatcgccctcagacacatgacacccacggcctctggctccctgtgccctctctcccgcttcctccagccagctctcttcctgtctttgttgtctccctctttctcagttcctctttcttttctaattcctgttgctctgtttcttcctttctgtaggtttctctcttcccttctcccttgccctccctttctctctccaccccccacgtctgtcctcctttcttattctgtgagatgttttgtattatttcaccagcagcatagaacaggacctctgcttttgcacaccttttccccaggagcagaagagagtggggcctgccctctgccccatcattgcacctgcaggcttaggtcctcacttctgtctcctgtcttcagagcaaaagacttgagccatccaaagaaacactaagctctctgggcctgggttccagggaaggctaagcatggcctggactgactgcagccccctatagtcatggggtccctgctgcaaaggacagtgggcaggaggccccaggctgagagccagatgcctccccaagactgtcattgcccctccgatgctgaggccacccactgacccaactgatcctgctccagcagcacacctcagccccactgacacccagtgtccttccatcttcacactggtttgccaggccaatgttgctgatggccccctgcactggccgctggacggcactctcccagcttggaagtaggcagggttccctccaggtgggcccccacctcactgaagaggagcaagtctcaagagaaggaggggggattggtggttggaggaagcagcacacccaattctgcccctaggactcggggtctgagtcctggggtcaggccagggagagctcggggcaggccttccgccagcactcccactgcccccctgcccagtagcagccgcccacattgtgtcagcatccagggccagggcctggcctcacatccccctgctcctttctctagctggctccacgggagttcaggccccactccccctgaagctgcccctccagcacacacacataagcactgaaatcactttacctgcaggctccatgcacctcccttccctccctgaggcaggtgagaacccagagagaggggcctgcaggtgagcaggcagggctgggccaggtctccggggaggcaggggtcctgcaggtcctggtgggtcagcccagcacctgctcccagtgggagcttcccgggataaactgagcctgttcattctgatgtccatttgtcccaatagctctactgccctccccttcccctttactcagcccagctggccacctagaagtctccctgcacagcctctagtgtccggggaccttgtgggaccagtcccacaccgctggtccctgccctcccctgctcccaggttgaggtgcgctcacctcagagcagggccaaagcacagctgggcatgccatgtctgagcggcgcagagccctccaggcctgcaggggcaaggggctggctggagtctcagagcacagaggtaggagaactggggttcaagcccaggcttcctgggtcctgcctggtcctccctcccaaggagccattctgtgtgtgactctgggtggaagtgcccagcccctgcccctacgggcgctgcagcctcccttccatgccccaggatcactctctgctggcaggattcttcccgctccccacctacccagctgatgggggttggggtgcttcctttcaggccaaggctatgaagggacagctgctgggacccacctccccctccccggccacatgccgcgtccctgccccgacccgggtctggtgctgaggatacagctcttctcagtgtctgaacaatctccaaaattgaaatgtatatttttgctaggagccccagcttcctgtgtttttaatataaatagtgtacacagactgacgaaactttaaataaatgggaattaaatatttaagagctgactggaa

SEQ ID NO: 61514 - DNA, 7961 bp, Homo sapiens
ctaaagttctgaaagacctgttgcttttcaccaggaagttttactgggcatctcctgagcctaggcaatagctgtagggtgacttctggagccatccccgtttccccgccccccaaaagaagcggagatttaacggggacgtgcggccagagctggggaaatgggcccgcgagccaggccggcgcttctcctcctgatgcttttgcagaccgcggtcctgcaggggcgcttgctgcgtgagtccgagggctgcgggcgaactaggggcgcggcgggggtggaaaaatcgaaactagctttttctttgcgcttgggagtttgctaactttggaggacctgctcaaccctatccgcaagcccctctccctactttctgcgtccagaccccgtgagggagtgcctaccactgaactgcagataggggtccctcgccccaggacctgccccctcccccggctgtcccggctctgcggagtgacttttggaaccgcccactcccttcccccaactagaatgcttttaaataaatctcgtagttcctcacttgagctgagctaagcctggggctccttgaacctggaactcgggtttatttccaatgtcagctgtgcagttttttccccagtcatctccaaacaggaagttcttccctgagtgcttgccgagaaggctgagcaaacccacagcaggatccgcacggggtttccacctcagaacgaatgcgttgggcggtgggggcgcgaaagagtggcgttggggatctgaattcttcaccattccacccacttttggtgagacctggggtggaggtctctagggtgggaggctcctgagagaggcctacctcgggcctttccccactcttggcaattgttcttttgcctggaaaattaagtatatgttagttttgaacgtttgaactgaacaattctcttttcggctaggctttattgatttgcaatgtgctgtgtaattaagaggcctctctacaaagtactgataatgaacatgtaagcaatgcactcacttctaagttacattcatatctgatcttatttgattttcactaggcatagggaggtaggagctaataatacgtttattttactagaagttaactggaattcagattatataactcttttcaggttacaaagaacataaataatctggttttctgatgttatttcaagtactacagctgcttctaatcttagttgacagtgattttgccctgtagtgtagcacagtgttctgtgggtcacacgccggcctcagcacagcactttgagttttggtactacgtgtatccacattttacacatgacaagaatgaggcatggcacggcctgcttcctggcaaatttattcaatggtacactgggctttggtggcagagctcatgtctccacttcatagctatgattcttaaacatcacactgcattagaggttgaataataaaatttcatgttgagcagaaatattcattgtttacaagtgtaaatgagtcccagccatgtgttgcactgttcaagccccaagggagagagcagggaaacaagtctttaccctttgatattttgcattctagtgggagagatgacaataagcaaatgagcagaaagatatacaacatcaggaaatcatgggtgttgtgagaagcagagaagtcagggcaagtcactctggggctgacacttgagcagagacatgaaggaaataagaatgatattgactgggagcagtatttcccaggcaaactgagtgggcctggcaagttggattaaaaagcgggttttctcagcactactcatgtgtgtgtgtgtggggggggggggcggcgtgggggtgggaagggggactaccatctgcatgtaggatgtctagcagtatcctgtcctccctactcactaggtgctaggagcactcccccagtcttgacaaccaaaaatgtctctaaactttgccacatgtcacctagtagacaaactcctggttaagaagctcgggttgaaaaaaataaacaagtagtgctggggagtagaggccaagaagtaggtaatgggctcagaagaggagccacaaacaaggttgtgcaggcgcctgtaggctgtggtgtgaattctagccaaggagtaacagtgatctgtcacaggcttttaaaagattgctctggctgctatgtggaaagcagaatgaagggagcaacagtaaaagcagggagcccagccaggaagctgttacacagtccaggcaagaggtagtggagtgggctgggtgggaacagaaaagggagtgacaaaccattgtctcctgaatatattctgaaggaagttgctgaaggattctatgttgtgtgagagaaagagaagaattggctgggtgtagtagctcatgccaaggaggaggccaaggagagcagattcctgagctcaggagttcaagaccagcctgggcaacacagcaaaaccccttctctacaaaaaatacaaaaattagctgggtgtggtggcatgcacctgtgatcctagctactcgggaggctgaggtggagggtattgcttgagcccaggaagttgaggctgcagtgagccatgactgtgccactgtacttcagcctaggtgacagagcaagaccctgtctcccctgaccccctgaaaaagagaagagttaaagttgactttgttctttattttaattttattggcctgagcagtggggtaattggcaatgccatttctgagatggtgaaggcagaggaaagagcagtttggggtaaatcaaggatctgcatttggacatgttaagtttgagattccagtcaggcttccaagtggtgaggccacataggcagttcagtgtaagaattcaggaccaaggctgggcacggtggctcacttctgtaatcccagcactttggtggctgaggcaggtagatcatttgaggtcaggagtttgagacaagcttggccaacatggtgaaaccccatgtctactaaaaatacaaaaattagcctggtgtggtggcgcacgcctatagtcccaggttttcaggaggcttaggtaggagaatcccttgaacccaggaggtgcaggttgcagtgagctgagattgtgccactgcactccagcctgggtgatagagtgagactctgtctcaaaaaaaaaaaaaaaaaaaaaaaaaaaaactgaaggaattattcctcaggatttgggtctaatttgccctgagcaccaactcctgagttcaactaccatggctagacacaccttaacattttctagaatccaccagctttagtggagtctgtctaatcatgagtattggaataggatctgggggcagtgagggggtggcagccacgtgtggcagagaaaagcacacaaggaaagagcacccaggactgtcatatggaagaaagacaggactgcaactcacccttcacaaaatgaggaccagacacagctgatggtatgagttgatgcaggtgtgtggagcctcaacatcctgctcccctcctactacacatggttaaggcctgttgctctgtctccaggttcacactctctgcactacctcttcatgggtgcctcagagcaggaccttggtctttccttgtttgaagctttgggctacgtggatgaccagctgttcgtgttctatgatcatgagagtcgccgtgtggagccccgaactccatgggtttccagtagaatttcaagccagatgtggctgcagctgagtcagagtctgaaagggtgggatcacatgttcactgttgacttctggactattatggaaaatcacaaccacagcaagggtatgtggagagggggcctcaccttcctgaggttgtcagagcttttcatcttttcatgcatcttgaaggaaacagctggaagtctgaggtcttgtgggagcagggaagagggaaggaatttgcttcctgagatcatttggtccttggggatggtggaaatagggacctattcctttggttgcagttaacaaggctggggatttttccagagtcccacaccctgcaggtcatcctgggctgtgaaatgcaagaagacaacagtaccgagggctactggaagtacgggtatgatgggcaggaccaccttgaattctgccctgacacactggattggagagcagcagaacccagggcctggcccaccaagctggagtgggaaaggcacaagattcgggccaggcagaacagggcctacctggagagggactgccctgcacagctgcagcagttgctggagctggggagaggtgttttggaccaacaaggtatggtggaaacacacttctgcccctatactctagtggcagagtggaggaggttgcagggcacggaatccctggttggagtttcagaggtggctgaggctgtgtgcctctccaaattctgggaagggactttctcaatcctagagtctctaccttataattgagatgtatgagacagccacaagtcatgggtttaatttcttttctccatgcatatggctcaaagggaagtgtctatggcccttgctttttatttaaccaataatcttttgtatatttatacctgttaaaaattcagaaatgtcaaggccgggcacggtggctcacccctgtaatcccagcactttgggaggccgaggcgggtggtcacaaggtcaggagtttgagaccagcctgaccaacatggtgaaacccgtctctaaaaaaatacaaaaattagctggtcacagtcatgcgcacctgtagtcccagctaattggaaggctgaggcaggagcatcgcttgaacctgggaagcggaagttgcactgagccaagatcgcgccactgcactccagcctaggcagcagagtgagactccatcttaaaaaaaaaaaaaaaaaaaaaaagagaattcagagatctcagctatcatatgaataccaggacaaaatatcaagtgaggccacttatcagagtagaagaatcctttaggttaaaagtttctttcatagaacatagcaataatcactgaagctacctatcttacaagtccgcttcttataacaatgcctcctaggttgacccaggtgaaactgaccatctgtattcaatcattttcaatgcacataaagggcaattttatctatcagaacaaagaacatgggtaacagatatgtatatttacatgtgaggagaacaagctgatctgactgctctccaagtgacactgtgttagagtccaatcttaggacacaaaatggtgtctctcctgtagcttgtttttttctgaaaagggtatttccttcctccaacctatagaaggaagtgaaagttccagtcttcctggcaagggtaaacagatcccctctcctcatccttcctctttcctgtcaagtgcctcctttggtgaaggtgacacatcatgtgacctcttcagtgaccactctacggtgtcgggccttgaactactacccccagaacatcaccatgaagtggctgaaggataagcagccaatggatgccaaggagttcgaacctaaagacgtattgcccaatggggatgggacctaccagggctggataaccttggctgtaccccctggggaagagcagagatatacgtgccaggtggagcacccaggcctggatcagcccctcattgtgatctggggtatgtgactgatgagagccaggagctgagaaaatctattgggggttgagaggagtgcctgaggaggtaattatggcagtgagatgaggatctgctctttgttagggggtgggctgagggtggcaatcaaaggctttaacttgctttttctgttttagagccctcaccgtctggcaccctagtcattggagtcatcagtggaattgctgtttttgtcgtcatcttgttcattggaattttgttcataatattaaggaagaggcagggttcaagtgagtaggaacaagggggaagtctcttagtacctctgccccagggcacagtgggaagaggggcagaggggatctggcatccatgggaagcatttttctcatttatattctttggggacaccagcagctccctgggagacagaaaataatggttctccccagaatgaaagtctctaattcaacaaacatcttcagagcacctactattttgcaagagctgtttaaggtagtacaggggctttgaggttgagaagtcactgtggctattctcagaacccaaatctggtagggaatgaaattgatagcaagtaaatgtagttaaagaagaccccatgaggtcctaaagcaggcaggaagcaaatgcttagggtgtcaaaggaaagaatgatcacattcagctggggatcaagatagccttctggatcttgaaggagaagctggattccattaggtgaggttgaagatgatgggaggtctacacagacggagcaaccatgccaagtaggagagtataaggcatactgggagattagaaataattactgtaccttaaccctgagtttgcgtagctatcactcaccaattatgcatttctaccccctgaacatctgtggtgtagggaaaagagaatcagaaagaagccagctcatacagagtccaagggtcttttgggatattgggttatgatcactggggtgtcattgaaggatcctaagaaaggaggaccacgatctcccttatatggtgaatgtgttgttaagaagttagatgagaggtgaggagaccagttagaaagccaataagcatttccagatgagagataatggttcttgaaatccaatagtgcccaggtctaaattgagatgggtgaatgaggaaaataaggaagagagaagaggcaagatggtgcctaggtttgtgatgcctctttcctgggtctcttgtctccacaggaggagccatggggcactacgtcttagctgaacgtgagtgacacgcagcctgcagactcactgtgggaaggagacaaaactagagactcaaagagggagtgcatttatgagctcttcatgtttcaggagagagttgaacctaaacatagaaattgcctgacgaactccttgattttagccttctctgttcatttcctcaaaaagatttccccatttaggtttctgagttcctgcatgccggtgatccctagctgtgacctctcccctggaactgtctctcatgaacctcaagctgcatctagaggcttccttcatttcctccgtcacctcagagacatacacctatgtcatttcatttcctatttttggaagaggactccttaaatttgggggacttacatgattcattttaacatctgagaaaagctttgaaccctgggacgtggctagtcataaccttaccagatttttacacatgtatctatgcattttctggacccgttcaacttttcctttgaatcctctctctgtgttacccagtaactcatctgtcaccaagccttggggattcttccatctgattgtgatgtgagttgcacagctatgaaggctgtacactgcacgaatggaagaggcacctgtcccagaaaaagcatcatggctatctgtgggtagtatgatgggtgtttttagcaggtaggaggcaaatatcttgaaaggggttgtgaagaggtgttttttctaattggcatgaaggtgtcatacagatttgcaaagtttaatggtgccttcatttgggatgctactctagtattccagacctgaagaatcacaataattttctacctggtctctccttgttctgataatgaaaattatgataaggatgataaaagcacttacttcgtgtccgactcttctgagcacctacttacatgcattactgcatgcacttcttacaataattctatgagataggtactattatccccatttcttttttaaatgaagaaagtgaagtaggccgggcacggtggctcacgcctgtaatcccag

SEQ ID NO: 61515 - DNA, 4861 bp, Homo sapiens
gtctcaatattagagtctcaacccccaataaatataggactggagatgtctgaggctcattctgccctcgagcccaccgggaacgaaagagaagctctatctcccctccaggagcccagctatgaactccttctccacaagtaagtgcaggaaatccttagccctggaactgccagcggcggtcgagccctgtgtgagggaggggtgtgtggcccagggagggctggcgggcggccagcagcagaggcaggctcccagctgtgctgtcagctcacccctgcgctcgctcccctccggcacaggcgccttcggtccagttgccttctccctggggctgctcctggtgttgcctgctgccttccctgccccagtacccccaggagaagattccaaagatgtagccgccccacacagacagccactcacctcttcagaacgaattgacaaacaaattcggtacatcctcgacggcatctcagccctgagaaaggaggtgggtaggcttggcgatggggttgaagggcccggtgcgcatgcgttccccttgcccctgcgtgtggccgggggctgcctgcattaggaggtctttgctgggttctagagcactgtagatttgaggccaacggggccgactagactgacttctgtatttatcctttgctggtgtcaggaagttcctttcctttctggaaaatgcagaatgggtctgaaatccatgcccacctttggcatgagctgagggttattgcttctcagggcttccttttccctttccaaaaaattaggtctgtgaagctcctttttgtcccccgggctttggaaggactagaaaagtgccacctgaaaggcatgttcagcttctcagagcagttgcagtactttttggttatgtaaactcaatggctaggattcctcaaagccattccagctaagattcatacctcagagcccaccaaagtggcaaatcataaataggttaaagcatctccccactttcaatgcaaggtattttggtcctgtttggtagaaagaaaagaacacaggaggggagattgggagcccacactcgaattctggttctgccaaaccagccttgtgatcttgggtaaattccctaccacctctggactccatcagtaaaattgggcgtggactaggtgatctcatagatccttcctgctggaacattctatggcttgaattatattctcctaattattgtcaaaattgctgttattaagtatctactgtgtgccaggcactttaaataaatattgtgtctaatcttcaaaacaaatttgcaaggaaggtttttggagataaggaaactgagactcaggattaagtaacacacctaaagtcacaggtgagcttggaactgaacccaagtgtgcccccactccactggaatttgcttgccaggatgccaatgagttgtagcttcatttttcttagagactttcctggctgtggttgaacaatgaaaaggccctctagtggtgtttgttttagggacacttaggtgataacaattctggtattctttcccagacatgtaacaagagtaacatgtgtgaaagcagcaaagaggcactggcagaaaacaacctgaaccttccaaagatggctgaaaaagatggatgcttccaatctggattcaatgaggtaccaacttgtcgcactcacttttcactattccttaggcaaaacttctccctcttgcatgcagtgcctgtatacatatagatccaggcagcaacaaaaagtgggtaaatgtaaagaatgttatgtaaatttcatgaggaggccaacttcaagcttttttaaaggcagtttattcttggacaggtatggccagagatggtgccactgtggtgagattttaacaactgtcaaatgtttaaaactcccacaggtttaattagttcatcctgggaaaggtactctcagggccttttccctctctggctgcccctggcagggtccaggtctgccctccctccctgcccagctcattctccacagtgagataacctgcactgtcttctgattattttataaaaggaggttccagcccagcattaacaagggcaagagtgcaggaagaacatcaagggggacaatcagagaaggatccccattgccacattctagcatctgttgggctttggataaaactaattacatggggcctctgattgtccagttatttaaaatggtgctgtccaatgtcccaaaacatgctgcctaagaggtacttgaagttctctagaggagcagagggaaaagatgtcgaactgtggcaattttaacttttcaaattgattctatctcctggcgataaccaattttcccaccatctttcctcttaggagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaaggtgggtgtgtcctcattccctcaacttggtgtgggggaagacaggctcaaagacagtgtcctggacaactcagggatgcaatgccacttccaaaagagaaggctacacgtaaacaaaagagtctgagaaatagtttctgattgttattgttaaatctttttttgtttgtttggttggttggctctcttctgcaaaggacatcaataactgtattttaaactatatattaactgaggtggattttaacatcaatttttaatagtgcaagagatttaaaaccaaaggcgggggggcgggcagaaaaaagtgcatccaactccagccagtgatccacagaaacaaagaccaaggagcacaaaatgattttaagattttagtcattgccaagtgacattcttctcactgtggttgtttcaattctttttcctaccttttaccagagagttagttcagagaaatggtcagagactcaagggtggaaagaggtaccaaaggctttggccaccagtagctggctattcagacagcagggagtagacttgctggctagcatgtggaggagccaaagctcaataagaaggggcctagaatgaaacccttggtgctgatcctgcctctgccatttctacttaagccagggtttctcatatgttaacatgcatgggaattccctgggcatcttcttgtggtgtggagtctgacttagcaagcctcgggtgggtttgagggtcaaatttctaccaggcttatatccctggtgatgctgcagaattccaggaccacacttggaggtttaaggccttccacaagttacttatcccatatggtgggtctatggaaaggtgtttcccagtcctctttacaccaccggatcagtggtctttcaacagatcctaaagggatggtgagagggaaactggagaaaagtatcagatttagaggccactgaagaacccatattaaaatgcctttaagtatgggctcttcattcatatactaaatatgaactatgtgccaggcattatttcatatgacagaatacaaacaaataagatagtgatgctggtcaggcttggtggctcatgcctgtattccctaaactttgggagcctaaggtgagaactccttgaactcctaaggccaggagttcaagaccagcctggataacatagcaagaccccatctctacaaaaaaccaaaaccaaacaaacaaaaatgatagtggtgcttccctcaggatgcttgtggtctaatgggagacagaacagcaaagggatgattagaagttggttgctgtgagccaggcacagtgctgatataatcccagcgctatgggaggctgaggtgggtggatcatttgaggccaggagtttaagaccagcctggtcaacatggtaaaaccccatctctacttaaaaatacaaaaaagttagccaggcatggtggcatacacctgtaacccagctactcaggaggctgaggcacatgaatcacttgaacccaggaggcagaggttgctgtgcaccactgcactccagcctgggtgacagaacgagaccttgactcaaaaaaaaaaaaaagaagtttgttgctatggaagggtcctactcagagcaggcaccccagttaatctcattcaccccacatttcacatttgaacatcatcccatagcccagagcatccctccactgcaaaggatttattcaacatttaaacaatcctttttactttcattttccttcaggcaaagaatctagatgcaataaccacccctgacccaaccacaaatgccagcctgctgacgaagctgcaggcacagaaccagtggctgcaggacatgacaactcatctcattctgcgcagctttaaggagttcctgcagtccagcctgagggctcttcggcaaatgtagcatgggcacctcagattgttgttgttaatgggcattccttcttctggtcagaaacctgtccactgggcacagaacttatgttgttctctatggagaactaaaagtatgagcgttaggacactattttaattatttttaatttattaatatttaaatatgtgaagctgagttaatttatgtaagtcatatttatatttttaagaagtaccacttgaaacattttatgtattagttttgaaataataatggaaagtggctatgcagtttgaatatcctttgtttcagagccagatcatttcttggaaagtgtaggcttacctcaaataaatggctaacttatacatatttttaaagaaatatttatattgtatttatataatgtataaatggtttttataccaataaatggcattttaaaaaattcagcaa

SEQ ID NO: 61516 - DNA, 15018 bp, Homo sapiens
cctttcagtgcagaagccctgggctgccagcctcaggcagctctccatccaagcagccgttgctgccacaggcgggccttacgctccaaggctacagcatgtgctaggcctcagcaggcaggagcatctctgcctcccaaagcatctacctcttagcccctcggagagatggcgatggatgtcacaaggagccaggcccagacagccttgactctggtaagggtcacaccaaagttagggactttgcactgggagagcagcacccagggcagggcccttggttttgcagattaccaaaactaaggctgggggcagggaaggcgagcaggcttggggcaccttggaaggaggcacatgggccttgggggtcctggctagggcagctgtgcctgccactggccctctgcccaccacccctcctcactgtggctatccagtgtccagcctctcgaggggttctagggtacttattcctggagctaacggtgacccaggacaccagtgtccggggcctggcctggggcttttatggggggagctggctggctgcccagggctgtctggctctctgggggctctgcatggcatttccaggggttggtggatcagggattctgtccctcaggagaatgtgggcactagcccaaggccactcacttctgtgtacatagccacctgagggcccaggaatggagggggccaggctacagctggacatctggcactcggatgggctctggagcccccaggcctgcagcatctgcccagggactgccctggcccttggccatttcctcagggacccacagctccaccagccggcccctcccagtgctggaatagacagttcctcagtccacatctgccaaaggcggcactagaaggcatcctgccttttttactgcgttctggaggtggggtcacaaagcactgctcactgcataaaagggacagcatcctgcccctggcagccctgcctgaccagctccgcctctcccactgctatccaacctgtacaccctggtgaccatgtccaggccagtggccttaaggactgtctctgtactgatggctccacatctacctctccagccagactctcctctgaactcgggcctcacatggccaactgctacttggaacaaatcgccccttggctggcagatgtgttaacatgcccagaccaagatcccaactcccacaacccaactcccaggtcagatggaacctcttcttcccaggcccttctgttcctctcctcagcccctcccacctcccttcagaataagtctagactcttatcgctttcaccaagcctgcgcccagcatccctgcacagggattgttaggacagcctgacgccctgcttccaccctgccccaagatgcccctgctctgcagcccggcgcctccaggcttctcacctcctgctgctcacagctcagcctcactccctccctccccgcctctgctccagcctcagtgcaggtcccctgctcccatcttctggcagcagctgcccgacctggtccctcttcatctgtccccattccttcaccccccagcctgtccccaacttgactgaggttctttcctgcagatccccgcccttgagaggggttggtcccactgtcaactctgcttctgtgccctgtgccgcacctggcattcagtgagcatctgctgaagagatgagggtcagatgccctgcagggagtgtgggggcgtcctcaggcaagaaaagttgtacgtttggctgtgggccctgattatgtgtcctgtgacctcttgggtgaggtcagcaagagaaacctctgcaagctggctggggctgcctcccagaggctgccagggggagggacaggctctgtctgtgctcttcttccgaggctacacctggggcgccaggctctcagggctccccaggtaccaccacatttcctacactgcttgggaaagccctgtaagtttgcacagacacccagcatgaggctcgccagagagatacttgtagctggggtctgggcaccaggaacagcttggtgctgggcctgaagtcgggcaggatgcagcctggccaggtgagaggaaagcttggagccagtgcctgggttcaaactcctctgtggcctatggttctgtgggcttggggaagggtttgtacctctgtgtccagtttcctcacttataaaaaaaggagataataaaagtacccatgtcccagggtggctgtagcaataatagggaggggtgcccagagcaggtctggcacacaggaagtgtgcatcagcctcagtccctgccattgggcttgtcctgggagtctgtgaagccaacctctgctccacaatgtgacccccaggcttgtgagaccaagctgggtcagagcttcctcctctggggttgcaccaggaggggaacttctgcaggcccagatgcaccctgaggaaagggcttgttcccaccaagaacaaggctcacctttggaggatgctccccacatgagaggtgaacccccaggtctactggtgactgcagcctcggaagctgacagcatctatcctccaacccatgcccactgggaagtgtgtgaggggtcctcataggccctgcggtgtggacaatgcagagaccctgtagcatctggctagggcggggcccagataagagccctgtgccaggagagcctggccggttctgccactgtggggagacaggctcccccaccccatgtcccctgcttccctgcagcccacagagaatacagacctacttttacagaaatccagatttttgtgtaaaagtgtctctattttaagtagattttaagtggtggcagcaaatttaagcttttgagaatattatacagaacaaatcagattcacaggccagatgcaactttatttacagaaatgggatcaggtcctacctcaggtcccatctcacgttttcacttatgcctatacgtctccttcacgggaaaggccacaagaggccctgcggtaagtgtcccggtgttgatttaaagtccccaacagtgaatatgagggtcctcactgttgcagcaagaggatacccccctgtgtatcttggaaatgcctgcagccctcttgctgcagaacagattcttaggagagaaactgtcagatcaaagttaaacttagagaaactccaaattgccctctgaacagacggtatcagtttgacatcatccaataccgggattcctcggggagaactttctggcctagaaggcagtagagccaggacttcacccagtcagtggcagggccacacgtgggccttgatacagagggggaagacttgagcctcctcgacaccctacagggcccagcctcccaacatgtgataagagaaacaacagccaacttgtacctagctctccttattctccaagggctgggccagttctccccacagccctgcaagggaggatcactcaagggccccaactgtctgacaatacagccacactctgatcagccacctgggcataggctccatgccattgtcctccgccaagacctcagactgaaatgttggctcctcccatgaagaacctggggccaaaggaccagagtccaggtccgtggctgccaggatgggccacttggagagaggcacaagggtggtgccaggcaggtgtgagggctggacctttgcaagagcagcatcacttttgttgagagcccacaggtatcttataattgggtcctaggacttcctgccagtagccattgtgtgcatggatttgggtgctggcctcaccatggtgtgctggctgcccatgcctgcaataatgacttctgtaagcctttcttcatctgcaagatgggtgctgctggcacctcctccccggtgctgtggtgacagggcatagtgtgtgaggctgctatgtgaagcacctaatgcagggcctggcatatggaggaattcagcaaatgacagatgccttcacagttagttcctggcatcctctacattggtgggtgtaggaaagaaagacagaggaggcaaaagttgtagctgtggggcattgaggacagcctggattgttccacagagccctgaggacatctccaggggtgtgctctgcaggggcagctggattggagggttaggggtcggggagggcgtgcactcccacccatgctcacagcctcggaacagtgcctgctcagccaacatgggtgtttgattctgtgtcttttgtcacagactttatcagccccatccctttctgaccttgcctcagtttaaattttacatgtggggcctcattaagagacatggttcttaactaaagatctgtatccattaggaatgctttgggctgcaggaagacaaacacctgactcactgtggcataagtggtttgcgtctgctcccataagctgcacgtggagggtggatctggcattactctctcttccctacatttgcagtatgctaacagctttaacctccagccttgtttcttcatggttgcagggtggctatcacagcgctggccatcacatccttacacagctgtgtttacaaatttagggggacattgaagctcctcccctgctaaaatcaggcttcccttcacctgtcattggccagaactgggtgaaatgcccaactctagaccgatcatcagtaagaggagtatagaattgctgtgcccaccttagattaatcatggcgcaatgtgctccccataccaacaaaatctgagttctagaaactgaggaagaagaggaaaatggccgtcttgcctcctggctgggattcagagcatctccaaccctctgagcttatgtgtaagactgtgggcaaaagtgtgtgagtttttgtggaatggatccacggcttttatcagagcatctttcctttttctttttgattcaagatgaaaatattcttatgattatttttctcaccactgcccagagataaccagcacattaacatggccttttctccatgaatagcactagggtgcccagtggacagacacatagctgtccacacaccagcttgctggggatgcataggcagagtcacatctgcactcacggcctgtcctcacactgccatgtggagagccagcagccacaccatgggccgtccatgctcacgggagtggcagtatcagatctgagcttcgtgtgcccaggcgtctctcacatcagtgcatagggaccctctttgttctgtggcccagtgtgcccatgccacagatggcttcagtcagcagacacctccttctagacactcacactcactcctggctggcccttagcacacctgtgcagacaggcccatttattttcttgtgtaaatcccaagtaggaggactgggtctctctgacagcaatgccagctgcctggcaccctccagacaggtggctcaagccccacctcgccagctctcccagttagcccctcctttccctggctctgacctgagggacgaagcagggtgctacaggacgctgtgccacagggatatcgtcagggacagaagctactctgccctctgctgctcacccctccaacacgctgtgggctgcatttgttgagtggctggtaccagactctgctcttctgactttccagctggttttacctgtagtaaagtttgagaagatgggtcatcctgaccccggggtcagaagacagaaggaggcccatggcgtgtgggggagatgccccgtgaggccctcggtgtgcagatgcctggtgacagccccaccctgaggtccccagcctaccccctccccagcccgactgctcccatccccctccctgtgcaggtagagcagatcctggcagagttccagctgcaggaggaggacctgaagaaggtgatgagacggatgcagaaggagatggaccgcggcctgaggctggagacccatgaagaggccagtgtgaagatgctgcccacctacgtgcgctccaccccagaaggctcaggtaccacatggtaaccggctcctcatccagaagcagctgtgggctcagccctagctgggagaagcaccccaggcactcccagactcacagccagcccgagacagaatctcctggggagcaatgaagtcctcgacttgggccagttctcacccttggctcctctggtccggccctggggcactcgggctcaccctggagctggcaaacctcaggaaaactggcgttttaaatctcactcctggccaggtgcagtggctcacccctgtaacttcaacactttgggaggccaaagcaggcggatctcttgaggccaggagtttgagaccagcctgcccaacatggtgaaaccccgtctctactaaaaatacaaaaattatccaggcatggtggcacattcctgtagttccagctactcgggaggctgaggcataagaattgcttgaacccgggaggccgaggttgcagtgagccaaaatcgcgccactgcactccagcctggggtgacagggtgagacaccatctcaaaaaaaaaaaaaaaaaaagacctcactgctccccatgggcacttagggaactctcccagcccagttctgcagctgggccattgcactagatcctcagttggtccctgggctctcggtgactgtccagggcaggagtttcccattgacttttccctggttgacctttgaccccttccacagttgacactggtgtccccaggtgtctggtggccccttgtccagctcccttagtcccttgtgccttccctcctcctctttgtaatatccgggctcagtcacctggggcccacccagcccaaggccagcctgtgggtgtccctgaggctgacacacttctctctgtgcctttagaagtcggggacttcctctccctggacctgggtggcactaacttcagggtgatgctggtgaaggtgggagaaggtgaggaggggcagtggagcgtgaagaccaaacaccagatgtactccatccccgaggacgccatgaccggcactgctgagatggtgagcagcgcaggggccggggcagggggccaaggccatgcaggatctcagggcccagctagtcctgacgggaggtgccacctgtctaccaggggtggggagagcgggggctggaggaccacccagcctcagaggcagctggaggcctgggtgaacaggactggccaacatgtccccaagtcccacagtcaccatctggccagcattgagaggggaacgggctgaggaagagttagtggcaagaggaaccccagccagtcacaccttgtccagtttaccagaggaaaaaccaatgtgtaagaacagaaatgtgacccggcagccagtgcactgcccccctctccaaaggccacccctcaccctccaccagcatgcacagaaagtggggtgacagcaatcacaatgtctacccaggcagcaaggacccctgaccatggggaggactggggtgcagggaacatagaagcagaatgaggcctagggggagttgggcaaggccagagccctagctgcagccaagcacatggccaaggccagctcctggaagggcagggctccgaggcaggaggcaggaggctgcccgtggctacccgtcctcacacccctgcagcttgctagtctgtctgtgggctgggtgtgaatcaaggcagtgggatggtgtggggacctccctggccccagcagccagtgaggagcctggtcagtcagcagagcattcagcagtatccagttccatggagaggcccgtgtgaggggagtcggggctggtcttcagtaaggatgggtggccagggcccctagaagtagaaaaggagactccgggtgctggagacagaaatcaaggatgtgcctccatgtggagcctcaggaatagctggccaggcctgaggctgaacctcacaaggttcagctgggagggctaggctgacagagcacagccgggccagggaccagcctgccctgtgttgccttgtcccgagggccactgtcagcaggtctctggcatgggggaggcttagggcctgagcccaacaagcagcagcggaagaggagagggaaactgtggacaggcctggcattcagtggccaggtgttgcagtgtccctgaggaatagcttggcttgaggccgtggggagggctgccggccagcgcacccccccatgccagatggtcaccatggcgtgcatcttccagctcttcgactacatctctgagtgcatctccgacttcctggacaagcatcagatgaaacacaagaagctgcccctgggcttcaccttctcctttcctgtgaggcacgaagacatcgataaggtgggccgggtggaggggcagaaggcagatgaggggaggcacaggcaccccagaggaactctgccttcaaatgtagcccccataccatgtgctcagaagggagatctggattcaaattgtggccatgtcacctgccacctctaatgctgtggaaaagaagcatcacattagctaattctggctgtgcgccttgtgaggcaccagctatgatcaccccactccagtggaaagagcagctggcagtagggtggggctcaaactcaggcagccgggctctgggtcacctgcaggccacggtcatgtcacactgcctctagctgagtcagaaatgtgaaggaactgagattctacccttcctgcaagctagcaaagtggcctgccagttacatctgtgcatgcacacacacacacagttatatatgcacacacataaaacacgagacctttgggtcagggagaaagccagatcctcactcacggcagaagcagcagccaaagcaacatctcatgtggttttccaagccccagtccctacagagacagagagggccaggtggcacctgtgcatgcagcggggtaccttgcaggagggaaatcctgattttacacaaagctgctccccccacgccctgccttgactctgggatgacgtctcagagctgtgcagtacaacattcttaaattggctgggactcagccctgcagaaatatgatatcttcaaggagaatcgttcccaaaacctctcaaagctatggggctgctctgagcctgtttcctcagctgtaaagtagggtgcatacttttatggccctgtgcaggaggtagtgacaggccctagcaccctgcctccagtatatgttagcagccacgaggcctatctctccccacagggcatccttctcaactggaccaagggcttcaaggcctcaggagcagaagggaacaatgtcgtggggcttctgcgagacgctatcaaacggagaggggtgagggggcacctgtacctgccgggggggctgccctgggccacccaccccagcactgcctgcctttctccttggcttccagcactgcagcttctgtgcttcttggcaggactttgaaatggatgtggtggcaatggtgaatgacacggtggccacgatgatctcctgctactacgaagaccatcagtgcgaggtcggcatgatcgtgggtaagggctccttgcacccctgccccttccagactgctgaggctccctgtgtacaacaggcttcaagggccctgtggggtgaggaccaaactacttaacaaccggtgatgtcagagcagagcctggtgctacagcctgggtggtcttggggtatcaagatggaagcaccgtgtacagtaggaagcatttcaacgccatgatgccacattcctgcatcagatggtatgccagctgcatatccacctcacccatcaggattataattaaaacacttatctggtaaattgaccaactggacagattggtccaagtggaagaggataagcaaaagtggtaccatctccacccgaatggtctttccacgggcctgcccctgcccctgcccccacccaaagtgaaggcaggtaccaggaaagggagcagcagtccgcccctcccagcagaggggtcttccacaccaactcggacctttctcagaagttccggaggtcattataaccagccttcactgaggagcaatccaatcagatcagttatctgctgtgcgcacagccgtgtggttctatacttctcttacttccattttcacctttcagaaggaacgttgtctttaaatccagcatctaaacgtgagccccagccatccctggctgtgatccccccagccctttccaccctatcctctggaactgcctggggctccccaagacacttccacatgaattcccaccaagccaagctgcagctgctgggcccaggcataacccctcctggggcagaggtggcaaggagtgacccaccactcacatctgccccacatccactcttgactctgctcagtgtttaaaaacatgtttataacaattaccaagatctgaaaattaggagaattcacatcaaagtctggatttctgtttgttcataaaaaactagaaggcagccaggcaaggtggctcacgccagtaatcccaacactttgggaggctaaggcaggcgggtcacttgaggtcaggatttgaagactagctggccaacaaggtgtaacctcgtctctactaaaaatacaaaaattagctgggtgtgatggcgcatgcctgtaatcccaggtactcaggagactgaggcaggagaattgcttaaaccctggaggcagaggttgcagtgagccaagatcacgccactgcactccagcctgggtgatggagtgagtgagactctgtctccaaataaataaataaataaataaaaactggaagtctaagcatcactgagccctgattcctatgtggcagctcgactgaccagcatttgagttgctgtccctgacagctttgggggtgtgcagcccacacagtcatgctagcttgaggctctgctgtcagcagtttgaaactcttaataacttgtgaacaaaagactccatgttgtcactctgcacaggggccagcaaattacaaaattccatatccggaattgtctacaggagcctctgggctgctcccaagggcccacaccatgccttactcactttgggttgccatccaaacatgtctcatgacaaagaagctcaaacatgtgcatggacagtgccagaaaacaagggtcgtacatagacaaaataaaatgataacgtcccacaaccatttctttgatacacactgtttctctcagtcctcccaaccacctaggtaacaggcagggaaggtgttactgttgcctgttaggaaagaggacagccctgaaagctgtccctggccactgaagcaacccaggtcttccagccccagggagagccgcctttccattgttccagacaaagcagagacaggcatgggggagcgggagagggactcctgtgggcaggaaccaggccctactccggggcagtgcagctctcgctgacagtccccccgacctccaccccaggcacgggctgcaatgcctgctacatggaggagatgcagaatgtggagctggtggagggggacgagggccgcatgtgcgtcaataccgagtggggcgccttcggggactccggcgagctggacgagttcctgctggagtatgaccgcctggtggacgagagctctgcaaaccccggtcagcagctgtaaggatgcccccctcccccacaacccaggccctgggccgctctggtgcagcggcagatgggagccgggccattgcagataatgggcttgtttttaaacaactctggggaaaagcaaactgacaatccgttcgtaagctccatcccttctgctcagtcatgacctgcccctgtgagagatgaagggttagtcccagttgtgatgtgataagcccagacctctttccttccgacaggtgatcgtgcatgcagaggaggctctgagacgcccccagcaaggttcctgggtttaacccaacattccccaaagtatgtatttggccacattcacagaaagaatattagtcttttgtggaatgctgcgggttgacagtcacagcttggaaaccaacccacagagagctcatcattaatcatggctatcacttgtttaccacctactgtgccaggcctatgctaattactttattagcgtcctctctgccgctcgcaggcctctattattataggtcagtagtattcgatttatttaaattaaatacggaaggtcatagattaagcaagaaagtgccagcaacatggtgcgtgcctctgactgggcactaaccctccaagtcttagttttcccaaccataactggccaatgaacagcagctctggatgcagctaaaggaagactgaagctgtaggtcccgtgctcggcgcagggccccctgcaaggaaggtttcggagggactggatggggtctttgaactatctgtctttccctttactgcagtgggcccaggggcaggccaaagttgctcccgtgattgacttgaacgtgcacgttcctaatccctgacatttctaaagctctggctcattaacgagggaaagacgtgaaccagctgggggagtggggatcgcagtgccccacgtggccgcctcgtgacctcagtggggagcagtggggccggctcccggcttccacctgcatgaggggccctccctcgtgcctgctgatgtaatggacctgccctatgtccaggtatgagaagctcataggtggcaagtacatgggcgagctggtgcggcttgtgctgctcaggctcgtggacgaaaacctgctcttccacggggaggcctccgagcagctgcgcacacgcggagccttcgagacgcgcttcgtgtcgcaggtggagaggtgtgcggaggaggagggtgggtgcaaagggcaggggctggggacgcccgggcactgcagacttggtctcagggcgacgctgagtcccaggcccggggcgcagggatgggaaactagggcctggggcgggattccgggcgtgggcggggcccggggcggggcacagggggcgggggagtgggcggggcccgaggccgggcgctggaggcgagggcggggcagggacgggtccaagggcaggaggctgggacaggacggggatgcaaagggaggggcggggcccgagacggggaggagggggagggcccaaggggaggaggcggggtccggacggggatgccaagagcagggatgggagcgagcctgcgtccgggcactggtccccatccgtgagtcccctcggtgctccctgcccgccgtggccatcctctcacatcactcacaaccccaaggcgcggcatggttgacacccccacgttaggacggagaccctgggcttagttagagggggcagtactaaccagtccctggcggaaacgctttggctgggtgaggtgagcgggatcgcccccatttctccagagaggggtcccggctcagcgagggaaagaggccgccgctggggggacggctggccggggcccctccctggagaacgagaggccgccgctggagggggatggactgtcggagcgacactcagcgaccgccctacctcctcccgccccgcagcgacacgggcgaccgcaagcagatctacaacatcctgagcacgctggggctgcgaccctcgaccaccgactgcgacatcgtgcgccgcgcctgcgagagcgtgtctacgcgcgctgcgcacatgtgctcggcggggctggcgggcgtcatcaaccgcatgcgcgagagccgcagcgaggacgtaatgcgcatcactgtgggcgtggatggctccgtgtacaagctgcaccccaggtgagcccgccccgctctctccctggtaaagtggggcccaaaaagcgcgcgctccaaggttccttgcggttcccaagctccaagatttcgtagtcctcttctcgtcccccttggcctagatttgggggaagggtcgactgcgtgcagggcgcccggtaatgaatgtggaggatgaggtgggaggagggacggcagccctgcttctcttctgcccagcttcaaggagcggttccatgccagcgtgcgcaggctgacgcccagctgcgagatcaccttcatcgagtcggaggagggcagtggccggggcgcggccctggtctcggcggtggcctgtaagaaggcctgtatgctgggccagtgagagcagtggccgcaagcgcagggaggatgccacagccccacagcacccaggctccatggggaagtgctccccacacgtgctcgcagcctggcggggcaggaggcctggccttgtcaggacccaggccgcctgccataccgctggggaacagagcgggcctcttccctcagtttttcggtgggacagccccagggccctaacgggggtgcggcaggagcaggaacagagactctggaagccccccacctttctcgctggaatcaatttcccagaagggagttgctcactcaggactttgatgcatttccacactgtcagagctgttggcctcgcctgggcccaggctctgggaaggggtgccctctggatcctgctgtggcctcacttccctgggaactcatcctgtgtggggaggcagctccaacagcttgaccagacctagacctgggccaaaagggcagccaggggctgctcatcacccagtcctggccattttcttgcctgaggctcaagaggcccagggagcaatgggagggggctccatggaggaggtgtcccaagctttgaatacccccagagaccttttctctcccataccatcactgagtggcttgtgattctgggatggaccctcgcagcaggtgcaagagacagagcccccaagcctctgccccaaggggcccacaaaggggagaagggccagccctacatcttcagctcccatagcgctggctcaggaagaaaccccaagcagcattcagcacaccccaagggacaaccccatcatatgacatgccaccctctccatgcccaacctaagattgtgtgggttttttaattaaaaatgttaaaagttttaaacatg

SEQ ID NO: 61517 - DNA, 17554 bp, Homo sapiens
gacgccatcccggccagaaaagccctggccagtggcgggcgcgacactatccgtgcggccaggcggaggtgagtgcgcggcggccggatgggcgggacgggcgtggaggacgccgagcaccgtggcgcgcgctcacgtccgcgtccccaagggctgcgctccctcaagcgcagtgcccagaactcggagccagcccggcccgggggaccctgctggccaaggaggtcgtcagtccggtcttgtcttccagacccggaggaccgaagcttccggacgacgaggaaccgcccaacatggcctcggaggtgagtgggacctcggggactccggtcctcctagcctccaaaggagagagtgggggcgccagacctgcctcgggccaccctgctgggaatcgccctccaggaagcaattttgaaaattacctaggaagcctgcacccccagccctcccgggcgcatcatctggagcccagcagtcacctttaccaggactcaccagtatccgcaggcagcccttgtggcaaacccaccaacccacactactaggggtagagtggctctgccctcacctcacagtgatgcctgcctggccaggaaaagtggctcccaagccttcagccttccaactcttccttccttcttaccacgtgtcctcctgtcaggtcccaccccacaccacatcccttctcctgctagagcaattgtccctgtttatagaataaagctcagcccctaagtgttcttgtccttgactgtggcatgtggaaagagccaggaaaaaggggacgtcgcctcgtggctccagcaaccctggtgcctggtcccttcctgtctcactggaccctgcctcttagggtcagtggctcctggcctctcctcctgaccactgagatgctggattcccaggcagaggttttccttccttgggccatagttgatttatctggcaatgggggtaataatagctgtcggcctcactctgtaaggcactagattatgaggccattgctttggacccttcaggtgagaggggctgttcgcctgatgcttgatgaagggaactccgggaagcaggaggtctgggttccaggcccttttggccttcattagctagcaattcacttcctctttctcaatgccctgcaagctcagtgccctgcaagcttctgggtcatggcaggggggtagggcctggactttggagccaaacagacttggtttctgtaccagtcacttgagccctttaaacctctttcctcatttgtgaaataggggtaatattgcccacctcataaaaggccgtaataacatatgtgaaatccctagcacagggctgagcaacagtaggtgctcaataaatggtggctaaccacaacaatactgatatttctactttgggaggccgaggcgggaggactgctgaagcccaggaattccagaccagccagggcaatgtaatgagaccctgtctctacaaaaagattttgaaaattacccaggtgtggtggcgtacacctgtagtctcacaggaggcggaggcatgaggattgcttgagcccaggagtttgagactgcagtgagcatgatctcaccactgcactccagcccaggcaacagagtgagatccagtttcaaaaaaataaaaataaaaaaacctggcaggcatggtggctcacacctgtaatcccagcactttgggaggtcgaggtgggcagatcacctgaggtcaggagtttgagaccagcctggccaacatggtgaaaccccgtctctactaaaaatgcaaaaattagctgggtgtagtggtgggtgcctgtagtcccagctattcgggaggctgaggcaggagaatcgcttgaactcgggaggcggaggttgcagtgagctgagatcgcaccactgcactccagcctgggcgacaaagcaagactccacctcaaaaaaagaaaaaaaacccacaagtcccaaaaccaaaactggtatttcccatgtacattcgaccttaactgttgctcattcaacccagcccaactcagtgccccatcccctggccctgaagagaccattctggcccagatgtgtcctggcttggagtagcaccttctgctaccacactaggcctccactctcctcagtgcccaaggggaggcacctcactctgatctccctgtggggtcctcttatgcctgccagtaaggataggagtttggttctagagcagagtggtctggcttccaacaagcccagtgttctaggtgacctcaggttgccccaggccttcctgtaggttggcactaattggtttggctgcagctccacttattaagtagttatttttattactaacaacctaggcagggtggcccaggagcccgctgggggaggcggtgccaggctcctggctgaggggcaggctggccccaattctgactggctggctccagtgatcaggaccagggccccacgtggtgctttgctggagatctaggcttggtggggcagctgtggggtaaggggcaggaccagctcaaagatggggtgggggcggaggctgcctctgcagggcagagtcctttggcagtcgggactgttgggcatagaggagtcagctcacagctcagggccagagcactggagaggtctctggggtgcatacaggaaccaggagtggagctgaagcatgtcctatcccctgccagccctcccttagtaacagctggcatttctcgagtccttcctgagcaccaggcaccgtgttatgtatgcaatttgcaaatattatctgattaaatgctcacaataaggctatcagagaggtactattattatccttatcttattattattattattattatttttaagaaggagtcttgctctgtcgcccaagctggagtacaatggcgccatctctgctcaccgcaacctctacctccaggattcaagtgattctcctgcttcagactcccaagtggctgggactacagcttcctgccaccgcgcctggctaatgtttatatttttagtacagatgaggtttcaccatgttggccaggctgatctcgaactcctgacctcaagcgatccacctgcctgggcctcccaaccctgagggtttttgtttttgtttttgttttgagacagagtcttgctctgtcgcccaggctggagtgcagtggcacgatctcagctcactgcaagctccgcctcccgggttcacgccattctcctgcctcagcctcccaagtagctgggactacaggcgcccaacacccccatgcctggctaatttttttgtgtgtgttttcagtagagacggagtttcaccatgttagccaggatggtctccatctcctgacctcgtgatctgcccacctcagcctcccaaagtgctaggattataggtgtgagccaccacgcccagcccctgaggtttaataataggtgccaggccaggtggttaatagaagtctggggcattgtagggggacagaggaggatatatgtccccattggccattgtagactcccttccacaaaaaggacgtcagtgaagtgacatgcccacctctaccccaccctcctcccagtcctgggcactagggctgctccccaggtgttctgtaccccctccccactctgtcccatgccctggcctctgccctctttcaaaacatagatgtggctggcgcctaggctcatgcctataatctcagcactttgggaagctgaggctggaggacagcttgagcccaggaattcaagaccagcctgggcaacatagtgagaccctgtctctaccaattattttattttattttattttgttcatttatttatttattttgagacagagttttgctctgtcacctaggctggagtgcagtggcgtgatcttggctcactgcaacctccgcctcccgggttcaagcgattctcctgcctcagcctcctaagtagctggaactacaggcgagtgccaccacgcctggctaatttttgtatttttagtagagaccaggtttcaccatgttgaccaggatggtctctgtctcctgacctcatgatccacccaccttagccttccaaaatgctgggattacaggcatgagccaccactcccagtcctataaaattttaaaaaaatgtctgggtgtggtggcgcatgcttgtagtcccaactattggggaggctgaggcaagaggattggttgagaccaggagtttgaggctgcagtgagctatgatggtgccaccgcactccaacctgggtaacaaagtgagaccctgtgtctaaaaaagaatttaaaggccgggtgtggtggctcacacccgtaatcccaggactttgggaggccgaggtgggcagatcacgaggtcagattaagaccatcctggctaacaaggtgaaaccacgtctctactgaaaaaaaaaaatacaaaaaattagccaggcatggtggtgggcacctgtagtcccagctactcaggaggctgaggcaggagaatggcgtgaatctgggaggtggagcttgcagtgagccaagatcctgccactgcactccagcctgggtgacaaagagagactccatctcaaaaaaaaaaaaaaaaaaaaagaattaaaaaagatttttttaatgaacaaaacaggctcggcacagtggctcatgcctgtaatcccaagcacttcgggatgccaaggtcaggggatcacctgagatcaggagttcgagaccagcctgaccaacatggtgaaaccccgtctctactaaaaatataaaactcagccaggtgtggtggcacacgcctgaaattccagctactcgggaggctgaggcaggaaaattggcttgaagccgggaggtggaggttgcagtgagccgagatcacgccactgcactccagcctaggcaacagagtgagactctatctcaaagaaaacgaacaaaacatagatgcctacataccattcctctgcccttggctcctggggagtaagggatcacccagtgacctcctagaaggccagtgacaatggggggtgtcagggtgcttttcagagccaagggagtggtaggaattgggatcttagtccagctccaagctgtgagggagagagttgcagggcacttaagcttggtggagaccctcaaggcctctttgcctgtccctgcagcaaaggttctggacaccagagccaagtccagaagccctggtggaacaggggtgaaaagcataggttctgacttcagactgctgggccgcagccctggctatcccaccccaggtgagagcaggctgctctgtgcctcagtttccccatcttcatagtggaattgtattggtgcctacccagagggttgtgtcaacaattaggatggcacctagcaccttggtcagtggtgggaaaggttccagaagttctgctgtggtcccaggggtgtctcaggccctgccatcatctccttggaggggtgccatgtggtgggaaagaaccccaacttcaaggccacacacagtggctcatgcctgtaatcctagcactttcagaggccaagatgggaggatcacctgaggtcaggagttcaagaccagcctggccaacatggtgaaaccccatctctactaatgatacaaaaattagctgggtgtggtggcacgtgcctgtaatcccagctacttgggagtctgaggcaggagaatctcttgaacctgggaggcagagtttgcagtgagctgagatggcaccactgtactccagcctggccgacaaagtgagactctgtctcaaaaaaaaaaaaaaagaacccaaacttttggtgttcagccatgttcccatgctcactcccagggtggtgactctgggaaggtctcagcctccttgtctgcccagttagaatgatctgatgcccctgctaccatcagacttgataagtttcccaaagactctttgcaagaagcactgttctggagggtggaggagagactaattgttcttgctctcctggccagagtgggaagctttggggtggccggtttgtgggtgcagtggaccccatcatggagaagttcaacgcgtccattgcctacgaccggcacctttgggaggtggatgttcaaggcagcaaagcctacagcaggggcctggagaaggcagggctcctcaccaaggccgagatggaccagatactccatggcctagacaaggtacttgccgtggcccaagccccacccaaggccccttccctgtggccccaggctcccaccaaatccctgagcaaacagtgcagtgttgcccatctgtggtttcacattgaactaattatatactcaagtgctgtttaactgtgtgccttgatgactgcctctctccatcctttaatgacccctgtggcccacatggctcatgggtaaaggtgtgctgggcctgagatgccccctcccagggtgcgcttccaggactcagctcctgggcagggacagtcagtcaccagggatagggtgggaccaaggcaggggctctcttggctgctgatgcctgctcacctgaccccggcattgctgctacccactacaggtggctgaggagtgggcccagggcaccttcaaactgaactccaatgatgaggacatccacacagccaatgagcgccgcctgaaggtacgacccctggagccccaccgctttccttgcctcccctctccaccttgcccagggccactttgagcattagcaccattctgtttacttcgccattggcagacagcatgtgagacctcaggacatgagccaggcaccctggctcatgcctataatcctagcactttgggaggctgaggtgggaggattgcttgagaccaggagttcgagaccagcctgggcaacataatgaggtcccacagctacaaaaattaaaaaaagaaaagaaaaaaagaacaggcctcagcagaaatggcgagagatttggggaggacccggagccctggggtatggaggtaggttggcagggctgatgaggaaaactgccctgcctgggttgactcctctgggggtatagaccgtgaccctgggtctcccttcacctccaggagctcattggtgcaacggcagggaagctgcacacgggacggagccggaatgaccaggtgctttagcccctccaccccctgctccgtgttgtcccaaccttgaggagcccagggggcagttagagttctgcagcggtcctggctcctcagggaagcaacacatcggcctccctgagcaccatctcctccttgcacaggtggtcacagacctcaggctgtggatgcggcagacctgctccacgctctcgggcctcctctgggagctcattaggaccatggtggatcgggcagaggcgtgagtcctacagggacacccagggggcagacagaggtgtgatggaagcctgaacaggagacctagggggcaggggtgaacagcgtgggggtgccaggccctgggggacaggggcatcccagaactccaggatcgaggcagagcagccaggagtgggccatttcctgcaggccccaatactcccatgccagtctagctcagcaggcagagaagactaacccttcgtggggctgggtgcggtggctcacgcctgtaatctcagcactttgggaggccgaggtgggtggatcacctgaggtcaggagttcgagaccagcctggccaacatgggaaaactctgtctctactaaaaatacaaaaattaggcaatgtggtggtgtgcgcctgtaatcccagctactcgggagcctgaggcagaagaactgcttgaacccgggaggaggaggttgcaatgagccgagatcgcgccattgcactccagcctgggctacagagcgagactcctgtctcaaaaaaaaagaaaaaaaaaaaagaaaactcaccatttgcagatttgaaggcaggaagctaagccaagcacagctagcttggctgtgcctggagcagccagagtcactccccacactgcctgtcccccagatcccccatcctaagcttcgcctccccatccagcccatctggcaaaagacagagccaaaggctgcctcctgctggcctcatttcaggctttggcttctgggacctggtgtctttgggactggatttgttccttgcagacctggacgaagagctgctgagaagtctccatgtgttgtcagagacccctcctcttcctcaactccctgtgacccctgttgtgcagacttgggggaaaacaagggcacaagaattgtcacccagcaggtggtgtggggctgctaggaggaacagggagtgtctgctactgagttcagggtttctttaattttttgttgttgttgtttgttgttgtttttttttttttgagacagggttttgctctgtcacctagtctggagtgtagtggcgctatctgagctaactgcaaactctgcctcctgggttcaagtgattctagtgcctcagcctcccaagtagctgagattacaggtgtgcaccaccatgtccagctaatttttgtatttttttcagtagagatgggttttgccatgttgaccaggctggtcttgaactcctgagctcaggtgatctgcccgcgtcggcctgccaaagtgctaggattacacccataagccactgcgctcagcttaatttttaaatttttaactttttaaattgtctttagagatgagatcctgctctgtcacctaggctggagtgcaatggcttggtaatagctcactgcagtctcaaactcctggactcaaatgatcctcccacctcagctttctgagtagctaggaccacaggtgtgcaccacctgtgagacagagtcttgctctgttgcccaggctggagtgcagtggcgtgatctccactcactgcaacctctgcctcccaggttcacgccattctcctgcctcagcctcccgagtagctgggagtacaggtgcccaccaccacgcccggctaattttttgtatttttagtagagacggggtttcaccatgttagccaggatggtctcaatctcccgacctcatgatccacccacctcggactctcaaagtgctgggattacaggtgtgagccaccgtgcccagccgcgaattctttaaattttttgtagaaacagggtctcactatgtggctcaggctggtctcaaactcccggccttaagtgatccttccctcttggcctcccaaagtgctgggattaaagacttgagccaccgtgcctggccttgagtacagaatttcttcatggggtgatgaaaatgttctaaaattggttgtggtgatggttgtacagtaaagtgtaaactttaaatgagtaaattgtgaatgatatctcagtaaagctggtttatttaaaacaacaggccaggtgctgtggctcacgcctgtaatcccagcactttggaaggctgaggcgggtgaatcacctgaggtcaagagttcgagaccagcctggccaacatggtgaaaccccatctctactaaaaatacacaaaattagctgggtgtgatggtgggcacctgtagtcccagctacttgggaggcaggagaatctcttggacctgggaggtggaggttgtagtgagccgagatcacgccactgcattccagcctgggcaacaagagcgaaactctttctcaaaaacaacaacaacaaaaaaacaggccaggtatggtggctcatatctgtaatcccagccctttgggaggccaaggcaggaggactgcctgaaaccaggagtttcagaccactctgggcaacatagcaagaccccatctttttttttttttttgagacggagtctcgctctgtcgcccaggctgaagtgcaatggtgcaatctcaactcactgcaagctctgcctcctgggttcatgccattctcctgcctcagccctcctgagtagctggaactacaggcgcccaccactacgcccggctaattttttgtatttttagtatagatggggtttcaccgtgttagccaggatggtctcgatctcctgaccttgtgatctgcccgcctcggcctcccaaagtgctgggattacaggcgtgagttaccgcgcctggccacaagaccccatctttacaaaaaactaaaaattagctgggcatggtggcatgtccctttagtcccagctactcaggaggctgagacaggaggatcgcttgagcccaggagatcgaggcagcagtgagctatgatcatgccactgcactccagtctgggcaacagaacgagaccttgtctctaaaaataaaaacaaaacaaaacaacaagaaaacaggaccatcactcacagcacctctgcctctgccctgcctacttgaatgaggtgcagggcatctcacctgctcagagcagcccttgaatgagccccagctatttctagggtcctcaaacgaaacctcccacggccaagtcatacccaacatgggcctcctcccctattctggcccctgctcggagatgctgagtgacagaggctggacttggggtgtttctggcaaagcctcactgcaggaagccccacagctcaggcccagtccttggttcacacggtcccacttccagcttcttttgcccttaagactgatttgtccctgggagatcaccagatccctcattcaggtggagtgctgcagcgtgacactttttccaggggtgacccaggcctgcagggttccagtgtcacaggcaggccttgcatgagcctccacccgagcttctgctcctcctctcccacagggaacgtgatgttctcttcccggggtacacccatttgcagagggcccagcccatccgctggagccactggattctgaggtgagccaggtgaggtgcaggggctgtgctagaggggaggaccccggctgccctgaccctcctgcccctggcttcccacagccacgccgtggcactgacccgagactctgagcggctgctggaggtgcggaagcggatcaatgtcctgcccctggggaggtgggtgaggctccagtgccccgagggcctggtgggggtggctgctgcatagccttagggattgacagagctgggaagtgcagagtgggacagaaaaccgccttatctgctcagcgggggactctgcatggagccccagctctcgctaaggtgacgaccaagccattgaatgtgtctgagcagggccagagccctccagcaaggctcctggcaagcccagcctgctgccctcagcctgacatgtgggaacatgtgtcaggagacaagtgtcctgcacccagggtgacttagtgcttggggacaagtgttttgtggacacttggggacaagtattctgtacccaaggagactgggccagggaagaggctaagcgccaggtggttgccctggcaaccaggacttggttctctgtgtgtgcgttcgtgtgtgtgtgtgtgtgtgtgtgtgtgtgtgtgtgtgtgtcagggctgcctgccaggagccctggtcaccatgaatccctgtccctgcagtggggccattgcaggcaatcccctgggtgtggaccgagagctgctccgagcaggtgagacgtcctgcccctcctccccagggagaatcaccctcagcacccgccaagacctgcagacacacctgaaaccagagggcaggggcctgtggctcctggtgaaaccttcattcattgcctatgggcactgaggtcatcaagttcaggggtcactcatggcagggatgcctggtactgagagactcagggctcctgcctccctcctgggactgtgcaaaagatccctccccccagctgttgccccaccctgatcaggggagggggctgggcaacctagttgggggagagggggccactccctgtcctccagcttagccctgcttcctcccacccccccagaactcaactttggggccatcactctcaacagcatggatgccactagtgagcgggactttgtgggtgagtcctggggagccagtcccctgccctgtgcctcactttagtccttcagcccagcttctctccagtttcctcccacacctccacggacaggctggttgtggtgatattgtacactgaagtataaaccttaaatgggtaaagtgggtggggcatggtggttcaccatgcccagcactggccaacatggtgaaaccccatctctactaagaatacaaaatttagctgggtgtgtggtggcaggtgcctgtaatcccagctactcaggagttctgaggccagagaatcacttgaacccaggaggcggaggctgcagtgagccaagatcacgccagtgcactccagcctgggcaacaagagcgaaactccatctcaaaaaataaaataaaataaaataaaaataaataggccaggcatggtggctcacgcccgtaatcctagcactttgggagtccgaggcaggtggatcacatgaggtcaggagtttaagaccagcctggccaacatggtgaaaccccatctctactaaaagcacaaaaattagctgggcatggtggtgcatgcctgtaatcccagctactcgggaggctaaggaaggagattcgctggaacctgggaggtagaggttgcagtgagccaagattgtgccactgtactccagcctgtgcattgggagcgagactccatctcaataaataaataaataaataaatggataaattgtatgtgagtgataactcagtaaagctggtttatttaaaacaacaacaataacaaaaaacacgctaggtgcaatggcttacgtttgtaatcctagcactttgggaggccaaagcagaaggattgcttgagcccacaagtttcagaacagcttgggcgacatagcacgaccccatctttgcgaaaaatgaaaatttagccgggtccccccaccgcctaacctcctcctgccccctgtatggtcaggctgggtggggatgggagaggcctggtgactgggaaccttttctcccagccgagttcctgttctgggcttcgctgtgcatgacccatctcagcaggatggccgaggacctcatcctctactgcaccaaggaattcagcttcgtgcagctctcagatgcctacaggtaagccctgaactgccacctccatctgccgctgccggcctctgtatcccccgccgcccgcggacgtggctgccttcctccccgtcccacccctccgccagacctggccattgcggcgctggaccagccaagggtccagccccttcagcgccagcacctctgtccccagcacgggaagcagcctgatgccccagaagaaaaaccccgacagtttggagctgatccggagcaaggctgggcgtgtgtttgggcgggtgagcaaggcagggggaggggcggggcctctgggctgatggtgggtggccaggggggcaggatcccgggtccagcccctgtgcctccctcttcccgcagtgtgccgggctcctgatgaccctcaagggacttcccagcacctacaacaaagacttacaggtgcgaggccgggggaggcctggctagtacgtgccagttctcagggctctggcacactcaggcagggccccaccccgggattgccatacatcctcccatcctgtgcacacagctccatccgtggctgcccttgaactctctgcccttcctttgttggggtattgagtgttcttcccatggaaggcagtggggatgcctcagtgggggggtggggctgtggggaccctgggtgccagggggctgctaggccctcacctcctgccatgtgcctcccaggaggacaaggaagctgtgtttgaagtgtcagacactatgagtgccgtgctccaggtggccactggcgtcatctctacgctgcaggcaagacatcacccccctgcttctcctcccctaggtcccaggcactggggtgggcatgcggggagggtggccttgggaggaggtgaggtggggctggaggacctggggcagggaaggagaggtgtgctcgctcctgctcctggggaacagggaaaggacagaaactgctgccatgcagtggaagtagatgagactcagggggcctggggcctgtcaaatggcctgaccagaactctttaaaaaaagaaaatctaaacaaaaggccaggtgcagtggctcatgcctggaatctcacactttgggaggccgaggcagatggagcacttgaggtcaggggtttgagaccagcctggccaacatggcgtaaccacgtctctactaaaaatacaaaaattagccaggcgtgatggcccacacctgtaatcccagctactcaggaggcggaggcagaagaatagcttgaacccaggagatggaagttgtagtgagccaagatcatgccgctgcactccagcctggaccacagagtaaaactccatctacaaatatataaattaaattaaattaaattaaatatctttaaaaaacattttttagagacagggtcactctctgtcgcccaggctggagtgcagtggtgcggtcgtagctcactgcagcctcaaactcttgggctcaagtgatcttcccacctcagtctccagagtagctgggactacaaacatgcgccaccacgcctggctaatttttttattttttgtagagacagggtctccctatgtttcccaggctggtctcaaattcctggccccaagccatcctcccaccttggtctcccaaggtgctgggattataggcatgagccactttgcctggctgatttcttttaaaatcaattattatgggaaatttatgtatataacagctagagaatgcataatgaaccctatgtaccgacacccagcttcaatgataatcaactcacggacatcctggctccagctgtctttacccacagctctctcccactcccttacccccttattttgaagcaaattcccatcatcacatcatttcattcctaaatagttcaggatatgtcttgaaatcagtgtttcttggctgggtgcagagcctcatgcctgtaatcccatcaatttgcgagactaaggtgggcagatcactcgaggtcaggagttcgagaccagcctggccaacatggcgaaaccccgtctttactaaaaatataaaaattagctgggtgtggtggtacacgcctgtaatcccagctactcaggaggctgaggcaggagaattgcttgaacccgggagatggagactgcagtgagcagagatcacgccactgcgctccagcctgtgtgacagtgcaagactccatctcaaaaaaaaaaaaaaaaaaaaaaggcagtgtttctggaggctagtcccccaactagcagcaccagcatcacctcagaagtcctgagaaatgtgatgtgaggccccactccagatggctgaatcagagactctgggggtgctccccagcaatttgtatttttcttagtaaattctccagtggctaggcctggtggctcatgcttgtaatcccagcactttgagaagctgaggcaggagaagcgcttgagcccaggagttcaaaaccagcctgagcaacatagcgagaccttgtctgtaaaattaaaaaaattaaattagccagtcgtgatggcgtgtacctgtggtcccagccacttaggagactgatgtgggaggatcccttgagcccaggagctcaaggatgcagagagccaggattgtgccattgcactccaacatgggcgaccctgtctcaaaaaagcccaaaacaacaacaacaaattagctaggcacggtggtgtgcatggctgtagtcccagctacttgggaggctgaggctggaagatcccttgagtccaggctgcagagggctataatggccactgcactccagcctggacaacagagcaagaccctgtctcctaaaacagaaaacaaatcctccaggaacatctgatgcatgctgaagataaggactctttgaaaacataaaggccagtaaaacatacaggccagtaagtgttcatagcacatgtaaatattatcgataattatgagaagatggttcaagttgagagtgagacagagccgagtgggtaagagagtatctgcccaaggcagggatgtcctggcagaggggcaggtcctgggcctggcagcttcagatcccagggtccccagggctcaccactcgcccacctgtgcccccagattcaccaagagaacatgggacaggctctcagccccgacatgctggccactgaccttgcctattacctggtccgcaaaggggtaagtgtgtagcagccagggggagggtgaggagatggggtgccccccccagagggtgggggagctcaggaatgggtgcaagcggcccagcctggtggctcacccctgtaatcccagcactttgggaagccgaggtgggcgggtcacttgaggccaggagttcgagaccagcctggtcaacatggtgaaaccccgtctcttttgatgtaaaaatacaacaattagctgggtgtggtggcacactcctgtaatcccagttactcgggaggctgaggcaggagaattgattgaactgggaggtggagtttgcggtgaggtgagatcgcgccactgcactccagcctgggcaacagagcgagactttgtgtcaaaaagaaaaaaaaaaaaaaaaggaagggggtgcaggcaatggaggcagatcagggcatggagaaacctgcctcagcgccatcttcctccctggcacccagatgccattccgccaggcccacgaggcctccgggaaagctgtgttcatggccgagaccaagggggtcgccctcaaccagctgtcactgcaggagctgcagaccatcaggtacggcccatccccttccccatgctgcctcctaggaagtgagcctgggtgcctggagcccagggtggcctggcgccctggcccacctcttcctctctccccagccccctgttctcgggcgacgtgatctgcgtgtgggactacgggcacagtgtggagcagtatggtgccctgggcggcactgcgcgctccagcgtcgactggcagatccgccaggtgcgggcgctactgcaggcacagcaggcctaggtcctcccacacctgccccctaataaagtgggcgcgagaggaggctgctgtgtgtttcctgccccagcctggctccctcgttgctgggctttcggggctggccagtggggacagtcagggactggagaggcagggcagggtggcctgtaatcccagcactttggaagggcaaggtgcgaggatgcttgaggccaggagtttgacacagcctgggcaacacagggagacccccatctctactcaataataaaacaaatagcctggcgtggtggcccatgcatatagtcccagctacttgtaaggctgaggtgagaggacacttgtgcccaggagtggaggctgcagtgagctatgatcacgccactgcattccagcctggataacagagtgagaacctatctctaaaaataaataaataaacgaaaaataa

SEQ ID NO: 61518 - DNA, 8085 bp, Homo sapiens
aaggaggagtgcactggccgggatcggtgcagcgctcacactcactcacagtcactctctctgagcgcgtctcgctcgctctcatacacgcccggagcccaggagcgctcaggatcccgagcgccgcgaaaaagttcccccggcttttgctggagactcatcgctttgggaagtgcatttgcttcgtggctccgccgagcctgctgaatcctgtcctcgcggctcgggaccccgggatcgctgaccgctgccgccgccgcctctgcctcccggactatcggcagcctcggcaacaatagtggcggccgcccccagcgaggctccgggagcccttgcctgcgggggtccggggactcgagccggcctccgcctcccggacgcacagccagcgtggtccccgcgtgcaacgcgagcgccggggagtggctcctgctttgcccctcgtgggggccgagccaagaccagtctgcaaactccatcccgccggctggaagaagtcgcggagccggcaccaaacccgcagcgtcttcccgcgcggatcccgggacttaaaaagccggggccaccccggcccaggacgggatgcgggtcggtccggtgcgctctgccatgagcggcgcctcgcagccccgcggcccggccctgctcttcccagccacccgaggcgtcccggccaaacgcctgctggacgccgacgacgcggcggctgtggcggccaagtgcccgcgcctctccgagtgctccagccccccggactacctcagcccccccggctcgccctgcagcccgcagcccccgcctgccgctccgggggccggcggaggctccgggagcgcgccggggcccagccgcatcgccgactacctgctgctgcccctagccgagcgcgagcatgtgtcccgggcgctgtgcatccacactggacgcgagctgcgctgcaaggtaggcgctcccgggccaggacccggctggggtcgggggcgcgggacggggtggtaggcaaaggtgcttggggtccggccaacgcttgggctgggcacagggcggatcagtagattgggtcagataagacgccatttgaccaggttcacgtttttgtggatcgaggggtttcccatggagtgatataatgggggcgcctagaggaagtgcagtgttcagtggctttctctatctgttcctttcctcagcgcccagtgtagcgcgtggcgttccatataagttgtggaattgaaatggattccagggccatgccattccccttctctcattctcctcgctctccaccccccctcccccgccaatgtcctggaaggacgccctttagtgggtgcctcctaggagcttggagcagctggcagctctcttgccgggcttgcacggcacccgggctcagttgtaggtggtaagggggctggaagactgtgtccggctcctgccttggggattccgaattgaatccgcgctgagactagaacacgccctcccaagggagcagtcccagagtcatccacccgaggcggaggaatctgctcggagtagaaatgttgaaaagcccacaccggccaggaaccctcgcttcgattcactttattttccagccagcgattttcctttgaacatagggatcccatccaggaggaggagacacagctcctagaaacaggatccgccgggtcctcctcctgcgcgggtagacgcagaacgttcccacagtctactttatgcgagcgtggcacccctgcttgaggcaccccagagcaccctcgggccgctccttttcacccgaaagataggatcaccccccagttaagtcgcttctgggttttccgcaactcacctgacactcccaacaccccgaccccgtcccggggctcgctgctgccacctactgcccaacccgaatgaaatttcagacgcatgatcaagcccagtttaatagggaggaaaaaaaaaccttttcttctccatgactggggctaagagctgttctgggacaagcatgtatgtgtgtgtggtgggatgggatgggatggggtgggaggagggggcagcaggggatttttctagctggtgccagagcagccaggcctcttagaggtggggtgagtctggccattgtgcaaccccttccagttcctctgagcagataatagctgaatccagatggtgacagcccgtgtgtcaccgtttccagttgagtctaggatatgagtaactggactgaacaaaaggcctttaaagagaccagccagcttcctagaagagaggagatgctactcatttctaggggtggggtcgggtgtggggggataaacaaacaagtggaaaacccattcgcaggattccatacccttcctgtgagaattgtaactcaaggctgcttacacttgagtcggactgtaggcaggttgcttaaggctgcattgtcccagcctccccctccaagtcatctgttccttctgattaatgacagctctgcatgttctctggcccctgcttccccttggaggctgcagagtcaccacattctgtgccctttctgtgttgagcactttgggtctgcaggaggcacatgcacgtccagggactgcttttcagctcctggacaggccaggggcttccttctatcagccactcaactagtgtggcctgcaaacaggaaagggccacagagggtggggggtttgcttagctctcaggagctgacagaagatgggaacatgtacaggagacagttctttcaaatcatctgtgtgaaagcgggtaaccctttgggtatttgcaagtctagagctttaggtgttactggttttaaaggtgtcaggggcagctggggctgcgtaaggtaaggtggcagaggaaaggagtaggtgaatggaacttactcacatcctaagcccacaggttgagaacttctgttcagctccctcaggggtttgggaggctgcctttgcttttctagccccctaaacgggccccccttctctctacaggtgtttcccattaaacactaccaggacaaaatcaggccttacatccagctgccatcgcacagcaacattactggcattgtggaagtgatccttggggaaaccaaggcctatgtcttctttgagaaggactttggggacatgcactcctatgtgcgaagccggaagaggctgcgggaagaggaagccgcccggctcttcaagcagattgtctccgccgtcgcccactgccaccagtcagccatcgtgctgggggacctgaagcttaggaagttcgtcttctccacggaggagaggtgagcggccgccacagcttctcctgtggccttttggaaccaaagcggaggtgcaggtcatgtagttaggtgctgtgtgttggtgcaaaacaaagtcaagggctcatatgtcccagatttagtatttagagcttctgttcctgaggagtcacagccaaggttggtttattctgcattctcttggacggggcctggggacaccgtggcgcttctatgggatggcaagtgttgacagggtgctcttcctctcctaccccaggatcaggttcattccccattgttgtcagaaaggtcagttgtctggggtacaaatattaaactgccctttacgatattgccttctgaaggaagtgttcaaatctttgcttatgccaagtgctgttttgtacctggaaggtttcacagagctagtgagactgtcatatatgcagaattccaccctcttgtttcacacagcattcctctcccatcccagtccaggttctctgtaacatcacattctctggtgactttttagacagcttgtttggatccgtcttcagaaaatagccacattgaatagtaaatggaagttggttaggatggattgctaaatatagatcatagcttacctcataaagaacaagatgagcttgataagagagtaatgaggcattaagattcaaagctgaggtttcagctagagaattcaggaagccgcatgagatagaccacacttgattttaagagccagccacatcccttgtggaaagattacaagcagtaaggctgtaacattgtagaggtgagagtgagttagtttgttgtaagaagtgggcttatctcacctgtgcatttttacctttgactccagagcatatgaaacagtacagggttgagctgtcataaagcatgactttgtatctgacctcgcaataattattggaacacactgattagcaaagaaaagcaaactgttggcaatgaagaagtttctaattcctggaacatgctcctttgatatggtgatgcattttctgaaacatgccttacacacctccttactagcttttgaaatctgcattgcacaggcgaatatcatgggcatggggtttggcaacccgggggttaagcaatgtcaggctgacgctattcgtgtaaccagcacaggtgcagggttttagtgctgtagcagccaatcaggggcagacagtgtgggttgagtcatattttccgtttacagaaccaatgggtattttacataacgacagggaggtcacgctgaggacatactgaagttagcacatgtatactacactccagggaacaggaaggcagaaaaaaaaaaaaacagacctttgagaggaaaaggaattgacccatcagccagtaccaaatgtttgcatttaacttcacaagtgacttactgaaacgggtatttcagagaagcaggcagagacagggtgtcactggatatcagagcttccccaccacatggctttgagctttgggggatccaggagacttgggtggctggttctgaataaggaggcacctgcagcttcataagagagcctttgactgaaggtgttttagactttcgttgttacctgaacagagaccccccctgtagaatacatatgctcacatgttgatgtgccatcccagggggagtgtgtgtccctgtgtaagaatttcagggtccctgcgtccctgaaatccatcagccacttttgtttgctcgcataacctctctgtccaggcaaagtgttctttgcagttaaacaccccaataaatgtaattaacattccttgcaactttcccatcctaattgttgcagcctgggcccaggaggacaaagtttgctctgtgtgcatgtatcagtgtgggcaccagcgctgatgacctgtgtgtaatagcagtgactttgggctccgtgttctgtaatgcagtgtgggtccaggtagccctggcagtcataagagggaagatgggttcgtaggatgctcaggccctctctgaagaagtaggatatgctgctcttccctgctagcttttgtagagaatgcagcattctgagacaggctcccagttctgcaatgggaacttagtaaattgcgtaactcctattaggatatctcttgtaagctccagcattatgaatactatttggggctttgcctcataccctccaccccaggcgctctgccgatactttgcaaacatttattgcagttcgtgttagtttgtgaaatcaggagccctcggtagttgcagggcactgcttactggacgaaggggtaaatagcattcctggagcctttgctgttagtgcctgtgggcgctgttattgggaaggctttgtttttcatagcagctggtgtggaaataatggcttggttcctctctcttgcagaacccagcttagactagaaagtctagaagacacacacataatgaagggggaagatgatgctttgtcagacaaacatggctgcccagcctacgtgagccctgagatcctcaacaccactgggacctactccggaaaggctgcggacgtttggagcctgggggtgatgctctacacccttctggttggacgataccccttccatgactcagaccccagtgcccttttctccaaaattcggcgtggacagttctgcattcctgagcacatttcccccaaagccaggtgcctcattcgcagcctcttgagacgggagccctccgagagactcactgcccccgagatcctactgcacccctggtttgagtccgtcttggaacccgggtacatcgactcagaaataggaacttcagaccagattgttccagagtaccaggaggacagtgacattagttccttcttctgctaatccccaaaacctcagaaacctcataattcttaacacctggcatttccatttctaaagatggacaggccctttggcgtggtaccaaccagataatgactgcatcaggatgaaagctgctgaactcggcatggcgcctcctcttctctgttgggatgagtgactttattgatttgagcagcatatgctgtgattggctgccctgcaaatttgtttcccttaaggaaccctcaccaactatctctgctggatttgggagttccgcatcttttgtggagggcagagtatggacatcttacacccggtggtcaagtgtgtaataaacttgagcattcgaatgggagaaaaagcaaatcgcacaatgacatattttgagtaataaccgtatttttcacagggtgacaaattgggccaataaatctgccatctttgaactcatctttggtggctagactgctacggcagcttctctgatgggaaagttccttttttggcttaacactcaccctttcttcacactcacatttaccaatgactctgctccgtttttggagcagactgttttaagttgctcaggagcctgatggaaccatgaaccgagactcttctctgtttcctgccaagacctcatctgcactaatgccttctccctgaccttgacacttccccctttagctataaaagcacttaccagccgaacgtggaacagtatcacaaaagattccatctcccaacgatttcagaactctgagctcagagagactccagattttaaaaaataatttgagtgcttggaaactattagctttttaagttccttccaaatatgttagtacctaccctttactttttccccaagaccatctcagggtggagcattctgtctaagagaagaaagataaggaggctcccacccacctctcccaagagcagacattaaacatctttgtgctttgaagagagtgaattttggatagtcttgtgattctcagactaacttccagaattatactttaacccctcccagatatggtccgcctttggcattgtgtgtacatctgcagttttgcatggtgggttgttaatatttcaaatgtgtggtttatgaatacgtctgtataatcggcttctggagtgaaacagcaaaccccaaatcttcaaagttggaaggaactttaaaaatcatccggtccaatctctttcctctttctgccacctcccaaggcagaaatcccctcttcagcttcttttgtaggtgggaatccagcctctgttagatatgtccagagatggaaactcactcccctacaaaagatggagcttaatggagaaattgcaactttcattaaaaaacaaattcagatgaaatatcagtaactgtcttggacagtgctgaaatcaggtggttaaacgggtaaacaaaatatactgtattttgagaaatggcacaaaaacaggcagtcatctttaagggctatgcctaggcaaactactaacatgcattgtgagaatgccgtgtatacctcacgtactgtgtactttgtacatatattttaccttttatacctatgttcgattttgttttgttttgttttgttctggctttgaggcttgttttgttgtctgtgtctgtctgaataacctgcgtgtctaaaaccacgtgaaatgtgaatgattattggcaatattaccttgacagaatcatgggactttgagaagagggaggacagaggcctctgtcgcactaacgctctcgtggttgctcgactgttgtatctgtgatacattatccgactaaggactctgggctggcagggccttctgccgggaaagctagaaacactaggttcttcctgtacatacgtgtatatatgtgaacagtgagatggccgtttctgacttgtagagaaattttaataaacctggtttcgtaaata

SEQ ID NO: 61519 - DNA, 4010 bp, Homo sapiens
acgtgctggcggctggccaatcatcgggggcggcgcggggaggggtggtgtggacggagaaagtgaaaggtgaggcacggccctgcagattttccagcggatcccccggtggcctcatgtcgcgcagtggaaccgatcctcagcaacgccagcaggcgtcagaggcggacgccgcagcagcaaccttccgggcaaacggtaactgcaccgcggcagggactcgctggggcgcggagccgagccctccccttccttaggaagctttcgtcccctccgaaggttggaacgctcatcccgagccagaccgacaaggcgtacagtctgcaggcctgtacgagcagcaggccaattggcgctgggaaagtccaatcctgggcctctagctcctgagcgggacagggccgagagggcgctcccgagcttgggcctgctggtgggtgagacccaggagagagggagctagagagctctgaggactgatcttgactgtctgcccccagaccatcagcatatccgctacaacccgctgcaggatgagtgggtgctggtgtcagctcaccgcatgaagcggccctggcagggtcaagtggagccccagcttctgaagacagtgccccgccatgaccctctcaaccctctgtgtcctggggccatccgagccaacggagaggtaagcctgtagagccctgcatctgcaggctgggccacggggagtagttccctcttagaactgtcctccacccacagggatagtgaacctccttctgggtcatatcccaccaagctttttggtcccctagggtgggccttccctactcccttgtagcctgtccagtctttgaagcccaccaggtaactggtggtatggggcagtgagtgcttctagcctatccttgtcggtaggtgaatccccagtacgatagcaccttcctgtttgacaacgacttcccagctctgcagcctgatgcccccagtccaggtaacctggctccaactgctgctggggaggagggtggctagacctcttgagggacttctgctgcagagagtgatactcctttacctcaggacccagtgatcatccccttttccaagcaaagtctgctcgaggagtctggtaactatggatttcccctcttacaactttcaaaccagagttggagactcagcattggggttcggccctgcccgtagcacagccaagccctacctctcggttatcttttctcccgtcaccacccagtaaggtcatgtgcttccacccctggtcggatgtaacgctgccactcatgtcggtccctgagatccgggctgttgttgatgcatgggcctcagtcacagaggagctgggtgcccagtacccttgggtgcaggtttgtgaggtcgccccttcccctggatgggcagggagggggtgatgaagctttggttctggggagtaacatttctgtttccacagggtgtggtcaggagggagttgacttggtgtcttttggctaacagagctccgtatccctatctgatagatctttgaaaacaaaggtgccatgatgggctgttctaacccccacccccactgccaggtaagggtgtcaggggctccagtgggtttcttggctgagtctgagccagcactgtggacatgggaacaggattaatggatgggacagaggaaatatgccaatgatgtggaggcttggaggtaaaggacctgcctgttcttctctgcttttgccccttgacaggtatgggccagcagtttcctgccagatattgcccagcgtgaggagcgatctcagcaggcctataagagtcagcatggagagcccctgctaatggagtacagccgccaggagctactcaggaaggtgggagagagccaagccctgtgtccccaaggagtccctaactttcttatcccatgagagaggtgtgtaaaggagaaagctagaggtgaactagtagagagagacttgctaggaggccttagcaataatccagtaatctaaaggaaagatgatggtgacttagactcgggtggttagtggtagaggtggtgagaagacatcagatcctgggcacattcttttcttctgcttcccttgcctatttgctgaccacactccggctcctatgtcaccttgatgacttcctatccattctgtcttcctaggaacgtctggtcctaaccagtgagcactggttagtactggtccccttctgggcaacatggccctaccagacactgctgctgccccgtcggcatgtgcggcggctacctgagctgacccctgctgagcgtgatggtcagtctcccaagtaggatcctggggctaggcactggatggaggttgctcccagtagggtcagcatctggaccccaggctgagagtcaggctctgattccagatctagcctccatcatgaagaagctcttgaccaagtatgacaacctctttgagacgtcctttccctactccatgggctggcatggtgaggcttttcaagtacctatatttagccccaacaccatttctgggctcctggggctcagcctagtgaactgcaacctcaaaggagcaagccttgaaacagttgctgggggaagtggccagagtagagatgctgggactgagggtggagcagcaaacttggtgaaactacatctccaatgtgctttctaatctcctgccagctcttctcaagcaggggatcctgggagatgtagttttcagatacctggttgggtttgggagtaggtgctaacctggataactgtaaaagggctctctctccccactgtctctcttctttctgtcaggggctcccacaggatcagaggctggggccaactggaaccattggcagctgcacgctcattactaccctccgctcctgcgctctgccactgtccggaaattcatggttggctacgaaatgcttgctcaggctcagagggacctcacccctgagcaggtcaggactcagaacagtctggcgtctccagactctcacatgcagtatgtgcaggcacctgatacttctgttgcccttgtgctccagtcattgcacaaggcagaaaacagctctggcaggaagggactgccaaagttaggagccctagggcctggaaggagagtatggtcctcagatcccccttctctcctgcttcctccagggaacccaacagtcatgaccctgatagtttcccataacaacctgggcattccttgggactcaggagctgctaaactctttcatcccctggtggcttcagcagtccttatcaccagcctcacaatcccacaggcccacccccagtgggcctgtggcattcatatttcatattcatatttcaaaccacaatatccagcaaaatgtctcctgagcacccagaactccataccatcggccgggtgtggtggctcatgccttaatcccagcactttgggaggtcaagatgggaggattgcttgagcccagaagttcgagactagcctgggaaacataggaagccctcgtctctacaaaaaaaatttaaaaagttagccaggtatggtggcatatacttgtggtcccagatacttgggaggctgagataggatcacttgggcccaggagtttgaggctgcagtgagccatcatcatggcatcattgcattccagcctgggcaacagagcaagacctcgtctcaaaaaaaaaaaaaaaatgaagtccatgccaccattcttggcagcccagcccttatcctccttaattgctccctgtcccttttccaggctgcagagagactaagggcacttcctgaggttcattaccacctggggcagaaggacagggagacagcaaccatcgcctgaccacgccgaccacagggccttgaatccttttttgttttcaacagtcttgctgaattaagcagaaagggccttgaatcctggcctggaatttgggcagatatagcattaataaaactgtgcatctcaaacttttatcacatactctaata

SEQ ID NO: 61520 - DNA, 59344 bp, Homo sapiens
ttacaggaacagtgtggcctctctggaactctgcagaccaactgccgtggtaagagaaccgactttcagaggcctctaggcactttgtcctgggtaggggtgcccacacatcctggccattgttgctcttccctctggaacttggcagctttctagcagttagaagagcagagggtagaaggatgggaacagtccttagagaacaggaatctaggggagggttggactagatcatttctcaagagctgtggggactgttctggtcaggcatgggcaagctgaggggcaggaggtaggcaaaccctacttgacctgagaacagatttgttgttgttttgtttttgtttttgagtctcgctttgtcatccaggctggagtgcggtggtatgatctcggctcactgcaacccctgcctcccgggttcaagcgattcttctgcctcagcctcccgagtagctgggattacacgtgtgtgccaccacacccggctaattttgtatttttcgtagagacggggtttcaccatgctggccaggatggtcttgaactcctgacctcaggtgatctgcccgcctcggcctcccaaagtgctgggattacaggcgtgaaccactgttcctggccgagaacaggttttgcctgagaccttggacagaagaccttggccatggatccaagagctctgggccagaacacccttgcatgatggtgacagttgagggaaaggccacatggttccttgtgtaaatggcatggctgccagtggtcatggggaggccctgctcatagttcagcaccagccggcccttcgtgtgctgtgctccagctccccagccggctcagtccttcacaaaatgccctggagttacagaacagaaaggcccggctttcctttaggaatctgggaaataggagggctgaggtcatgctctgttcaacatgtgagacctcccagacagcagtgcaggaaaaacatgttactacccgtattttgggagaccagacctctggcgtttgagtaggactcactgctcagatctaaggggagagaacatctcccattttgaagaaaaccttttcctcagtttaggaggaggagaaactgatcaggttccaaatggcctcttgttctttaactgcaaacgggccaggctccctgccaggtcatgggataacaatccaaggagaggggagaaatgcagtgtgcatgtgtgtgtacatgggcatgctcgtagggggaaagactggggggatggaggtgacgtggacatctgtgtatgcttcagctctatttccctctgcttagtcccaaactgctcgggattagcaattgttaagaacatgcctttctccccaccccgggagttctaggccaggggtggagggattgagcaccgtggctttgttctctgtcaggtggtgcctttctctgtgacaccgagggagacctgccatcaggagggagtctgaggccaggagacagtacttaccgatcaggatggatctttggtcttgtttgtgtgcttggtttcctggctggaatgaaatgtcagtttcatgaggacagggacctgttctctcctgcacaactttctctctgatgaccgacagtgcctggcatgttgtaaaggctcgttcagaagtgactgaatgaatgaatgcatactttttaggcggggctgcatatcgttcccttaaacctcctgattcatcttccgttgcttccgtgtcagcttctcactgggtcattgtctgctttggtgctgcccttccccacaactttgagagttcatgttactgcaggctccccgcccgcccacctctgcctgaaacttctcttttgggctcctgtgctgtgacatactagcagtatttgtttgcccctcttaagaccatcccttcagtttcattcctgcctcagtttctcctcctcacatttctgctgttccacctctgctcctgtgctcttctcaggaaagcaggtgagtggtgatgccctgggctaagctcgccagggcctgggcagcccaggcacccgtggttcgggtggggagggagcatgctggtggccggagctgggcttgtgggcagcagccctccccaccttgctgaggccaagctctttctcatggctttggctgtcacttctatgctgatcacccccaaatcattgtgtctatatttctctattggtgcttctgaccttccaaaatctgatcccaccctggcagtcagaccttatttgatgtcaaggattattaatttgtagcatgtattacatccctaatatggaccagttcacatgcattctcatatttcatcctcccaatgaacatacaaagtcaaataattattcttattttacagagtctcagacaacttagttcctctaggtaaccagattaattagcattagggggttgtgatcaggatttgaactggctccactggcccctgaccctgaacagagtcagcttggagtccgcccttggagacgaggacagccggtcctgtttctccctctcaccccagtgcactcacacagcaggcgttggcacccttgctaagggccaggccaagcgtctcctctgtgagccttcacttagctctcctaagctgctcggcctgcctcctctcccttttctctaacagcagtgcctttgcacacactatgtgtttgttatatgttggctgtgccagtcttgcctcgtcagcagatagtgattttcttaaaggcagaggccatgttttatatgatcctccatccctcaagtgtgtgttacaggcagtttgttgctcagtaaacacttgatacctctgatgaggtgaaatctaatcacagtcctttgcatatgtattgtggtttacagtttctgaaaccgaagagccaatttgaagtttcctgtaaaacagatcccttaattgtcagcgctctgtgctgagagggataaatctgttttgtagacggactaacaggtccagaggtagagtgaattccccaaggtcatatgatggatgatagcaaagccagaacttgaacccaaggtttaactcttaatgccgttcctcttaatgccgttcccttcccacagaatcacagcagcctgtggtccagacttggccaggtgacccctgccaggccttccatcccacttagtcatacagttccttatttgtatttgtcctttctctttcattagaactcgtgtctttttgtgtgtgtgtgtgttttgagacagggtctcgctctgtcacccatgctggagtgtggtggcacaatcacagctcactgcagccttgacctcccaggctcaggtgattctcccacctcagcctcctgagtagctgggactacaggcgcatgccaccatgcaaggctaatttttgtatttttttagaggcagagtttcaccgtattgcccaggctggtgtcaaactcctgggctcaagtgatctgcttgctttggcctcccaaagtgctgagattacagacatgagccaccgcgcccagccttagaatgcttgtctcttgagggcagggaccctggctgcttttcccattatccttccaaagctccagctctggggccatgaaccagaaatcattccttcaaggatgttgacacagtgagtcacctgagaaggggcagggtgcaggaggggtggggcaggagatcaggaactggtgtgggacattaggggtgggagataggccagaaagccccatgctctgtgtaaaagcttctgtcaaatgaagatgtgcttgtcctacctaccaggcgaggttactcttagtagcaagtgagagtgtctgctaaagcgccttctaaactgcagagcactagcaatattgttgttaaatataattatagtctgtagctgggcatggtgctgggtgtctgtaatcccagctacccgggaggctgaggcaggagtattgcttgggcctaggaggcggaggttgcagtgagctgagatcgtgccgttgtactccagcctgggtgacgaagtgagactctgtctctaaataaaaaaaaaaaaaatgtatatatgtgtgtgggtgtgtgtgggtgtgtgtatatatatatatatatattttttttttttttttttttttcctgagatggagtctctcactctgttgcccaggctggagtgcaatggcaccatcttggctcactgcaacctccgcctcccaggttgaagtgattctcctgcctcagcctccccagtagctgggattacaggtgcctgccaccacgcctggctaatttttttttttttgtatttttagtagagacagggtttcgccaagttggccaggctggttttgaactcctgacctcaggtgatccacctgcctcggcttcccaaagtgcaaggattacaggcgtgagccaccacgcccagccaaaaaatatattttttaaaataataataattatagtccgtagggatgagctcaacaacatggttggatagaatcatactggccttgtgagtattgaggagacaatcaggatggtgcctcacccaaggcctggcactccagctattatgaattattcttgttttcataattattataagacatgccctcttccttcagattggggaaaggagttggcagtgctgagaatgcatcgcttctggattgggactaagaagatgggaaaggcagtctggccctagggctttcgtagatccactcaccaccgcaggtccccgactctgaatacctccttcctcccagtgggggttttcagcaagctaatttctcacccctgaggaggaactgttatattcggatgaacacccccctgctaatgtggagcagaaaagtaaggcctggcgagtcagcagctgctcagcaggtggatgggctgcggtggtgtagcgggtaggcgcctgacagcccggcttgccgcagccgctgtgcttccctcccatccctggggtgtgcattttagggtaaaggcaaactggaagctcttgctatttgcagaactccaaaacaacaaaacaaaatgtccactcagctgggggttggctgggcagcaccactgtgattacacagttagcctgggggaagggctgtggtcagagtttgggggacacacaggtgtgactgtgatgtgatacagctggaggaggaagaggagggtgtgatcacaggcccgggagtggccagggcaagagtgatggtggaggagagtggctgaggttggcaggcagggaggagagattggtaactactaatcactagcatgatcagtcttgacaatctatctacaagggactcccaggtggcagggcaggacctgaggcacagctcggcatgacgggcagacaggggtctacgtggctttgagctctgagaccataggcaagctgttcatctgggtgtctttccatgcttacaataatattccccttacaagccctctgatgattgagatcatagaaatcactcagtgcagtggctggcactcagtagcagctcacacaaatgatcagcaattccgacacttgctatgtggccatcacagtaaaatcagcaatagtggatgcccagagctgcatctccgggaagcctctgagccagtcagtgtttgtgctcaaactccaaagcataggatgaaaggtcagatcatggggctatgaagatatgttctcctaggagtcacgaatagggagagaaaacagcagcaaacacagtcaaggccatgtcctgcctgggttgctgtttactttcctcttccaggaactgaagctgtttcccattggatttctttactatcgccttggctcatggactgggtactttggtaatcagttcgcccagagaaccaggctttcacattgacctaggttccacagtgacttcctccacgggatgtcggggtgtgtcatctagcagaatagcagtcaagactacccaggaatggttgagggttgcacactatttttaataaattgaattaaatagccaagaaaagtcagacacccaacaagggaagttgaggcaccaagcgacagtggaaagtcattactaccactaggcttgaaggggtcaggagaagaaatagcatttcctggctgggcgtggtggctcacgcctgtaatcctagcactttgggaggctgaggcgggcggatcacctgaagtcaagagttcaagaccagcctggccaacatggcaaaaccccatctctactaaaaatacaaaaaaattagccaggcatggtggcaggtgcctgtaatcccagctactccagaggctgaagcagaagaattggttaaacccagggaggtggaggttgcagtgagccaagatcgcgccattgtactgcagcctgggtgacagagcgggactctgtctccaaaaaaaaataaataaatagcctttcctgcaaacaccagtgagggctgaatagtggacactgggatgccagcaggaactgtcatagcgacaagacacagcctgggtcaggatggtggcatcaaagctggtagagagtgaggaaggcacaccccacgttctctctccaccgcctcctacctacccttgtctcccgcctgtgcctctgtctcatcggctggacctacaggaaaccagccaggaagggagcccaggtgcctccacccagagggctcagccccgctgggtccagagaagggcatacagggaggccgccaaccaggtagcctttccccaaaaggcaaagctgtggaggaggcatccactcagcaggtgtggaaagcaggggggatgagagctctggcatcctagggtctgagcggctgctgctgctactttttgggaaggggctgccaaatcaaaactagttactagttcaaaatttgatcataaagggcaattaggaaagataaggaaataaagaacatccagattggaaaggaagaggtaaaagtatttttattttcagttgacatgatcttgtatagaaaaacctagggaactcattaaaaatctatttgaattaaatgagttcagcaaggttgcaggacataagatcagtatgccaaaatcaattgtatttcagtagcagtgggcaaattgaaaatgaagaaaacaattccatttaagatagcatcaaaataaaatatttgggaataaatttaataaaagtgcaagacttatactctgaaaactatgaaacattgttgaaaacaattaaagaagacccaaataaatggaaagataccccatgatcatggatcagagacttaatattgttaagatggcaatacttcctgaattgatctgcaatccctatcacaatccaagatgccttcattagcggaaattgacaagatgatcctaaaattcacagagaaatgtaagggaaccagaacaaccaaaagaatcttaagaaagaagaacaggctgggtgcagtggctcgcacctgtaatcccagcactttgggaggccaaggcgggcggatcatgaggtcaggagatcaagaccatcctggctaacatctctactaaaaatacaaaaaaattagtcgggcgtggtggtgggcgcctgtagtcccagctagttgggaggctggagaatgacgtgaacccgggagtcagagcttgcagtgagccgagatcgtgccactgcactccagcctgggcaacagagcaagactccgtctcaaaaaaaaaaaaaaaaaaaacaacgttggaggactcacacttcctgatttcagaatttaactgcagtgtggtactggtgtaaggatagacatatagatatatagatcaatggaatagaactgagagcccagaataaaccctcacattaacagttaattgattttcagtaagagcgccaagacaatttaatgggggaaagaatagtcttttcaacaagtggcgctaaaacaactgtatatctgcatgcacaggaatgaactggaccccacctcataccatatacaaaaattaattcaaaatggaccaaagacctaaatgtaagaagagctataaggagaaaaataagtgtaattctttgtgaccttaggttaggcaatgattttttagatacgacgccaaagcacaagcaataaaagaaaatgaactgtacgtcatcagaatcaacctttgtacatcaaagaacactatcaagaaagggaaaagacaacccacaaagtgggagaacattttggaaatcatctatgtaacaaggaacttgtatctagactacctcaagaactcttggctgggtacggtggctcacatgggaggatggcttgaggttgggagttcaagaccagcctgggcaatgtcataagaccctgtctctgcaaaaagtaaaaaggaaaaaaaaactagctacttgggaggctgaagcaggaggatggcttcaggagcccaggagtttgaggctgcagtgaactatggtcgtgccactgccctccagcctgggcgacagagtgagactctgtcaagtaaaatcaataatattatgggaccaccatcgtatatgcatttcatcattgactgcaacatcgtgtggcacatacctgtagtcatatgatgggatattatttagccatacaaagaagtgaagtactggcacacaccacaacacggatgaaccttgagagcaatatgctaagtgaaagaagccagacccaaaacccacataatttatgattctgttgatatgaaatgtccagaattggctgggcacggtggctcacccctgtaatcccagcactttgggaggccaaggcaggtggatcacttgaggtcgggagttcaagaccagcctgaccaatatggagaaaccccgtctctactaaaaatacaaaattagccgggcatggtggcgcatgcctgtaatcccagctactcaggaggctgaggcaggagaatcgcttgaacccgggaggcagaggttgtggtgagccaagatcgttgccatagcactccagcccgggcaacaagagcgaaactccatcttaaaaaagaaaagaaaagaaatgtccagaataggcaaatccatagagactgagagtagatgagtggttgccaagggctgagggagctaagggggttggagcatgacagctaggggataggaaatgttctaaaagcggattatggcggtagatgcacatatctgtgaatatatttaaaaagccattgaattgcactttatttgtttcttgagacagagtcttgctctgtcgcccaggctggaatgcagtggcgcaatctcggcttactgcgacctccacctcctgggttcaagcgattctcctgtctcagcctcctaagtatctgggattacaggtgcctgccaccacgcccagcgaatttttgtatttttagtagagatggggttttgccatgttggccaggctggtcttaaactcctgacttcaagtgatctgcccacctcagccttccaaagtgctgggattataggtgtgagccactacacccggccattgaattgcactttatgtgtctcatctatatggtatgtgaattgtatctcagtaaagctgttaaaaaacaaaaccctggccctgaagggcagcgcagtcggctaaaagactgtgatttaatgaggaaactttcccaccgggctgtgaccgctggccctggctccctttggccgggtggaggtgctgtctgccactgagggccctcagctgctttttcaggatctcagaacatgggaggaccccagctccagaagaaaatcttaattccagtttaatcttaattccaatttaatttggttgagttaaacatttttggaactgtactgtgagctaggcaccaggctagctgctctcatgaaaaaacaggggccctggagctgggcagccttaattattcttgagtttgctacttcctgtgggtccttcccagcctcaattttcttttcagtaaaatgagggttgataataccccatgagattgtggtgacaattcagtgggctaaaaggaagatgcctggaatattgtaggcagaaaatgaaagtttctttccagtgctcctggagcaagttatctctaccaagtggacataacaaagatgagttagttatgtctgcccccgtagagctcaaggctggatacatgacctgtactcgctaaccagggcctggggagaagcaggccaggaggagggtccctgtcttactctggtcctgggttgggaaccggggaaggcttcctcagggagggggcaatgaagtgaggctttgaaggaggatagcttttcgcatgttgtattttattcgctttttgtttatttattttttgtaggcaggtctctctctgtcgcccaggctggagtgcagtggcataatctctgcttactgcaacctctgcctcccgggtttaagcaattctcctgcttcagcctcccgagtaactgggactacaggtgtgtgccaccacatccagataatttattatatttttagtagaaacggggttttgccatgttggccagactggtgacgaactcttggcctcaggtaatctgcctgcttcggcctcccaaagtgctgggattataggtgtgagccactgcaccccgacttagtcactttttgaatagataatcaagtacatggtgccaattcaaaagggtcaaggctgggcgcggtggctcatgcctgtaattccagcactttgggacgcctaggcaggtggatcacctgaggtcaggagctcgagaccagcctggccaacatggtgaaaccccatctctactaaaaatacaaaaaaatcagccaggcatggtggtgcgcgcctgtaatcccagctactctggaggctgaggcatgagaatctcttgaatcccgggggcagaggttgcagtgagccgagattgcaccactgcactccagcctgggcgacaagagtgagactccatctcaaaaaacaaacaaacaaacaaacaaaaaacaaaaggatcagcagtgaaagagaaacctttcccagaggcagccactgttaccagctcctgaagtgtcattctagaaatactctatgtttatgagtgtatgtgcgtatatataggcggacgcttctcatctaggcagattttcacagcatccacattgtggtccgtggggatcaggggcctcctgctaaggtgtgggttaggcttcaggtgttatgttcttgctgctttcgtgtcttgcggtcaggttcggcataggccctctcatcagtaagagtgaggcttcattttcctttagttccccttgaagggagccagcggcgctgtccatcctccttgcccctctgctcccttggcgtgccctctcccagggatttcctctgtctttctcctttgttccccgctcctctttctcgtttgcttgctcccttgtttgggtgcagcatattgacagcagcttcctaacaaagacctttgccttttcttgttattttactttcatacatggttgatagtttagctggatagagaatttcaggttggggccaggagccatggctcatgcctgtaatcccagcactttgggaggccgaggcaggtggatcacttgaggccaggagttcaagaccatcttggccaacatggtgaaaccccatccctactgaaaatacaaaaattagctaggcatggtggcacatgtctgtaatcccagctactcgagaggctgaggcagaggattgcttgaacccaagaggtggaggttgcagtgagctgagattgtgccactgcactccagactggatgacagagccagactgtctccggaaagaaaaaaaaaagagaatttcaggttggaaacaatttttccttgacaagtttgaaggattgctttgcacttttctaacttctgaaactgctaagaagtccaaaacctttctgatttctgatacttttgtcttttttttctttttaccctcctttgggaaagcttacaggatctgaaattggacacagtgccttggtgtaggcctgtgttcatctgtttcgtgaggctctcagcaagtccttccagtgtggaaactcatgtcctatcctgggagtttcttgaaacattccttttcttgccctctgttttttactgttctgtctttctgaaactcctattatttagtttttggatctcttggactgaccctctaatttttttccctttttcacctattttccatctctttgtctcttttcttcagtttctagaagatttccttttatctttcaacctttctattgctttgtcttattgtattttttaatttccaagagcttttttgctccccaaatggttctttaaaaatgtgtgtagcatcctatgttttcactgatgtaatcgtttcttatttctgtgagaatgtgaatgccatgtttgtctctaagttttcttctccctgcatagttggtttcctccaaattgctttctctgctctttcctttggtctccatcctctttgaatgaatctgcccagggacctttggttgcccactcataattattaggagggtctaaaatgctgcctgggagctggagcaggtgggggtccagttctgagtttaccagtacatgatctgggcaggctgtttgttggggaacctcagtgtcaacacctgggagctcagttggggaagggggtagcatgcaaagagtcacgtaacctgccacccccatttttggcaaggtccccaggccctcaactgtgcctcgaatttcccagtccagagaccccacacttttccctccccagaaagtaaacctctgttcttccagggctggagaggggaggtctctggcatgagatgggggaggtaggggtctaactgctatttttttttttttttttcctgagacggagttttaactcttgtcacccaggctggagtgcaatggcacaatctcggctcacttcagcttccgcctcctgggttcaagtgattctcctgcctcagcgtcctgagtagctgggactacaggtgcatgccaccacgcccaactgatttttgtatttttagtagatacggggtttcaccatgttggccaggctggtctcgaactcctgacctcaggtgatccacccgccttggcctcccaaagtgttggcattacaggtgcgagccactgtgcccagccctgattgctttttgaaagctttcagcctgccctctttatacacggcagcccgttcagcccattgtggaggtgggaggcctggagctgcagttccctggcctttggaggattcctggtggatggtgggaacccgggtgttctcagcctgctccagacccaggctgtgaggtcagctgacgcgagctgcgctccagcttctgcagtcatgttgctgttgtctcctctcctgttctgcccttgggggttcatagctttaaaaatatatatatatttgctgaagtcttagtgggatttcataagggagggagaaaaattagatgcatacctgagacaggagcaggacttgcatgggcaaaagctgggacgggaagggtgttctaatggtagagggagtgctctgagggagaggggcaggtgctaggatttctgagaacaaagaggaggcagctgggctgcagctggagaatccgggaggctggggcatggggggacaaggctggacaggcagggtgcactaattttgggggaggtccccaaggagacttgagtttcccacctacagacagtggggagtcagagaattaccccacttttcaggaagagtgccgtcatgcctgtatttggggatgctagctatccctagtacctaatgtggattggtagctagagctgtggtaatgagtaggaggtttttacgatagttaagtagtaagaagaggacatttcagggtcctcttcttagaaatgaaaagagggaaggatgtgagggattaaagaggtaaaactgcccagacttcttgaccagatggtaggtgagggaggggaagagctaaagaagaccctaagcttaacccttggtgaccagggagagggtggtgaggaaggaaggaggaggtgtctggttgggtttggtgtatgtgtgcagtttgggagggggagtgagggggtagggggcgggggctaagttctgctatagaataggcatttgccatgtccaccaaaaagcgtgattttacacccccacgcttcaacctccaagtgcctgtgttgatggagagagagaaagaaggtgttgagagcaggggtaaagaaatcagtcccttagaagacaaaagaataattttccagttgttaaatgagattctcaaaagaatttttatgttgatatcctcaaagattaattcatgttgcagaatgtcattggaactaccttaagacattgatagagtgcctgtctgctgtcttccttagctcatcctcatgttttgatcaaattaagtacttggacaccaggtctgtaaaaaagaaaagagccttctttatttgggttctgtaggcaaaagggagagtggagaagcgactctgtctacgctgctcccctcactccccgtctctgggcccttctgggatttgcatgccacccactgctctgtcaggagtggctcttagggaagtgaggaaagggccttgattatagtgtttgccaatttctgtggcataaatatgcccactgtggcccgtgtcaggctaccaacgtgatgtcatagcacagagctggagtcaggcaagcccgtgggagtgagtcgtgccctggggtcacagtgggggtcctcactgacacggtgcagctggacagcagaatctcatctttcaggtcgtctgacttgttctaagggtctgtcagggttgaatcatgcttgccaagtagcatcttaaaagatatttccactgcagcagccccagcccttcaacctgggcttctgtggccttctaattcttccttctctgcctcccctccacccacccccacatcatcagcagcagatccaacatgaataccaaacactcacagttaatactaaaagccaacaatttttttttttttgagatggagtcttgctctgtcacccaggctagaatgcagtggcgccatcttggctcactgcaacctccacgtcctgggttcaagcgattctcctgcctcagcctcccgagtagctgggaagctgggattataggcgcccgccaccgtgcctggctaatttttttgtatttttagtagagacggggtttcaccatcttggccaggctggtcttgaactcctgacctcatgatccacccaccttggcctcccaaagtgctgggactacaggcgtgagccaccgcgcccggcgacatttttcttaaagttcaatctctcatctctgatgcagctcgcactcattattgccatccttggagcagctgtggcaaacgagtagcttggatgtcagtaggaagtcttgtctctacaggctgacctgcctggactgttgctttgcccttttggttgtgcgttctggaacgtgatgcctgtgcttgtcagccttgatgagtcacattgaaaaagctcttagtcatcccaggccctggctgagtcagtgtattgggtgacacctgtggccaagcactggctgttttacaactgagactgtcccagaactcttaggcactctggtctcaggggaagtgttcttcatctagttcaaggccagtctttcacccgagcctcgcagccttgttcccggactcgccccaccttttattctcatccttccttcttcaacttgtcattccctctcaactccttccccttcctcttcctataacttgctaaacatcctcccaagcgtctgccatgggtataacagagaatggattcatgcctagaatacataaagatttattacagctcagtaagaaaaagacaaccagcccagcagaaaagtgggcaaatgatgtgaacaggcagttcacaaaaggaaaaacctaaaaatatatccacaatcataagaaaatagccaacttcagtaataatcaggggactgaaaattaaaatgataccattttatactacaaggttgacagaaatcaaagtctaacaatataacagttggtaaagatgtggggagatagacattctgttgtatttctagtggctgtgtaaattattaggataactaccttgagacttatttggcaatattgatattaaaaacttgcctattggctgggtgcggtggctcacgcctgtaatcccagcactttgggaggctgaggtgggtggatcacctgaggtcaggagttcacgaccagcctgaccaacgtggtgaaacccgtctctactaaaaatacaaaattagtcgggcatggtggtgcattcctgtaatcccagctactcgggaggctgaggctggagaatcgctcgaacccgggaggcggaggttgtggtgagctgagatcgcgccattgtactccagcctgggcaacaagagcaaaactctgtctcaaaaaaacaaaacaaaacaaaacaaacaaaaaacaaaaaaacttgcctattaggtgggcacagtggctcatgcctgtaatcccagcactttgggaggccaaggtgggcagatcacctgaggtcaggaggtaaagaccagcctggccaacatggtgaaaccctgtctctactaaaaatacaaaaaaaattagttgggcatgttggcgcacatctgtaatcccagctactcaggaggctgagccaggagaatcacttgaacctgggaggcggaagttgcagtgagccgagatcgcgccactgcactcaagcttgggcgacagagcgagactctgaaaacaaaaacaaaaacaaaaaaaaaccccatgcctattgtctgacgcagcaattccaattctaggtatatgtcctagagaaatttttgcacattttctatatggggtcaaagttattcattttttaacacttttaatcgactacttttatatagacacaaaaatagagcaaatagtataatgaactctatgtacctgtcgcccagcttcaacaatgatcattttgtcagcctatacaacacagttcttaattgctaaaaattggaaacaaccgcggcgggggaggtggctcatgcctgtaatcccagcgctttgggaggctgaggtgggtggatcgcctgaggttgggagtggagttcgagatcagcctgaccaacatggagaaaacccatctctcctaaaaatacaaaattagccgggcatggtggcacatgcctgtagtcccagctactcgggaggctgaggcaggagaatcgcttgaacctgggaggcagaggttgcactgagccaagatcacgccattgcactccagcctgggtgatagagtgagactccatctcaaaaaaaaaaaaaaaaagatgaaactgccttatttatttatttattttttgagatggagtctcgctctgtcactccagcccaggcaacaagagtgaaactccatctcaaaaaaaaaaaaaaaaatgggaaacaatctatttgtcactgccttagtctgggctgctataacacaataccataggttcattaaacagcagaaatgcatttctcacagtcctaaagaccagaaagtgcaagatcaagtgtcagcagattcagcgtctggtgagggcccactgcccggttcatagatcactgtgttctcacggacaaaggggaaacagagttgtctgatctcttctgtgaggcttctaatcccattcaggaaggctctgctaccagccgctaatcttctccccgaggccccaccttctgacactgccacattggttagggtttcagcataggaatttggtgtggacacaaacattcaggcaatagcagtccctcattcggcatgtacagattgcgatatgtctaatagaacattgtgcagtcattcgtgaagtaggtctactgtattaacatggagagatttcaaatatatattgggtaaaacaagttaaaatgattatatcatttatgaaaaaaattagaacatatggttatgggcacacaaatatccaggtgaaatcaacaaaggggaagtagtaactctgcattgtgggccccctgggagaaaaggagaaaaggacccggaatggtattaggaagaatcacaaaggaactgcacctgtttgcagagtgtggttttttttcccttttggtaagtttaacttttattttatcaaaataatacatgtgagactgggcacattagctcatgcttgtaatcctagcactttgggaggccaaggcaggcggatcacttgaggtcaggagttggagaccagcctggccaacatagtgaaacccccatctctactaaaaatacaaaaatattagctgggcgtggtggcgggtgcctgtaatcccagctactcgggaggctgaggtgggagaattgcctgaacctgggaggcggagattgcagtgagccgagatcatgccactacactccagcctgggtgacagagtgagacgctctcaaataataataataatacatgtggacacttctgaaagtcagattgtaccctgaggctcatttgcccccgccacccctgtcccactgccctccccatgagtgcctcccagaggctgccctgcaactcctgttccccacggcattgctctgtttagtggtctcctttgatggaagattgagctcacttttactgccctccccatctcaaaccctgccccacacatgtacccactttccctcccttcaccctgcatggttatatagaaacacttttaagtacattttcagaatttacatttttgttttgttttgttttttgagatggagtctcactctgtcacccaggctggggtgcggtgtcgcgatctcggctcacagcaacctccgcctcctgggttcaagcgattctcctgcctcagcgtcctgagtagctgggattacaggcatgcaccaccacgcccggctaatttttgtatttttagtagagacggggtttcaccatgttggtcagggtggtctcgaactcctgaccttgtgatttgcccgcctgggcctcccagagtgctgggattacaggtgtgagccactgcacccagccaagattttacattgttaacattaagttaatattcacatctgaaaatacagagtgtctactatggtggcattaacttttcattttcctggagttgatgttcatccccagacaagttgtgcgttgccatctcctcttcattctttcggagacaccaggtaatctgcctttttgtttgtttatttaaggccacatccccaggagctgctgtccaggtgcctggcgggtctccaggcctgtggacagcgagcgacctgggcctccctccccatcgccgtgggagttccctttgcctcctctgtgctggctgcccaggtgcctggatcccttgtcttccttattcttggtttatttagtcctttgttttgttcgtgcccatccctgggcttcttgggcagacaggctcacaggtggcacacctcccaaggcctggcgtgtctcaaaagattggtattttacccccactggattagtagtctaactggatagaggactccagcttgggaagcgttttccctccaaaattggaggacattactccagaagcttctgactccatgtcactgctgaagacagttgtgtgtgacccttggtcttcagaagtgtggtaggctggagatggcctccaaaggtacccaggtcctaatcctagttgttaccttagaaggaagaagggctttttcagatgtgatgaaggattctgacctggaaaggtgatcccggatcatccaggtgggccccgaatgccatcacaagtgtccttagaggacagagacctatgctgaggagaaggcgatgtggagacagagccagaggtgggagtgatgtggccacgagcaaaggagcccggcagccatagaggctggaaaagactcgggagggattcgttgcaggccctcggaggggcgcagccctgccctcacttggtttcggcctgtgaaagtgatgttggatttttgacctcccaaactgaaagagagtgggaggtctcttttggcatcccaaactgatctttcttctgagtgggacttttggcatcactccaggcgctccaagacctttccacatggatacgcgtccttcagtcccgggagactttccagcaggattcccctgcccctggctctctcgtctccccttccgggagtcccaggcagctggatgctggacttgctggactgagtctcttattttcttatcttttctcctattttccatatgttagtctttctgggtaatgtcccaaactatcttctaattctctatttattatgtttaaaaattttgcaactctatttttaatttcctagagctctttcttgttgcctttttaaaatagctgccgcctcttacttaatggatgcaatagcttttcttgtttctctgaggagataaattatagtttttctgagtatctgttctctatattacttttctcctcaatgttcctgttttttaaaaatcccaatttgttttggtgaattttttggtcatttcctcaaatatctggtggtggttcgctgaccgttcacactgaaaaatgagacaccaacacccattggcaagtctgggttggggtggagcttggtggcccctggtcctctcgctgggagatgagactgggctccctggggagcccactgcataccagtagctgcaggactcctggttcctggaacggaagcttccagttcgctgcctggaaaagagcccagtaagcactctgtggagccgagaggaccttccacacattccccaacagccatgtgatgcctcacctcctgggccagccctgatggccggggctggagccttgtatcttgggaaagacgctgtggcacagtggtcaaaggcaggaccctaggttctgaagccaggggcgtgcaccgtggcactgacacatcctagcagcgtgccttcctgccttcgtctctggagcgggctgggatgactcccaggtctctgcagctcagaactctttacacaggagactcactgtctagctgtctgttctttccagccggatactcttcaggttcaaagctgagtcactgtttctacccacattggcttcgcgttctttaatttggtgttgccatcgttcaccttaaaacccagggccacccttccctgctgcctctctgcctcccatctaatgggtgctgttgatgccacctcctaagtatttcttggcacagtccctcttcattcctattcccaccaccgtggttcaggtcctcattgtctcttgcccacattagaacatcttcctagctgaccttctacttctcatctttccttctcaaatccagcttccccagagctgccacagtggtcctgagctctcagttgcaaatctgtctccctgctgcctggtatttccatagcatcccgacatagaggacactgcccaagctgctggtggggcccactagctctggactgagtctcaggctcagcccttaggctcctctccctgcctgcactccctgcctcagcgggccacgccaggctgtttgcttcctgccttatctgcctttgctccagccgccccagcacctggacctcctcccctcctctgcctgcccccctccctcccctcttctccctctggacgtcccttcctcctcccaccctggagtctttccttcaggccatcttgctaactctgccctgctctccacgcaggcgtggcccgcctcatcatccttcacttctcatctctgctgcctctcactcagcctgccccagccagctgatcacagtcccaaatagcgacatgctctgaaagccaccgctgtggcctgcatcaggatgtgcggatgagaggggggtatttttaccatcattgtgcttctccagcccctggtgttaggatctgtataggatctggttatttgtaggcaacctgggtgtattagattcctacagctgccatcacagggtgccaaaagctgggtgaaaacaacggtgacttcttgcctcacatctggaggccagaaaccccaattcaaggtgtgagcagggccgtgctctctcggatggctctgggagggtcctgcctggccactgccagcttctggtgtttgccagcagtccttggccttgcctgacttgtagctgcctcactccagtcatgtggccgtcatctcctgtgtcttcacatcttcattctgtgtgtgtctgtgtccagatttccccctttttataaggacactaagcatattggattagggccaccctaatgactttatttttacttgattaccctatttccaaataaggtcacttttttttttttttttttttagacagagtctcactgttgcccaggctggagtgcaatggcgccatctcggctcactgcaacctctgcctcccgggttcaagcaaattctcctgtctcagcttcccgagtagctgggattataggcagccaccaccacacctggctaattttttgtattttttggtagagatgggtttcgccttgttggccaggctagtcttgaactcctgacctcaggtgatcagcccacttcagcctccgaaagtgctgggattacaggcgtgagccatcgcgcctggcccaaataaggtcacattctgacctaggtgctaggggttaggacttcagtgtatcttttttggtgggggacacaattcaacctctaacaccgggtgacacccgcttgtcctgagcttgacaggtcccgaagtccccaaggcctctgggaggccctctctaatccagccagcattcatgtcctgtcatcttggaacgaggggaattgagtggggagcaggtcctgtgaagctctccagcaggggtggggtggcctgaagagggtcgggaaatgtcctgggccacctgcaagtgtctgctgggtcctggcatcttcctccctgcaaagattgtccagttctgtttagaattgagtctttggtgcccctagcctctgtcgcccctcgcagccctgaaactcagcttccctggttcccattgccaggctgcgtctgagtccttttgggctttagtgacaaaataccacaggctgggtggcttttaaacaacagacatttatttctcacagttatggaggctggaagtccaagatcaaggtttcaacatatgggtgtggggggcacaggcacgctctgcattagtctgggaggtgctttttgctgaccttgtccttcagaccctctctctgtcctgtcaacatcactttgggctctaatcaatatgtatgggacatttgtgtgtcccactagtgtgtgtgtgctgttcccaggaggggccaagccttactaatctttatctgaatgctccataatatttctaggtaaatctttttttttaactaattgattaattattttttgagacagagtcttgctctgttgcccaggctggagtgcactgggaccatcatggctcactgcagcttcaaccttctaggttcaagcaatccttctgcctcaggcttccaagcagctgagactatctatgggcaccaccatgcccagctaattttttttttttttttttgagatggagttttgctcttgttgcccaggctggagtgcaatagcacgatctcagcccaccgcaacctctgcctcccacgttcaagcgattttcctgcctcagcctcccaagtagctgggattacaggcgtgtgccaccatgcccggctaattttgtatttttagtagagatggggtttctgcatgttggtcaggctggtcttgaactcccaaccttaggtgatccacccgcttcagcctcccaaagtgctgggattacaagtgtgagccacgtgccaggccacacccagctaattttaaaaagttttttttttaattttttggcagagacaggatctcaatatgttgcccaagctgatctcaaactcctagactcaagtgatacccctgcctcggcctcttaaagtgctgagattacaagcatgagccaccacgcctcacggtgaatcttaacagcctcatgccactctgcaacctcattgtgacctgaagtatttcttcactgattcattccctcagacatttatttagttctggtcttacgcactgtacagagtgccagggagatgtggggacaaaagagaccagggatcctgtgcccagggccctaacagtgtctattaaaggagacaagacgggtcaacaaatctttataacattaaatgctctttgctgaggacacagacgccacggagacctcatggagagccccctgagcaggacgatgggtggggcacagacaaggacagagctgagggaggtggctgcccggggaatatagggaaggcattcctgagcctactcctataggatgtggaggaatggggacaagtgaccttcccatgtgagccctgcccacaccccgtgctgcagggtcggcaggaagctggctcctcgtgcgccagggggcagtgttggccctgaaattctcactgctttccagtgaggctgggatggagcagccacctcactgcaggccctcgggacccctcactctgctttctctgagaccccctttgtcccccagtccacaagtcccgagaccatggcgccagtcgcctcggtgccaccctttccccctcggctgctcctttgaatagagggttgccagggcgatgaggagccctgctggcactgttcactgctgttcgtcgccgcagtgccacttggagcagccggcgctcctgggggcccagagcccggacagctgagcctcggcgagcacccgtgctgtgtctgtttccgtctttggtattgtctctctcctgtcttctgtgtctgtcacctgcattgtttccagcgtcctcccttctgccccccctgcccagaaatctcagcctcagtctgtcctctcttgggtgctttgatatcagccgtggcagccctgagagccaggtggagtcgttctttcatctgtccctcttggctgccagccctggggcccgtcggacatgtttagagcagagccgcctggggagagcggccccatccgtcagagctgccaccgccgcagccccgagtgctctgccaagagctctttctttctggttctgacctgctttcactggcagctgtggagcccagctggggctaggggcacagcctggtgcgggtgctggtgctgggggcagctgggcccataggaagtaggtgtgtggagctttgttggttcggaggttcctggggcctgtttctgaaccacacttctttcttctctgccctctgctgctctccagcacacctctgaggatttgctgagggacccaggtgctctgctgggctttcagaaccaacttgctggccacccgcccctgaagcagggcctggtctttcccttcctctgcggcctcttgcccactgctgccctctgaggctgcaggagacgctctgtgaggacaggaatatgtaggacgaagcgatgtggggcctcagctgcagcagctcttaggtggcgccctgccctggtccccagaaaggctgctgagcactggggccacgttgttgtctggaacaaaacttgggggatgatggcctgacagcaggattctgtgctccttctggttgcaagaggcatcctgggagatgtagttcaggtctgaagtagtgggatttcagggacattttgatgatttattagacaaattgaaactgccttggcttatctgggacatgtgactgctgacattgttcgtcagctctcgttgggaagctctgagtgccactggtggccctgctggaggccaggccagtgacagttttatcagaagtggggtttttggttttggtattttggtttccaagtgcctgtcacactgtgctcctgatgaaagccgtgacttactcctttagttgagtgaagagtccataggccaactctgatgggtccgagctcctgctctggagggggccatatgaagcgggctccaggccggctctgctggtggcctgggtgtgtcacttaatcccactgcacctggtcccttacctgtacagggaggtgatgaggggctgtgagggttactgagtgagtctgcgtgaagagccacagtggcccctgcctggcaaggagcaaggctctgctggggtcactgcccaccattgtgccctcctccactggcactggccgggcaccaggtggagctcagtgagtatgtgttgtgtgctatggaagcggcagctctgtcaggagcggggcaggtgacggccaggccctcgccctgcctcagcctgcaggtcgtcgtaggtgccttcctgactcccttctggaaggggaatgctgagttattgatctgaagctgaagctgggagggaaatggaagctgtggagtcacccgagaggcagcaggggaggaagcaggtgccccacacactactggcttcactgtggctcattcttgcttgcaaggagttatttacacgtcccaagtgacagtcaaagctgtcttatttcttggtctcttatgcacaacccgaggccaagaaaagggatctgtcagctggcatttgcagaaaatagcaagtgggtctctgggctgtcagctctctggagaggaaaacagggtgaaggatctttgggtgatggtggttgcttttctctcactcactcactactgtttccccatttctgaggtcagaaagggagagctttgcttgtgtgtatcaccaggagcaagcaagacagtggcatcccccgaggcgtgtaactgtaacctgagctggttgctggccctggcagcatcccagaatgcccttcacacctggggctctagcagcctcccttgaagagttgcggctcagctcgagggagcaggaaacggctctgtgggttctgttagtaaagccctctgcatttccagggaagcttctcagccaaacttgacaaccttgagaacttcttgattgccatccaccaaccaaatacccaaaagcagggtgcagcatgggactgcagcatgggactgcagcatgggaccgcagagggagcctggccccagccattgctgccccctgcttcctgtgcctggccatcgcctattctgtgccgtgctgtgaagatggcaggaagtgcctggaatggtgccagccagaagggctgcagactggtggcacttgctgggaatgtgccattgtgagttgaaaggctggcatactccagtgtctgggcttggtttcgtacagcctgaggaccgggagtgtcattaataccagaggcaaggcttctgggggtctcaggaaggccgtctcccaccctctgctgccacttccgagggtcaccataggtgcctccagctgcaggggttccttcttctataccccaagtgctgtgcagaggcccctgctcccttcggctttggggaatggtctagtattggggagcagggggagtctgcccacccagctcctccctttgaaccatcccagacccctcaagctcagcatacccagagtcggcttattccaccataaccttgaagaccctgcttcctggagagagggtggtgtgagggggccacgcccatcttacagtgcggtttctcccagccgatgttgattctggaaaggcctgggtttcagatctgggaaggcagtgccattcgataaggaaaaactgggttaaccaagttctaggaagggtgcaggcgccctgggaatgcagtggtgtttcagttcatctttatgtctgttgggccccatccgtgcctggcattgtgtgcgggtcagggagagacaggttggtggtgggggtcttgtgtgaccacagcggtgagcttagtttcagggccataactaggttctaaggagcagtgcagccctcaccctccgtcattcacagcagctcctgacagccttccccagccccacactgcctgctggccaacatttccgtgtcttccgcctcactcggcagcacatcccaaatccatcacagaaacctgccctcccgtctctgactgcctcctgtctcagaccacctccctcatcatcttgccaggtccctagggggccgagggagcaggctgtgggctgtggatcagctactctctgcgtgacccaacctcccgcctccctgcagccagcggcccatgccagcttctaggcctcaggttcacagcctctaggctcactgctgccccttcccctgattgcagcccaggcctccagcagccttgtgttggggaactttgtattctgggccagtaacctcaggcagaagagcagctgtctgtggctcctcagacaccctcctctgtgcactgaaggccggtacagggtgagtgctctgggacaggtgcccccctctctgcaacacctgacactcccaactacttttgtttggggtgggtcttcctttgcagaggaatgttggggacaggtttctgcattggcaaaagcacgtggtgtcctcgggcctgtgtgtttgctccaagtgtatgtgggcatcacacctgctggctcccctatgcagtgaactctgctaagcattgggtgcatggtcagcctggcttggtgggtgggctgcctgtgctgccttcaccccaggacggcctggcctgtggggaggtcagcatggagctgcatcatggtgcgagtgggagggcgcaagtgtgtgggccttccagctgtgtggggccgggggcttcctccctggccctctgttcatctgggaggggagggagttgggaagatagtgacagcagctgatgtttgtcacccaggcatggcgctttagctgtactgtctcagtcgacccccaggatgacctgcttagggtgggctggtggaaccccgttttacagatgtgaaagctggggcctcagaggtgcccaaaccatggagctggggcagcccccggccagtggactgtgggcctgcgctgggctgtgccccagaggaggctactctctgttccacttttccctgctctgacttcagccgaagagccctgatcttttcccttccataaacatctgcctggcatgctgccacccaaagagctcccgtgccccggggacagtcctcttggcctcaagtctaggcctgctttcgcttccctctgagggacacaaggactcacggaggcattcctgtgccccccgctgcccacagcctccggctcttggtggagtgggactgctaaggaatcctttacccaccaagaaaaaatgaggatccaatgcaagaatgtatgtgagaggggccgccgagggggcggcaacatgtcagcactccatcattttcctgcctgagctaagcagacacttggtggccacgctgtggggcagggtgcagccttccagaggctctggaggtgaccggcctttggcatatcttctgaggaaatctctttctttgcatggaaaaggcagtggggagtgagtgtggtgtggacaggggaggagagcaacaaaaatgacctgtttacccacaaaccacgggtaagtgcccctgtggtcgcagggtaaacccacccaggtgggaggaaaggactggggctccctggaaaaagcttgaaactgccctggaggtttgagaatctcggtgccagtgggctgctgccagctgtgaggctgctcacctataggcaggccagcaggtgaggagggggagggtgctaggctcctgggagacacatagccaagtcctcccacccaaggagtcggtgtagcaggagctcccttcgccttttcctgcggagctcttcctgtcccttctgtatatttcttcttttttttctaattataaataacgcatccccaatggagaaaatatggaaattttccatatggaaatatagaaaagcataaagaaggaggaaaacacaactctacagcaattccatagcacgtgggagtgaggagggtggcatgcaagcagtcctacagttgttgccattcctttaaaaaaacttcatgagatcatgttgtttaccattaaattttcttggcttcacattacatcacaagcatttcccatgtcatcaaaacctgtgcaaacacattattgttaatggttacataatgtctgtgggagccagggtgtggaatctttaaattgcttctcatgattttctgttgtaaataatgctgctttgaacatctttctgcgtacatcttggttcccattttggaatatttcctggggttggatttctggaatagtaatgactgggctcaggggcataacccgccaccatgcctagctaatttttttgtattttttagtagagatggggtttcaccgtgttagccaggatggtctccatctcctgacctcgtgatgcacccgccctggcctcccaaagtgttgggattacaggcgtcagccactgtgcccggctttttttgttttgttttgtttttgagatggagtctcgctctatcacccaggctggaatgcaatggcgcgatctcggctcactgcaacttccgcctcacaggctcaagcaactctcctgcctcagcctcccgagtagctgggactataggcgcccactatcatgctgggctaatttttgtacttttagtagagacggggattcaccatgttggccagggtggttttgaattcgtgacctcaaatgatccgcctgtctcagcgtcccaaagtgctgggattacaggcgtgagccaccgcgcctggccgggcataaataccttaaaggctcttgataagttttgcaaacagcttcccggagaagctgccgtgatgctcagcagtgcctgcgggccgcctcctgaaggccttcctggcgctcagcactgcatttacaaagctcccaggcaggagtggcacctcatggttgtattttgaatctcttgctttctcgtgggttcaagagccacttgtgtttgctgtcttgttgctgtgcttgtcccgaaggctcccctcgcctcttcctgactttgccctatgtggtaacttgagctcttttgacatggcctttcccagcgctcagcagagtagacatttggtgcccaggaggagggtgagatttacaccccacacctgctctctgatgccagtgccgcctgctcccagctgggaaagacctgtcctcctagtgggcagcatccgataactcgcctggagcagggcttagaggattgtagatctgcatgtgggagatagcagggtgataacgtctgacgttcatcctgctctgagcagggtgtctccacacctgagctcctcgctggtgctcccggcacctcttgagcagcaggtgctggggcatgcactccctaaggttatctcctccagcggcattagcggtgggtatggttcttttcacttgtcaatttgaaatgatttcagactttcagtaaagttgcaagagtaagacaaagaattctcgtacccctgaccccagttcccccaatactagcatttgcttcattgttcccgtttttccctgaaccatgtgagtgggtgtaaattgcagatgtggtgctcgtggacccttgagttcctcagtgtttttccctaagaatgaggctgttctctaacataaccacagtccactgatcaagatcaggaaattgatatcaacgcaatcctctttcaaacctgcagaccttatttaaattgtatcgttgtcccctgatgtcctcttagcaatagaaacccggatccaatccaggatcgtgtgtggctctcaccattgttgctttggtctcctttcatctgaaaccgttcttgcgtctttgtctctcacgacctttgacatgtttgaagagtccaagccagttattctgtggaatttccctgaatttgagtttgccccttgctttctcctgattaaattcaggccgtgcacggcagcgggaaccccatcaggaggtgtgtggtatcccttcggtgctagtgatattaaccttcatctctcggtcagcgtggtgtccgccaggtttctccactgtgcaatgaataaggacaaggtatattttagaaagaggaggagcccagagtccagcaaggttactctacccacgttcaccatagccgggtgtgacctgggtgcctcctggtcaccgcagtggccccttcccagcccccatcttaccctgcctctgggagtcatgctctgcccaactcgcgccccatcctcctgagagccgctcgcttctgcccagcgacccgtgcgtccctccctcctccaggcatcccccctgggctccttcttggctcttcctcctcggccagactcaactccagtgggcctgaagacgcaggcctgacccacttctcccaggctgttctctccctggcttcagacaccaccgcccctgtgatgctgcccaggttcttgtccctgctcttccccctctgtgagcttgcctcactcccagccctgccttttctgtcttgcccttcttatagcaggaaaagtcatctccacccacccatacaggatttcttcctctaccttgctttctatggggggtctctcgacgaatcttgtctgtcatagcccagatgtttcctaagccccaccccgacccccatagcttccccctgtcagaggctccgcgtctctcagctcagcctctgaattgccccagacatgcgtcgtctgtcagcccctgctgctcgccagtccagagagatcctttccactgtgcatcgatcatgtccctcctgtcctgtccatggctgaagggaggcctcaaccactgggccctgtctgtggctgcagccccacctcaggccgtgggctcacacttccctctctcaggacagcaccaagcctgttcttcctgagaacttcacaattgctatcccttcttcctggagctttctctgcggatctgtgcgtggccgacttctccccatccaggtcccagcttctgtgtcccctcctcagagaggccttttctaatatccagcccccaaacccctgcacccgccccagatcattcgcaaaatgtcacctgtttcttatcttccaggcacttgtgatctgaaatgttctgatttgtgtcttgtttttcttttctttgctcctttcactgccattcatcttccatgagcagaacccttcactgttgtgttctcgactcctaaggcttagaactgtgcctggcataaggtctgcccctagtggggttttctgtttttctcccctggctgtgggtctttcctcctcctcctcttctctttcttctacttatttccttgtttcttctcttttctttttcttctgtctttatttccccttttctaggttgttggctgtaatatggcactaaggtttttgcaatatttgtttcatttcttgagtatgtttttatgttccttacttaaaacaaaatggctgagtcaagtgttttaaacgttttctaagaaatgaatcagatcggccgggtgtggtggctcacacctgtaatgctagcactttgtgaggccgaggcgggtagaccacttgaggtcaggagttcaagaccagcctggccaacatggtgaaaccccatctttatttaaaatacagccaggcgtggtggttcacacctgtaatcccagcactttgggaggccaaggcaggtggatcgcctgaggtcaggaggtcgaggccagcctggccaagatggtgaaaccctgtctctactaaaaatacaaaaattagctgggcgtggtggcgggtgcctgtaattccagctactcgggaggctgaggcaggagaatcactcgaacccaggaggcggaggttgcagtgagccgagatcgcaccattgcgctccagcctgggtgacagagcaagactctgtctcaaaaaaaaaaagaaaaaagaaaagaaacaaaacaaaaacaaaattagccaggcatggtggtgcatgcctataatcccagctacttgggaggctgaggcaggagaattgcctgaacctgggaggcagaggttacagtgagcagagatcatgccattgcactccagcctgggcaacaagagcgagactccgtctcaaaagaaagaaatgaatcagatggttagatgaggcccagatgcaggggtgaaaagagtgtgtctggtttggcttgggctctgtgctgggcagctgtctttttagtctccactgtaccttggtttccttcattttacaaatgaagggctggccaacctctgaagcctctttgcattcagggatataagttgtcgtcagttgatttaaatatatatataatattatataatattataatattatatataatatatattataatatataatataatatataatattatataatatatataatattatatattatattatatataatatatattttatatataatataatatataatatatataatatattatatatatttatattatattatatataatattttatattttatatataatatattatatataatatatatatattttttaaagatggagtcttgctgtgtcacccagactggtacagtggtgccatctcagctcactgcaacctccacctcccaggctcaagtgattctcatgcctcaccctcccaagtagctgggattacaggcatgtgccaccatgcctggctaagttttatattttctgtagagacagggtttcaccatgttgcccaggtgggtttcaaactcttgagctcacacaaatgtgccttggcctcccaaagtgctgggtttacaggtgtgagccaccgtgcccaacctgaagtattatactttttttttttcctgggacagagtcttgatgtcacccaggctgagggcagtggcgcaatctcagctcactgcaacctctgtcttctaggttcaagcgattctcgtgcctcagcctcctgagtagctagaattacaggcgtgtgccaccatgcccggctaatttttatatttttagtaagaggcggggtttcaccatgttggccaggctggtctcgaactcctgatgtaaggtgctcctcccacttcagcctcccaaagtgctgggattacaggcatgagccaccgcgcccaacctgatacttttattttttttgagacggagtcttgccctgtcgcccaggctggagtacagtggcacgatctcggctcgctgcaagctctgcctcctgggttcatgccattctcctgcctcagcctcccaagtagctgggactacagatgcccgccaccacgcccggctaatttttttttttttgtatttttagtagagacggggtttcaccgtgttagccagggtgggccaacctgatacttttaaaagttatagtgcatattatgctgggtacggcagctcacacctgtagtcttaactactcaggaggctgaggtgggaggatcatttgcgaccagcctaggcaacatagggagaccctgtctctacaacaataaagtcacagttaggatatcaggctgagctgggggttccatttggggttggatttgctcccttctctagagccaggaaatgttgggcttggccaggcatcaggaggtagatggtgctagcctttctgtggggccactgtggggttgggaagggccctcactcattctgaggagcctcagtgctgaggctgcgctaacctgggctctaacttccctccctagatgctgaagttccgaacagtccatgggggcctgaggctcctgggaatccgccgaacctccaccgcccccgctgcctccccaaatgtccggcgcctggagtataagcccatcaagaaagtcatggtggccaacagaggtgagcaccagtggggccggtgagaggagcctcatggccgccccagccttggcattcttctcccactcactgccccaggccctggcttcccactcccctttctgcttctcctaggacctaggaatctaacttcttgtttctttgccctctaggtgagattgccatccgtgtgttccgggcctgcacggagctgggcatccgcaccgtagccatctactctgagcaggacacgggccagatgcaccggcagaaagcagatgaagcctatctcatcggccgcggcctggcccccgtgcaggcctacctgcacatcccagacatcatcaaggtggccaaggtgagcccagtggcctggctgggcctggacagcagggaccagggagtcttagttgccgcgggggtctcttgaggctggcgtgctcagcgcctctgtgcgtgggtgggtaaacggatgcagctcagcaggttaggcaggggaagaggctggccgaggccttggaagggactgcaaggtaccgtcctctccctgacccccacctgcaggagaacaacgtagatgcagtgcaccctggctacgggttcctctctgagcgagcggacttcgcccaggcctgccaggatgcaggggtccggtttattgggccaagcccagaagtggtccgcaagatgggagacaaggtggaggcccgggccatcgccattgctgcgggtgaatataacgggcaagcaaggggtggccccgcagctcctggagagggtccagcagggaggggtggcagggattcccgcctgttacagagactcccccacacctttctcccaacaggtgttcccgttgtccctggcacagatgcccccatcacgtccctgcatgaggcccacgagttctccaacacctacggcttccccatcatcttcaaggcggcctatgggggtggagggcgtggcatgagggtggtgcacagctacgaggtgagtgaagatgcccagggctgggagcagggcagggcagcctgccgtgggggcaggggcggaccactcaagggatctggaaagtgggtggggttcatggcaggggagaggtagcgctgtggggtctgaggtctggctggcccctgcccgccctcgcaggagctggaggagaattacacccgggcctactcagaggctctggccgcctttgggaatggggcgctgtttgtggagaagttcatcgagaagccacggcacatcgaggtgcagatcttgggtgagtggtcctgacgccccgcctggggcagctggaggcgggagctgagaggcccagtcctggtgccgtcacagtggctggccttggggacagccctggggcctgtcgggcgcttttccagaggactctggaaagtgggctctaggggccgagctggcagttggtcctcacagccttggtgatgctggtgtctctcctggcagcctctgtaccgctggcagccggcactgactggcgacagtggttatgtgggggtgatggggcatttaggaggcgtgtagattccagtaaaagctaagcccagtttacctccctccccaggggaccagtatgggaacatcctgcacctgtacgagcgagactgctccatccagcggcggcaccagaaggtggtcgagattgcccccgccgcccacctggacccgcagcttcggactcggctcaccagcgactctgtgaaactcgctaaacaggtgaagggtgggcttcccgtgttgggacaggagcctgtgctcacaggccggcaggcctcacagtggggcgctggttggggaaggggaccctgagtccccttctggggactggggatggggagaagagggtgaaggactctcctgggggccagaagtgggtttgtggcatccttcccatgtgcagttgaggcacctggcccagaggccaagcttagagtccaggatggctgagaagagggagggaaggagccccagccgcctcctcagccctgctgctacacagacctggcttctctgtggcatcagctcatccctgtcatcaggagaatgagattccgtggattctgtcaagattgaggaccattatgaaggcagtcctccctcatgtgcttctgtctcctacatcatgtttattatgatctgtttccttgctctgcaccctctgcccatctctgcttttctgggacctctggtcggggggtcctgggctgtggaggaggctgaggtggcaagctatctccccacagtgacctgccccaggactggcctggagagcacctgctgtggccaggtgtgcagcggggtcctgccccctcttcttccctggcctataggcagcagaggatgcgtcacctccccatgccgaaggccggggtgtgcactctgcagcaaggcctcagccacagctaatgcgaggcatcgaccagggtcgcgtttaagtcaggtcttatttactggcttatactatttcacattccagaacaggtttaagggaggtgattcagtctggtttatcgttttggtgagaccaaaagtgaaactggaattagggctgaaatttgagttagagtcattatctgttggtacctctcaaatgaatttctttgggtggtggtggccagaggtgactgcgcagtagactagaaggggactttctgaaaacacctccaagcagaagcagcggctgggagaggcctgggtctccgtgtctgggtggatgacacagccttggcgggcaagcccaggaggcagcagggcaaggtgccgagcctgggatgggtgggggcttctgcccatgtctcgtcccagataagctgggtgcagccatctgtggctccgggaaccctggagcctagtggactacttgggggacgtgtccaggcaggagcatgacctgggccctggggtctgtctgccatctgtgggggcagggtttgccacaggccattcttttacggaaccaacccaatgggtgggacggaatccctgtcctgagtccagtgagtttgcccaggccctgcctgtgccctcccctgctcacgtggccgcccccacaggtgggctacgagaacgcaggcaccgtggagttcctggtggacaggcacggcaagcactacttcatcgaggtcaactcccgcctgcaggtggagcacacggtcacagaggagatcaccgagtgagtgtgggcgggcaggcggggcgggaggcgcggcttctaggatttgcataaagtacaggcgaagtggctcctggggccagccagggggcttgctcactccccacattggtggagagcaatggggatccaggtacttagtgttttaaaagtcattattctaaaagcattacgtggttattataaaaatcagcacaaaggagcaaataaaaatgactgacagccctcctctctgtcaggacgctgccgattgctcaggcccaggtgctcccatctgtcagaggagtaaagcaaggctcagagacatttggagagttgctcggggtcacacagctggcgctggaacccaggcatctccggctgtctttggtttgctcctttcccggtttacctgttttactagagacatagtttgatgcaatagagatgttttatatagaatttttattctacttttcaaattatttaatatttgttgaaggcatttccccaggccataattctgtctgaatacttttagtggctgcgtactattccgtcttgtgtgtatttcttaacttacatagtcctcgattgttaggcaattagtttgtgtgtctggctttggtggttattaagcgtgtcacttatcatctgtgtgcctgaatgtttggcttcagctctgaagagttctgagggtaaacccttcaacaggattatctgattgaaggataagtagcatccctcggaacagccctctagagaggtggcactagcgtgctccctgcaggcactgaggatgacattttcaaaatccgcctggtttctaaatgacagtcatgatggccctcacccttcaaggtctctactatgagccatgtaatttcttgacgctgctttgggccagcccatctcactgtggagcatccctgaccccagttctgcccccagccccaaccccacctgagactgaggatgctgtcggggtggctgctgtggctcgccgggggcatggaggcccctccctccccttaggagaagcttagagacaaggccaacactttggccgagtgagactcttcccctcaagctgctgtgaactcctcggtcttgggtctgcttagagcgtcctgttagggatgggagtctgtctgctgtggagcacgggttttgtgtcagacagattggggctcaggtgctctcaggtcccaagccacgtggagcctgggtgagctccaacctctctgaccctcgagctcctcctctggtgggaatgacagggctctcagcacaccgtcgtggagatgaagcatgggaggagtgcagcctggcctgtggcactgagtggaagctgtcatctctgctgcgaagtgggccagcaggcagcaagaacacggggaaatcctgccagtgtaggttccaggctgccttcaccacaagcctcagtggcaatacatgtaaaaccttgagtggttttttttaagacatagtcttgctctgtcacccaggctggagtgcagtggtgcaatctttgctcactgcaacttctgcctcccgggttcaagtgattctcctgcctcagcctcctgagtagctgggattacaggcacacactaccaggcctggctaatttttgtatttttagtagagacagggtttcaccatgttggccaggctagtctcgaactcctggcctcgtgggattcacccactttggcctcccaaagtgctgggattacaggcatgacctgctgtgcccagcctggtttttttgtttgtttgttttgttttttaaacagctgttccacttggacttgtgactgcccttaggagcagtaaggctgagcttggaaaaccctgcagaggtggggaagcttgcactctccaagcatctctagggggttttgggcacaagtccagcaggaaaacaggcctcagaaggacaggtcctgacccagcacccactgtgcaaccctctcacagctgtggttaccatttcgaggagcccagccttcacagcacctgttcccttgcacactgcccccctcacaaccacccacacagcatagcacatatggccccaagaatgtgctatcctggccctctgacctagagatctgctgaggcttcaaatctaggctttaccaagggggagtttaggggagtggggaaaacagacctcaaggaaggaggaggcagagtacagggaggagcagcttagggctgtgtggacggcaccgtgagtcaggaatgcaggagcaggtggtcctggtatttcagcgggccatctccagctgccaggcactgtgtagtttagtcggctcccggcgggagcagggcaggggctggtggagccactggttgggaggaaccggctgttcaggctggcccagagcctatgggcaggagtcgcactgtgtgtggacgccccactggctgcggtgcccctcgtctatcccccgcctcatgtttccccctttctcccgtcctttcccccctccccccaatgccctacagcgtagacctggtccatgctcagatccacgtggctgagggcaggagcctacccgacctgggcctgcggcaggagaacatccgcatcaacgggtgtgccatccagtgccgggtcaccaccgaggaccccgcgcgcagcttccagccggacaccggccgcattgaggtgggcggagctcgagcagagggagatgccagctcacctgtgcacaggttctgcctggtgcctggggctgcagtgccaagttgccacagcccggcagttagggaggacccgcatgtgggctctgaagtggacatagagtacacggaggcaggcagtgcccagaggaggggcggcgcctcccaggggaagagactgctgggcgcccaggtcaggaggaagccgtgagggtgggagcggggagcaggctggcttggtggagcaaaacgcagggacccagacacaaagccagcccctgaccctccagctcccacaggagccccacgcctggctgccgacggagcccaagcaccacctcccatctgagggatgggctgacatggcaggacctgggggtgggggtggcaaaggactgggcccagaggtcccaatggagtctgagccaagctcaggggcccatcaaggatgggggagggagtcggagatggcggcacaggagggagaccgagaggtagattcggggccgcgagatggcagccttggtgggggagagagtggtgtagggggcgctgaggcggtccacggcaggctcctcagcacagcaagactcgcgccttctccaggagggctccctgtacctttcttcctctcagcaccgggacccagtcattggcctccgaaacccatctcccccgcctctggtcccagctgtgggcaggagccctgcggcctgctcggtgcctgttcccagccctgcacgtgctgccagcaccgtgccagctgtgctagggacttgctccctatccaggggcctgagccccaaaggaggcaagacattgatggagctccagctttgctccagagtccaaggcagaggcccccgggcttgtgtggggcggtgaggggagcaaacatgagtttgggccaggctctgggcttctgagacaagggaggctggggaggctgggggtagggaccagagctctctggattctggaagcagcagagcctgtggcttcagcagggagctggccacctgccttctgtttctggaagagtctgtaggtggcggcagccccaggctgagtgctgcccggcggcccctgacttctctgcctccctccatccccacttccaagccctggctcttcagagcctgcctcatcacagagtatttttagccgacagtttctgctctcagctgagtgttcacccttaaatattttatgaagttcctttttattgaacacaggcctctgcccccgagaagcggaaatgggcagtgggtgtcccgagcccctctgggcggtccccccactccccttcttccttacctgggcctgacgggtcccccacctccggggagcccttctctgcggggctcactcgggcggcacgaacaggtgcaggcggcacgagccacctgtgtgtgtgagtgtcggcgcctctgtctcctcctctccgctgcccctcccattgccgtctggccctggccctgtcccgctgccccgctgccctctcctcgcccttggtttgcttccctgatgggtgtggaccctgcctctggcactttcccttcatttcctctcccacttcctcctcgttgcctcctctccctcccatcctcccttctggaaggaaaggaaaggaaaggaagggagcatgggtggatgttgaggccttccccaccaccctgttaaaaacaaaaacaaacccccggtcagccttgcctcttgcctcgcacatggtcctttggaggccctgtcgccggcctgccgtcccctcgctgtctgggagcccacggcgaggccctttagcggccgggtcagcagacctcaatccgtgctgtggaacgaacgtggatgagtctgaaaggctagagggttgctcaggcaggtgcagcaggtccgtgggaatagaggcagggctggcccctgcctgcccgggcccctctcccgctctgcggcaggcattcccttcctcctctgccccctcccagctcctcacagggagccagtagcagtgactgcgtggcacgtagagaagggacgcactcctgggtttggtggcagaaacagcaaaacctgaccagccagagctgggattcacctgcagacaccccacgctctgctctcagcagctgctgggtgcacacctggccagcctcggggtgggtggggcacttttgaccgcagtttctggcgcaggtcctcacgcctcacccttcccacaggtgttccggagcggagagggcatgggcatccgcctggataatgcttccgccttccaaggagccgtcatctcgccccactacgactccctgctggtcaaagtcattgcccacggcaaagaccaccccacggccgccaccaagatgagcagggcccttgcggagttccgcgtccgaggtgtgaaggtgagaggctgcagcccccgcctgcctttgctcccggcccttggagggccccctgaccgttcacttccccaccaagggccttgcacatggcttcacctcagccttgcccctgactgatgggtcgaggtcagtggctctccttggctgcagctgcacgccagactccagctgttttcagagtctgcaggcgcctgggcaacccgctgccagagtccctggcagtggcctggccggagctcgtcctcacatgcctcctgtctagtcttgttccggggagacccacgctgtgtcccgcccctctggggtgagaatcacctggaatgtgtgttaaatatcatcaggcttcccttctggaaatcctgatcccacaggtttgggtagaggcgccagaacctgtgttttgaacaagttctccagataattcttttttatttttgaagtggaatcttgctgtcgcccaggctggagtgcagtggcgcgatctcggctcactgcaagctctgcctcctgggttcaagcgattctcctgcctcagcctcccgagtagctgggactacaggtgccccccaccacgcccggctaatttttgtatttttagtagacggggttttatcacattggccaggctggtctcaaactcctgacctcaggtgttccacccgccttgacctcccaaaatgctgagattacaggtgtgagccaccgtgcctggcctcccagataattcttaatttctggaaaatgtggatccccccccaccaggcaagagcccaagtcatgtagatgcggtcactttgcacagtgtcaggcccccgccagccccctgctctcctcacctggcctggtgcacacagtgtcaggtgcttcaggagcagccgagggtgggggcgcagcagagacatgagcaggaggcttgggaggcaacctgcccttggtgggctggcagctcggcttgtctttgggtggccttggtgggtgccctgcctggcatgaggactctaaatgggtatttaggatctaaagagccctttgctgggctctgttactggcgtctgtagctagagaggaatccacagccaggaaatgccgcctcggcctttgaagccagcacgtgtcccgtgggagccaccctcagaatggcaagaagagccggaggacaggggctttggccctcagcccctgtgggagttaccaccccatcttcttcttgggggtccccacagggcgggctgtgctgggcactggcaccggcccctctgccttggcctcgtgtcctccttgcagcttcttccagccctgcctgtcatcgaggcgcagttgcttgggggatgggggggcatgtgggccgtgctgtcccctcagggtcctgcaatcacttctcacatgtccacatggctgcttggtcgcaagagcccctggaggcttctgggcctatgcctgtgtgtgtggccagcctgtctcccaccttaagagggaacagcgcacttcctagaggccagggggtgttactcttccgtggggagcctctcagcctccctgttgggggtccctgtcgtgcacataggcagaggtgtgtcgcgacatcagctgtcgacatcacgcgctccccctgcaccttgctgcggctcctggtgtcctggcggggatgtcctgcggctgcttcggtgttgaggggatgcgtggccatgcacaggggtgacccaggccatccccctcgcctgcccctgcccgttgctctgtggtcctggctggctcctggggttgtgcccggttcctctgctccctcctcaccctcagcagctccccacgtgccaagctggtccctgggccctagaaccttgcgcctgctaggggtgcagctagaggtgggcttctgcaccctggagggcccggaaagatcttcctctttagaccgtcccccgccccccaggtggagaaaggggcactagagaccgtgaccacggggccagcagcaggataagtgtctctggtgtctgggggtgccaagtcctccccaaatgtgcaccaagaccaggccgctggctctagccgcctcctgagcctcatgctagcgcccagcgtggcagccctggccctcctgtccctttgccgtctgtgcccacccaccctgtcccgcgcccccgcccactcctccatggcgttcgctccccacacccttctctgtcgaggaccttgctcccattcatctaaaccaggctctcgaagcccacctctagctgcatgttctggggctgggagggcaggcacacgcgtgtgagccaggtccatgcacacgtgaacacacgtatgccttagagcacctgcctcacctcggctgcccggtggcagcgccttggccctcacacagaaaacaccagggagtctgtgcagcgtgtttgccgtggcctggggtgccagggccgccttctgagttttcatacagcacctgggggagcttgaccctctgcagggctgagggccacgtctgcccatgccccccagccagtgcctagaagcagatagttcaggaggctgcaggggctgggccaggtcggaggctgcccgggcctggccaggggtcctagcagagaaagcagggctcgtgcccatccggctgcctccctgcagcgagggagggcgaaggccgccttcccaggaaggcccagagcacatctgagctggcagctgcggtcctgctcggacccacagttctgacaggaaccttccagaggatcacgggctgatggcagagcagtggggttccctgcccttccagtccctttgggatggcgttttaccagtccacaagatgccctgggaggtggcagacacagctgtcagcacctggagccatgaggacttttcactgtacgctcagcccaggtccgttctcccagagggctgtaccgtcccccacctcctcctgttgcttagtccagtcctgtgtccgccccgcagaccctgaagtgccatggggaaggcgctcacacgtgctccccaggctttacactggatacggcgtcctgtcgccacctggcaggaaggggcgttctttgcacttacaggcgagggtaggccgcctgcccaagcccatgctcttgcaggtcagaagacaccaggcacagcccttggccgcagccctgggccgcccctgtggacaggaagccaggaggccccaggctgctgtgactgcccccaccggccctggtagccccacccttgtccgtgtgccaccagcggcccgtgtcctgtcctcccgtctcgggggacctagccagacaacaccagagactagcactgaggtgtccccaacaattttattataaataaaaacaagactcccagtgggtggctgcagcccctgcctcggtggctgtgagcacctgttggaggggcctgcccttaccctggtctggaggccagaaccgaggaaagggctccctgcccctccaagtacacaggggagcctgaggtactgagaataaaaaccagggagggactcccaggccaggcggcggccccgggccctctgccccacgaggctcatcccttggagcacacaggaagctgcccgtccatcacaccacactctcttccagccgctcggcgctgcctcctaccccccggcaccctgccccgagcagccccccatgcacagagtggctccgtcgggcccaagctcctcccaggcgcctggcataaccgtagcacccggcatctcccaggtccagagagcagctgcgctgcggccggggcggggggctccgcggcgggtgggccttgggtgtggggctggggcctccattggtctgggactggacgtggctgagcttgagggggaggcggccatttccggccccccggccccgaaccagcaaggccacagtgaagaccagtaaggcagccaccagcacaccccccacggccacggtcagggtcccgcccagcacgtgggcctgcagggcgtggcacaggggcgaggccggcagcgtggagaaatgggcacagcccagcagcctggtggccgtgaggtcagagggcccagcggccggtgacaaggccagcaggcagaggtcatagtcagcgccggggacgaggtgcttcagcaggaagtggtggctggaggctgggacaatcctgcaggcaagggcaggtggtcagagcccggggctggggtctagccccatcctcacctccccactcccgtgctcccagctccaaacacccctccccctggggccactcgggctcttgggttcactcaggaaggtgaacaggctggagagtgtggccaggagatgggtgtgtgcactggcacaggacgcaggcaagcgaggggaatggggtggggggatggcaccagcagaggcagaaataacacgcgggcgcgggccatgtgcttcagacagacccaaccgccacctgctgccggggaggcctgcacagctcagtgacacctgggacatctcggggtggggtccttctgccgccccttgagctccagccccctcaggcagccaggccaggccaggccactgctcctccaagagtccagcagccatggtcggggagggggtgtcagccccagagagaggaggggtggaagcaaagccttgtggggagcagagggcggaggaagggcgccgggagtgcagccgggtgtggggcacgcatcctcaccggtagatgagggtctcatcttcgctgctgttgtactggatttggaacatccacactgggtcggctggccgcccgggaccccagctcaccagccctgaggtggcggtcacctccgtcacctgcacggctggctcagactccagcgtcccctcaccctcggcagcagtgcgagcggaggcggcgatgtccgagggcccggggcggcccccctcggcactgctgttcccaccatggggcaaggccagcacccgcagttctactcgggctgtggcctcaccagcagggttggtggcgatgcaggtgtagcccccagcgtccccagcgccggtcaccccaatctctaaggtcccgttggggaaagcccgggctcgggaggagttgccaaccaaccggtcgtcaggaccgacccagtgcatggtaggcgcggggtcacccagggcccggcaccgcagcgtggcccgctggccttccagcacccagaggcgctgcgtgtggcgggcaatgaggggcggctcacaggagaactcgccctcgggcactgcccagaagtagcggccggccaggccgggcggggaggcgcacgtttccaggtcgtccggccgcgccagccgccgcagccacagcagctcacagttgcagtgcagggggttcccgctaaagctcagcaccaggggggcgggagaggcctctgcatcacgcccacgagagaaaagcgggtccggagccagcgtggccaggcggttggaggtgaggtccaggcgggagagctgaccgagctgggcgaaggcgcctgggggcagtgcgtcaataaggttatggtccaggttgagggtgtgcagggcaggcatggcgccgatgccggcccagggcacctgccggaggttgttgtaggacaggtccaggtcctccaggctctctaggaagtcgtcgaaggctcccggcgcgatgcggcccagctggttgccgctgaggatgaggtgctgcagattgacggggccccggaggctcccggtgcccagctccaccagcctgttgccgtcaaggtggagggaacgcaggctctcgaggtccccaaaggcgcgggccccaatgcgggtgatggcattgcgagacagtgtcaggtccaccagtcccgtcatgttgcggaagtcagggggccccagggcctggatgaagttgtcagccagccgcagctccactgtgcgccggtccacgttgggcggcacaaacagcaggcctcggtgggcacagagggtgctgagcgactcggacaggttctggcagacgcagggcagcgggcaggcggccgctccactggccagcagcagcagcaggagcggcggggccatggtgagcgccctgtaggaaggggccacagcccaggcacaggtggggctggcgcaggtgcccacttgggcccaggacagtcccagaagccagcttctgtgagcctggcccggggaggggctgggtcagaggcccaagagggccgccagagatgagggaaggttggggcctgcagggccaggccccccagagcaaaggtcacatttcccaagcagttaagggggagtccaggcgctggggacaaggtgaggcatgaggcaggaagcggaggaggaccgagagcagggagggtcccggaacttcctttcccaggcgtccccaggaatcgccagccgcctccccactccccgccataccctcccccgccagagaaggcgccccccgaacctcccgtggagtccgtggcccctccctggccggcccccgcgctgcgcccggcggccccctcacctggtgtccgtcgctcagggggcgcgggccggcctccctgcgagcccggccggcccccgccgactcctggccgctctcccgcggggacgaggcccggggatgaccggccgcccgccgcccaccctcgggcccatggcgctcgggcccgcggccccggctcgctcggttcccggcaccttttcccggcgcggttagcggtggcggcggcgacaggcgagcgggtgcgcgccggcgggcgcgcgcgccgcggacacgcacgtggagggcggacggggaggggcgcgcggggatccacccgggcccgggccggctcctgaggtcacggggacacgcggccgctgcagcgcccacgggtggcgcccagtcacgcccgaggcccgggccggcgcgggccctccgcgctgtcccccggcgctgccgcagcgcactcaccctggcacaggcgcgcgcgcccccggccatcctggcgccccggcatcctgcaccgcacgggcgcccgccgccgcggcgcgaacctcactctgcagacagccagacaaagcgcctgctcgcgggccccttcaccatctcccggagacgggcgtctttgtcacatgtcgctgggcaccctccccaacacacccacacatgcccacacacccacacgtccctgcacccacgggcagggccgagcgcaaacccgcactgttgctgggacccttgcgttcacagacacacgctgaaggtcataaccgttctgcatcaccgagtcacgtggagggtccccaaccggcacggggttcggccgtggggggggctggggcggcgcccctggcagggctgctgcggggtggggccgagagggcttggcctccgggcaggcgccccgcccccgccgccccgccctgtccccagctgcctctcgcctctccctccctccccagctgccccgcccgccccgcgggccaggcgttccggagccaaccggcctccgcctcgggccggattggtctgcgcggcgcggcttcccaaccgccgggggcacgcattgggaagctgtgcgtcctcgcagcgcctgcggcccctccctcccgctctgtcgccgccgggccatttccctggaagagcggctcggaaccagctcctctcagagaaagggctcccggcgtgaggtgggggaggttctttgcttcctggttgagaaagctggggcttcggtggctcggcgagcctggtttccttccagctgtgcccgccaccaccagtggtctgcccagttgggaaacaggaagtcaccacctccccgtgtctcctggtccttaagccacctaaacctcagccatcctcgttctccctccagccctgatccccatgggccaggtggcaggaaactcggggaaacccaagattggaattctgatcctgtcagcacagcagtgtagtcctgggcacgttacctgaccactgaaaacaagttcctcctgtaggccaggagagttggatggtacatacataagcatttcctaggggcgagaggggaggacagctgcagcttgtgaggggcttacaggcagccagaagccattctgtcaccactcactgggcctcagctgtggcgtttgtaaaatgagggggattcagtcctggtgcaggtcaactctgatgtgcagtggcaccagctatgtctttgttcctcttctccccatcaaaaatgttttccaccgggtgcagtggttcatgcctgtaatcccagcagtttgggaggccgaggcgggtggatcacttgaggccaggagttccagaccagcctggcaaacatggcgaaaccccatctctattaaaaatacaaaaattagccgggcgtggtaccgcatgtctgttgggatgaggcacgagaatcgcattaaccagggagccacaggttgcagtgagctgagattgtgccactgaattccagcctgggcgacacactttgtctcaaaaaaaaagttttcattcactctaaatatagatgtttaccagcatccaccatggccacccagtgctgggagccgggttcatcaggaaccagatgggcctggttcctgcccccatagagcttacagtatggaggagaggatgggcaacccgacagtcacaaaggggagactcagtggggaccctccacatgactcggtgatgcagaacggttatgaccttcagcgtgtgtctgtgaacacaagggtcccagcaacagtgtgggtctgcgctcagccctgcccgtgcaggttcctcagcggcctgctggaaaggtgagcatcagctctgccgagggtgtgaggacagggcgaaggcctccaagggtccttctcactctgcgcgctcggggctctttggatggtttcattagctgcctcccttctccagtgccatgccttggcccagctgaaatgtcagcatctcttcaggagaggcaggggcgaggctcaggggcagacaggcacagcactgctggcggggtcccactctgtggtgagcacctgacaggctggtgggggaggcacccttcctgtccaggcctccaggtaataggagcctaagagacggagagctcagaggagtctgggtggccttgagtccctgttgaaggtgccgacagggatcatgaataagtgacgcgtggaggtgttttcttcgcggtggaagccagggctgtcgctacacagccacaggccatgctttcacaggtcttggagcacctgtcacagtgctggctcgcatgtccccgtttaagtcatactcaccctggcccagcctcatgttgtcacccaggcatttaatgagtggaaccgagggcccctgtgcacaaagtgcactgacacatgcctcaggcagcaccctgcccccaagggttcccaggcagacaagcagaggatgaagccgatgggtgtgcttgcccacagcgggttcctcaggggactgctggaaaggtgagtgtcagctctgccgagggtgtgaggacagggcgaaggcccttgagaagttcagggagagcttcccaggcaggtgcaaaggtgtggagcgcaaggcaagtttgatgtggctggaggtggccacaatgaggaaggcggtggagggtgtggcctggagatggagaagaggtcacaaggtcccaaaatggccgtggtcgaatcctctggcttgaccagtggcatgggaggagtgggtgatgagggtgatgggatgcaggttttggtaactggggggacagtggggcacccactgggcacaggaggactgggtgcataggcaggaagctggccgtggacttgctgaacttatgcgaggggtgaacaaggaaaggcccgggaggcagttgcacctctgggtcttgccctggaggcagagcctgtcactggcgccacagccccgggacggggcctcctggggagcatgtggtgtgtgaggagctggggaggaagaggacaggagagcaagatggcttggaagcccagggaacgagcagcaaggcgggagcatgcccgctggactcagctgggaggagtgacttagagtgccagagtgtggtctgttgcggtcaaggccctctttcgagaagcgtggacgaggggcaagggtgactgctgtgggccacgctgctggagaaaaaggctgagccctgttctaggctgcggggaggcaggaagggtggccttcagcacatgctttggtgtaaacaagtatggagggagcaggcccagcccgtgacagcttagggggctctgctggagtgaggagagggctgagggacggggaagtgcccctctgcagggaggcccagaagctgtgctggcccagggcagcatcttcagccttttctctttcagccttttctcctctgccttccctgtctgtgctgcatggtgaccccctcccacccgcctctgtcctgcagaccaacatcgccttcctgcagaatgtgctcaacaaccagcagttcctggcaggcactgtggacacccagttcatcgacgagaacccagagctgttccagctgcggcctgcacagaaccgggcccaaaagctgttgcactacctcggtctggcccgagactgccctgccctgccctcccctcccctccgctctccaatctcttgctcctacctccttgccactccccatgaccaaagaactccttagtgccccctgcccctcacccctgccctcattctggccctgcgtcctcttgtcctgcaccctgccattcactgctctccttgcttctgatctgagagaccccacctttccatccacgtggtcctcaagacgtccccactgcctgtacccaggaggccctggctttggagaggacaggggccagctggaagcccggggatcctggagggatgtgtccctgtccctgagcccagccactctcactgctgccctcgactcagcctctgcccagcccaccctgacccactgcccgctttctccccaggccatgtcatggtaaacggtccaaccaccccgattcccgtcaaggccagccccagccccacggaccccgttgtccctgcagtgcccataggtaggtgagatccattctgtcaactcatgggggagacaggaggttgccacctgcaggatgggcaccaatgcccctgtctaccctaggcccgcccccggctggtttcagagacatcctgctgcgagaggggcctgagggctttgctcgagctgtgcggaaccacccggggctgctgctgatggacacgaccttcagggacgcccaccagtcactgctggccactcgtgtgcgcacccacgatctcaaaaagatcgccccctatgttgcccacaacttcagcaagctcttcagcatggagaactggggaggtaggctggcatgctgcgcagcgcctggtaggaatgggcgcccgctctgtggccagtcccacaggcttaggccactggggacaagctagagacgctgacacgaagaacaccaaagaggaaggaccgaagaaggcacagcgccctctccggccaggcctggtgccggcacgaggttgcagagctgagaccaggtgcatcctgggaggtccagggtcaggaggagacacctgcctgttaattatagcacagagaggtagaggagaagatgggattataaagggggcatagaagggacacaaatgagcctggtctcccccttagagatcagacaagggaaaaatctgtgggggttggagcagggaacacaggtatggcgaagatgagcaggacctggtattggggccagaggcttgtgctgcagagctagctccaaggcctggtggagttccccaggcatgcagagctgatctgggcctctcggttcctgtgcaggagccacgtttgacgtcgccatgcgcttcctgtatgagtgcccctggcggcggctgcaggagctccgggagctcatccccaacatccctttccagatgctgctgcggggggccaatgctgtgggctacaccaactacccagacaacgtggtcttcaagtgagcctggggtggggtgggcagacgctacctggtgtggcccagagggtaccgagccatgtcgtgatggcctctgttctccacggtcagcctgacaccaagtctctctgtggccacacgcagcaggggctgctgtttggaaatatcgagaagtgtaaaattggagttgcagaaccagacaggcttctaaatcactccctcactcctggggcagtggaaggtctgagacttgcctgggtcactcggtgcagggctgggattggaacccaggcctcaagactccttgctcagtaccctcttccacagcctgccactggcctagctgatcctccagggcctggtccacacttgtgtggccaccccccgcctgtggatgccacaccccctgccaggcgagaccctcagatctcattccccaggggccatagagtgggtcaggaaggagccagggaagactgttcagagggaggtggggtggggctcagccctgggctctctcacccttgcaggttctgtgaagtggccaaagagaatggcatggatgtcttccgtgtgtttgactccctcaactacttgcccaacatgctgctgggcatggaggcggcaggaagtgccggaggcgtggtggaggctgccatctcatacacgggcgacgtggccgaccccagccgcaccaagtactcactgcagtactacatgggcttggccgaagagctggtgcgagctggcacccacatcctgtgcatcaaggtgcctgggccacttgtccgtccctccctctctgccccggccatgtccccgccacccacaggcacacatcctgccctctctaccatctctctctctctctctcccacttcccccaggacatggccgggctgctgaagcccacggcctgcaccatgctggtcagctccctccgggaccgcttccccgacctcccactgcacatccacacccacgacacgtcaggggcaggcgtggcagccatgctggcctgtgcccaggctggagctgatgtggtggatgtggcagctgattccatgtctgggatgacttcacagcccagcatgggggccctggtggcctgtaccagagggactcccctggacacaggtaggaagaacagcagcccgtggccacacccctctcaaagccgcagccaccaccagtcccagtagtgttggacctgcctaggatccagatgccctgctctggccttgccgccttctgtcacctgagtcagacatgggacctgagctagccctgggtcctggaagagtcacacatttctaaggcctcctctgactctggcctccctgcagaggtgcccatggagcgcgtgtttgactacagtgagtactgggagggggctcggggactgtacgcggccttcgactgcacggccaccatgaagtctggcaactcggacgtgtatgaaaatgagatcccagggggccagtacaccaacctgcacttccaggcccacagcatggggcttggctccaagttcaaggaggtcaagaaggcctatgtggaggccaaccagatgctgggcgatctcatcaaggtgagcccggcccggtgctccttacctgacccagccctgcatgcacctgccactggcctccttgaggtgcctggcaccctaacctccagggccttctcctcaggtgacgccctcctccaagatcgtgggggacctggcccagtttatggtgcagaatggattgagccgggcagaggccgaagctcaggcggaagagctgtcctttccccgctccgtggtggagttcctgcagggctacatcggtgtcccccatggggggttccccgaaccctttcgctctaaggtagggaaggcccagcatggtgtgagggtgggggctggatgcaggacttgggactgatcctctgctttgctccccaggtactgaaggacctgccaagggtggaggggcggcctggagcctccctccctcccctggatctgcaggcactggagaaggagctggtagaccggcatggggaggaggtgacgccggaagatgtgctctcagcagctatgtaccccgatgtgtttgcccacttcaaggacttcactgccacctttggccccctggatagcctgaatactcgcctcttcctgcagggacccaagatcgcagaggagtttgaggtcagtggctctggcgcttctccacactccaccctggccccctgccccagagctctggagtttagcttggctgtcacccagcctcgcaagctttgggagcagaaaggacccttgagaccgggagctaggcctttaggaacgaggagccaaggcccagtgtggggacttcctatggccagggccgggggactgctctcccaccttggcgtccagctctgagtctgcacaccctccctgcaggtggagctggagcggggcaagacgctgcacatcaaagccctggccgtgagcgacctgaaccgggccggccagaggcaggtcttctttgagctcaatgggcagctgcggtccatcttggtcaaggacacccaggccatgaaggtattgtctcccccagggccagccaggcggtggggcttggctgggcccaggatgtcatgtcccctctgccctgtgtcttcaggagatgcacttccaccccaaggccctaaaggacgtgaagggccagatcggggcgcccatgcctgggaaggtgatagacatcaaagtggtggcaggggccaaggtggccaagggccagcccctgtgtgtgctcagtgccatgaagatggagactgtggtgacctcacccatggagggtactgtccgcaaggttcatgtgaccaaggacatgacactggaaggtgacgacctcatcctggagatcgagtgatcttgccccagaccggcagcctggccatccccaagccttcaacagaagctgtgctgccacggcaggcccaggccagccagtgcccgaggccaggaaggccgggccgtggaggtcctgtccacagctggacaggagagacaccgcctgcggtggttcattcctttcagccatcgtcctttcctccggcggacagctgcttacatgttcatctcttgccaaataagggtcccctcctcactggagactacaagtggtgggtcaggtggtcctaggacccaggggaggtttaggggtcctatctcctgggggaaggggagatctaagatgtcccaggtcctgggaagtttactcaataaagctggctttcccctgc

SEQ ID NO: 61521 - DNA, 3051 bp, Homo sapiens
ataaagcagaatgtctgctctctgtgcccagacgtgagcaggtgagcagctggggcagagggatgggggtcacagtcctaagggagggcattgcaggtggcctcaggggagagcctggggtggcccctaagacgtcctcttggaacattttggcagagttgcctcttcgccctcattatggctcagtttttccaccatgaaatgggagggagggagacaggtgggcaggggagaggtggtagaagtggcctagagaactgttcctggggtctgggacctttgcgaaggggttagagcaccacgctccctgctatgtgactgaggtagcaagagcacgccctcttcccatgtctgaggaagacaccctagcctccttgactcacctaggtcagtcctcttgagccccaacagctctgtgctccccagcccaaggaaggggtaacaggatttcgggcagttgcccctgcagaggccccctgggcaagtcccctgcgccatgtcccttcgtctccttcttcccctaaccaggcctccctccacctgtcttctcagagcaggtaatggcaagcatggctgccgtgctcacctgggctctggctcttctttcaggtgggtctccgaccctgacttcaacgtgggggtgtgggtggaggctggccagagggccctgtccaccctgggggaggagagcccaggccctgattacctagtccctctccacagcgttttcggccacccaggcacggaaaggcttctgggactacttcagccagaccagcggggacaaaggcagggtggagcagatccatcagcagaagatggctcgcgagcccgcgtgagtgcccaggggaaggggtgtaggcgaagggaggagacagctgggccatgccatgatgacctgcctctgctgcctcaacctctgtggccgctgctgggacagaggaaaggagcggtgctagctctgtctgcagatcccggccatcctgggctctttagcgccctctgcctgcagcccccgccttgacaactccgtagctgttgcccccttgctcactgaggcgcgggacctgggatcaatcgggaggacgcccgctgcagtccccagaatcaaaggatgatgtggcgcatctatgtttctttggagagtgttgtaggtctggatttgtatgggcaatgtgtttgtgcttcgtgcgtgagttgttactggccagggctaggacaagagccctcgaccctggggccaacgccctgcgtccttggttcccccagaggatcagtgcgcgatgacttggggacaaaggagatgatggaggctagcagtctgacggcctggatatctgtccccttctccaggaccctgaaagacagccttgagcaagacctcaacaatatgaacaagttcctggaaaagctgaggcctctgagtgggagcgaggctcctcggctcccacaggacccggtgggcatgcggcggcagctgcaggaggagttggaggaggtgaaggctcgcctccagccctacatggcagaggcgcacgagctggtgggctggaatttggagggcttgcggcagcaactgaagccctacacgatggatctgatggagcaggtggccctgcgcgtgcaggagctgcaggagcagttgcgcgtggtgggggaagacaccaaggcccagttgctggggggcgtggacgaggcttgggctttgctgcagggactgcagagccgcgtggtgcaccacaccggccgcttcaaagagctcttccacccatacgccgagagcctggtgagcggcatcgggcgccacgtgcaggagctgcaccgcagtgtggctccgcacgcccccgccagccccgcgcgcctcagtcgctgcgtgcaggtgctctcccggaagctcacgctcaaggccaaggccctgcacgcacgcatccagcagaacctggaccagctgcgcgaagagctcagcagagcctttgcaggcactgggactgaggaaggggccggcccggacccccagatgctctccgaggaggtgcgccagcgacttcaggctttccgccaggacacctacctgcagatagctgccttcactcgcgccatcgaccaggagactgaggaggtccagcagcagctggcgccacctccaccaggccacagtgccttcgccccagagtttcaacaaacagacagtggcaaggttctgagcaagctgcaggcccgtctggatgacctgtgggaagacatcactcacagccttcatgaccagggccacagccatctgggggacccctgaggatctacctgcccaggcccattcccagctccttgtctggggagccttggctctgagcctctagcatggttcagtccttgaaagtggcctgttgggtggagggtggaaggtcctgtgcaggacagggaggccaccaaaggggctgctgtctcctgcacatccagcctcctgcgactccccaatctggatgcattacattcaccaggctttgcaaacccagcctcccagtgctcatttgggaatgctcatgagttactccattcaagggtgagggagtagggagggagaggcaccatgcatgtgggtgattatctgcaagcctgtttgccgtgatgctggaagcctgtgccactacatcctggagtttggctctagtcacttctggctgcctggtggccactgctacagctggtccacagagaggagcacttgtctccccagggctgccatggcagctatcaggggaatagaagggagaaagagaatatcatggggagaacatgtgatggtgtgtgaatatccctgctggctctgatgctggtgggtacgaaaggtgtgggctgtgataggagagggcagagcccatgtttcctgacatagctctacacctaaataagggactgaaccctcccaactgtgggagctccttaaaccctctggggagcatactgtgtgctctccccatctccagcccctccctctgggttcccaagttgaagcctagacttctggctcaaatgaaatagatgtttatgata

SEQ ID NO: 61522 - DNA, 8673 bp, Homo sapiens
ccggaagtgacgcgaggctctgcggagaccaggagtcagactgtaggacgacctcgggtcccacgtgtccccggtactcgccggccggagcccccggcttcccggggccgggggaccttagcggcacccacacacagcctactttccaagcggagccatgtctggtaacggcaatgcggctgcaacggcggtgagtgctgagccggtgaccagcacactttgggcttctggacgagccgtgcagcgattggccccaggttgccatcctcagtcgtctattggtcagaacggctatctttttttttttttttttttttttttttttggtccgagtagcttttaaagggccagtagctcggttgccctccggaaggaatggggaaatcagagagcggtgatactgggttaagagtggaaggattgtttggaacggaactccggtccctgcgggcatctgggtgggattcccatcaggcctgggatgcacggctctagatttagtgacccagaccaagaacgttcgtctacacagacggggtcctttcattcgaggctgggctgaggcggatgcagatacggcccctttgggaagacacgttccacttttgattcataggagagagtatcagccaagcctccgaactgcacacaaacgtcttagaagtgcgccttctttttgtgttatagtggtctcccagccacagccaacgctccaagtccccagctgtgacacacctactgaattactaccgtgggtgggaggccgccgtgggcctttccattacgagcctgcttgccgagccctgggcttgtgcacagacaaactgcagagctggtggaggccactgccaggccgagataagaaagagatggggagctgctaatctccccctgtccagcctgttggtgagggctgggatctttgctcttgcagtcattccagagccctggactaggagtaggaagatctgaattgtggccccaactctctttcggttattagctctgtgaccctaggcaagtcacctcatcccttgatgccacccgttgcttctgtaacatggtcccaaaggtgcctgtcttgtccacctgataggatttttgagacgacaacaatatgcaaaagcaatagcttcaacatagaagtgctcagtgttttattttttaatgaaacggtttgacttggatatgctgtgcacattcaatgaacttaaggaattgtttgaacctagtagttctgggaccttagagtcctttctgtgggctccctgtggcccagaattttggtggccacgtttaatatcaagcctagcctaatttgcaaagggtctcccagggttaatttattggagtgatcacatggagtagaccagagtctgagggcagaaagctgtcacctgcttcggcaatagaggccccagatgtctgggtgcaaaagaactccatagcaccccgaccaacatggtgaaaccccgtctctactaaaaatataaaaattaggccgggcacagtggctcatgcctgtaatcctagcactttgggaggccgaggcaggtggattgcctgagctcaggagttcgagaccagcctagggaacacagtgaaaccccgtttctactaaaaatacaaaaaattagccgacgtggtggcatgcgcctgtagtcccagctacttgggaggctaagacaggagaatcgcttgaacctgggaggtggaggttgcactgagccgagaccgcgccattgcactccagcctgggtgacagagcgcgactccccctcaaaaaaagaaaaaaaaaaaaaatatatatatatatatacacacacacacatattttagctgggcatggtggtgtgcgtctgtagtagtcccagctacttgggaggctgagtcaggagaatcgcttgaacctggaaggcagtggttgtagttagctgagaacatgccactgcactccagcctgggcaacagagggagactctgtctcaaaaaaaaaaaaaaaaggaactacataggatgaacatcccagatcagggaatgttgactgtcgacagtatcagtatctacagtggctactgtctgatgtagaaagaaatgggatcaggctaggcgtggtggctcacgcctgtaatcccagcactttgggaggctggggcaggaggatcacaagttcgagaccagcctggccaacacagtgaaaccccgtctctactaaaaatgtgaaaattagctgggcatggtggaacatgcctgtagttccagcttgaacccaggggtggaggttgtagtgagcctagatcacgccactgcactccagcctgagcaaaacagtgagactctgtctaaaaaaaaaaaaaaaaaaagagagaaatgggacctccgtcttagactgaagaattcagttctacgtgcttagcagtgaatacttttgtccaaggtactctggcaggaggaagaggcgtgtcctcttgagttcttgacttgggctctggcctgttaatatttccatgttggtgaaaccagaggcagcactctaggtgcacgaactttaggcagcgcagcctcctagtcttatggaacatctgaggcagaagaaacctgagtccaaccttttcattttatagatgaacaaacagatcctggtgggacagtgtacccaaggtcacccagccaagaggctgagcaggactgtacgtcagatccgtttacctcagtccttaatgcatgcagtccagccagattaagggacccttaatactgtcagctttccccactgtgggatcttcatcctcttgacttcttttgtagccagacatctgggcctcttgctggagaaggtggcagcttgctgctcttagactctagtctactccatgtggcatctggatggcactgaaattttctcaagtgccttgtctgttgtagataatgaatctatcctccagtgactcagcacaggttccccagtgtggtcctggctgccctgcccctgccagctgcaggccccacccttcctgtggccaggctgatgggccttatctctttacccacctggctgtgcacagcactcccactgacaactgccttggtcaaggtgggcttcagggctcagtgtcctggttactgcagcggcagcaacagcaggtcctactatcgcctccctctagtctctgcttctctggatccctgaggagggcagaaggtactgaggaaggttaaagggaccagccttggagtatttccccactctgagactcagctggccacaggccaggttctgaagttcctttcttccaagccagtgattctggttcttggacaaggtgttgaggaacactagaaacagaggggactgtgacctggggactttttctgcaggaagaaaacagcccaaagatgagagtgattcgcgtgggtacccgcaagagccaggtgggtgcaggagccggggtggaggaggtttgtcagaacagttatgatgctcacagcatcacaaattgggggactcagagggttagttcctagtatgaaggagatggggtggctgggcgttaagttccccgggaaatggcagattacattctatggcaagatcatccctaggctgggaaaattgttggagtgcagagggctcccaagccccttctcatgcccagatggaaattccagtcccttcaggatctgcctaacctgtgacagtctaaagagtctgagccgtggctgggaagggcaggactaatccaagtctctacccgcagcttgctcgcatacagacggacagtgtggtggcaacattgaaagcctcgtaccctggcctgcagtttgaaatcagtgagttttctggaaaggagtggaagctaatgggaagcccagtaccccgagaggagagaacacaacatttctggctttgcctatagctaaagcccgtcccgctgccccgagattccttctgggctgctcccagttctgaaggtgctttcctctgaatacctccagctctgactacctggattagcctggcatttaacatcttgagctttgggtctttttatgagtgtttctggtcttcctgctcgattgtatatactcagagggcaggaaccagggattatgtgcctctgtccccatcatgaatcgtagcacagcgctaggctcagtaaatgctgatcaataatgagcacctgattgattgactctctcctcagttgctatgtccaccacaggggacaagattcttgatactgcactctctaaggtaacaacatcttcctccccagttcttgtccccactcttctttccttccctgaagggattcactcaggctctttctgtccggcagattggagagaaaagcctgtttaccaaggagcttgaacatgccctggagaagaatgagtaagtaaagataggagagtgtggtgccctcccagtctcttgctgggaccctagtatgctaggtctcttgctgggacccggggtgtcagataggctgctgggcttaaaccctcagagaggctgaaggcagctcataggtgggttttttcaggcttcagaaaaggagagtgtctggttctgagccatctggctgcctggactgcaagaatggctgggggagggagggtaggagggagagtaggagggagagtgagaggagagcagttttcatgctcctgagatcttgagaaggtgtgcttcctgaactgccctaggctccaccactgaagtagaggcaggggtgggtggagaaggggtgaaggctggctgctcataccctttctctttgcccccctctcccatctctatagagtggacctggttgttcactccttgaaggacctgcccactgtgcttcctcctggcttcaccatcggagccatctgcaagtaagagtcttgcaagtaaggggcttgggcaggggtaggcatcatgtgaacctttgcctttccctttggggcctgaccctctgcttcagggttatctcctctgccctgaggagtgttgactggtggcagaaaactcaagaaataccagtgagttggcaatcgagagagaatagaggtgatctgaacttaaatctcttccctcattctgtgcccttccctcctcccccaggcgggaaaaccctcatgatgctgttgtctttcacccaaaatttgttgggaagaccctagaaaccctgccagagaagaggtaagtggggcctggataggcagcttggtgggatgtgcccagaagatgcagggatgggaggaggaggaaaggaacagtgactgcctagtgttaaaatctcattgtaacttctctctgggcagtgtggtgggaaccagctccctgcgaagagcagcccagctgcagagaaagttcccgcatctggagttcaggagtattgtatccttttagaagagtgacggatccttttggaagagtgacggagacagcagccaaggaaaaagacaaggtctagagggctctgggagtccggagagtggaaggggcttccagcaagcagcccgtggggtcagtggcctgtctgtctttccatgcactcatccgtccactcatttacagtctaatgttttcttagccccagacaagtgttcagagtgcaaggcattggggataatggtgagcaagataaacatttccctgcatatgtagagtttacgtcttacttagggataatgcagttatactgaactgaatagtgactacttctggagggatagggagtacttccttttttttttttttttttttctgagacggagtctcgctctgttgcccaggttggagtgcagtggcgcaatctaggctcactgcaacttctgcctcctgagttcaagcaatcttcctgcctcagcctcctaagtagttgggattacaggtgccaccacacctggctaatttttgtatttttagtagagactgggtttcaccatgttagtcaggctggtctcaaactcctgacctcaggtgatccaccagcctcggcctcccaaagggctgggattacaggcttgagccccgcacccggtcagtacttccatttttatatgctactatattgtcttgacttttacaatgaatatgtagtacatttcataaaactaaatttaaaaatagtatgtgctaagtgctccaataagtgaagttgggaattttctggaaacttctagttggaacatctaaacacagaagtctggggtgtcagggaaggtttctcagaggtcttgtaaccttggcaagttatttagcctccctatgtcattttccttatctgtaaagtggggataataatactaccttcctcacagggttgttgtgaagatgaaatgagctgacatatggaaagtacttttagagcagtgtctggcatgtagtaagtatgatgtaactgttagctgttaacattaagctgagagctggaagatgactgaaagtcagccagctagagagggaaagacagactcaggcagagggaaccgcacgaggccccagattgcccgacactgtggtccttagcaactctccacagcggggaaacctcaacacccggcttcggaagctggacgagcagcaggagttcagtgccatcatcctggcaacagctggcctgcagcgcatgggctggcacaaccgggtggggcaggtagggcctgcccctatcctctccccagctcatctgcatctcctttctgccttacagtcatccccaatttaggatttttagactttatgattgtgtgaaagcgatatacgttcagtagaaactgtacttagtacccatacagccattctgttttttactttcagtacagtattcattacatgagatattcactttattgtaaaacaggcttggtgtcagatgattttgtccaactataataggctaatcttaagtgttctgagcacatgtaaggtaggctaggtgtattaaatgcattttcagcttgttttcaacttaacaatgggtttatcaggatgtaaccctattgtaagtcaaggaccatctgtcttcacttcttgaccaccccacctctaacaccgtaggctgggaagattgtgaatcagaggccagactctaggctttcatggagaaaatttacaaaaaaaaaaaaaaagaggccagactcacacttaggcctacccaggctttctagatgatagggaactcccatctcactgccaggtgcttttagacacccccgtgtccacccttttgactccctgttccgcctccacagatcctgcaccctgaggaatgcatgtatgctgtgggccaggtacacttgaccagggaagccacatggtgacatatgccttccctttgttctcaaccaagaagcttgtctcacaaccttctgcatctgcttccccagaatagcattctcagggaggggcagaccttgggatgctaccggtccaaaaggcgctggggagcaagtagatagaggtggtcccatgctttgcgccattggttggggaaagatcaggcctgatgtcctaggatgtttttccatcagggggccttgggcgtggaagtgcgagccaaggaccaggacatcttggatctggtgggtgtgctgcacgatcccgagactctgcttcgctgcatcgctgaaagggccttcctgaggcacctggtagggcctgtgctccacctgtggagggctggggacttggagagctgggaaaggtggcagggaagatttcttacatgaatgctctgtatacagtgctaactcattcttgttgaatgttgtgtatggataggaccaggtctgggcccacagttgccttttcagtgatgtcctcaggtctgtggtcacagggtggtgttaagagcccttgcagctcacaagaacttcttgttacaggaaggaggctgcagtgtgccagtagccgtgcatacagctatgaaggatgggcaagtaagtggggggaaatgggcgggaagccagggaaaggaggactgtggcatttcttcctgtgcatcccaggtttctaggtagtcccctctcagactgtgctgaggcaactgttttcttccccagctgtacctgactggaggagtctggagtctagacggctcagatagcatacaagagaccatgcaggctaccatccatgtccctgcccaggtaccaaagctggagggcgagggggtaataaacaagagtgcatataatctcttgttctcaccaaatcccacctccttccctcatacagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaaggtgt

SEQ ID NO: 61523 - DNA, 23944 bp, Homo sapiens
ggggccctgattcacgggccgctggggccagggttgggggttgggggtgcccacagggcttggctagtggggttttgggggggcagtgggtgcaaggagtttggtttgtgtctgccggccggcaggcaaacgcaacccacgcggtgggggaggcggctagcgtggtggacccgggccgcgtggccctgtggcagccgagccatggtttctaaactgagccagctgcagacggagctcctggcggccctgctcgagtcagggctgagcaaagaggcactgatccaggcactgggtgagccggggccctacctcctggctggagaaggccccctggacaagggggagtcctgcggcggcggtcgaggggagctggctgagctgcccaatgggctgggggagactcggggctccgaggacgagacggacgacgatggggaagacttcacgccacccatcctcaaagagctggagaacctcagccctgaggaggcggcccaccagaaagccgtggtggagacccttctgcagtaaggagccctgccccgtccccgctcccaggagagcctagaggggcccccctcagctcctaacgagccccccttctgagttgagtccccatgaccttcagcctttagcctagttgctgggaagggggacagggcccatgagagcccaggggtccttgcttggaggtttgagcctccagcccctgaactgctcctctgcagagtcccaaatcccatgagcccaggcctttagcccagtccttgggcaagggggacatttcccaggggggtccaagatgggagaaaaagcaggtgagttcacaactcaaatgcctggagaactgggaggtggtggaaatttttagccactctgatcatttatactctccagaccctaactcctgcactgagtcctcagtgggtaggctccggggcccaggaagcactgccagggaggagggcccgaagctggggtttgggggctttcctggcctcctagggactcatgcgtttagccagggaagcccaggtctttcttacctgaggcagacagagcctcgaggtgggagctgctcccctttcctgtatggccacaggcaccccacctcaccagcaggcgccattagaggctgcccgttctacatccccatccgctggcggactccccgtctcctggagaactgggtgggtcctgagctcgatgcctcccctctcctcagcagagctgacctagttactaattacccatgtgctttattatttctcttttgttttataaatttataaatggcaaaaggctctgataaggtctgtgatcattaacttgtaggaatggtggcctggaaagatctgggccaacccacctcccacctagtgggggtgggggatgggggtgtgggggagaaggaaggatggcctgggggctacaggggccacccctccccagcggctccctgacctccaccctacagcgcctgcttgaggaggttcactacttcctgggcgctgtgctgaggtttcacaggaataatttcccttcatggtgaggagtcctgggcagaagctattggtgactctgcttcacaaatggggaaactggggcttagagccgggaaggagctagactaagttcaccaaactgaggccccaaacctactctgttcggtgctctcaattgctatgaccggggaccagaggcctgcagggggtggccagggagtcagagagagaccgagccccaaagatgctccaaaggggcccatctcttttctgtccaaggtcctgatcccagctggggtgggggagggctggtggattcctgctttcccagaggcctcagggagcctcccgagggcctggacagggggcaggggagcagtcagggccccctgacttggcaggaagaggagggcaaaggactccagagctgcaggggaggggcaaagagtcaggcatcccagacccagggcgaaggcaacctgacggggtggggctgggcctgacctgcccagggccccagatgggactgggggctttggggtgagggtgggggcaggggatgctttcttacctggctgagtgagctctctcggtcagcagccccctttggtgggatggtggggttggggaggcttgatccacagcatttgaaggggaagcagaggtcaaagtgcttcctagggaccagcagagacctggaagctgaggcagagagtgtagagagaggccattgggggagatggacagagaagctgggagaagcagaacggaggagccaggggggcgggggctcagacccagctgggagaaggggcacgggagagaatgaggcgccccaagcttgcaaggaggctggagtgcttcccgcctgccccgattgggttttctttaatgctaacagcatgctatttactttccatttaaatttgagatgttgctataaattatcaaccagctccttgttcctgcagagtttataactaactacctgggttacttattgttcaggtaacaaaagggatcggaaaacgccctgagtgaaaaaagtggggcctccagcgtcagggtcaggaaaggagccagggagagaggggcgggggacccctattgaaggcctgggccattggggaggttgaggctgggaagacggtacagaggcagaatgtctagtagaagctgtttcccgggagaagtcagtgtctgggaagaagccggggtgggtcctgggtcccaggcctccctggggtgccccatgttggtggccacagcaggaacctgagctctttcttcagatctcccccttagctccctgagtgaccttgggaaagtctgttcctctccttctgcctcagtttccctccctggccaaggaataaagtccaaactccctgccttggtttcgttcccctccctccaccccaccaaattcctggatctcttcccaggtctttctcttcctctcggcctttgctgcagtcattttggctttgctgttcctcagtaccccaagccaattcccaccccagggcctttgcacgtgctcttcctgctgctcagaacctctttccagatcttcccatggccgattccttctccttcagctccctgattgctccatccaaaagggggccccacccccgtcactctcttccactactgttgttcactttctctggttccctgtcaagacttgtgatcatctgatttgtttgttttctatctcctgccatgaaaatagaagctcttcaaggacaaggcccgtgttgccttatttaccacttgtacccacatcctgcccagtggctgatgcacagcaggaatgagtgagtgactgggattgtctgaggccctgaagatatctgctgccctgttggtcagggcccagcagcctgagacgtggccaagggagaaactgggacccagagttccttcctgggtgtcctcccgggtcctttctgtccctgatcagctcaaaccccagcgtgtttcttttttgttgttgttgttgttatttttgagacggagtctcactctgtcggcccggctggagtgcatggcgcgatctcggctcactgcaagctctgcctcctgggttcacgccattctcctgcctcagcctcccgagtagctgggattacaggcatgcaccaccacgcctggctgattttttgtattttagtagagatggggtttcactatgttggccaggctggtctcaaactcctgacctcaggtgatccgcccgcctcggcctcccaaagtgctgggattacaggcactcagagccactgccctcagccttcaaaccccaatcttgaagtattctgatcctgcccatcaggcagcatcagggcactgagactcaggaaaacagtagccacggcaggaggggggggggacagaggatctgacgtccccaacaaaagccagactgcctgcatcctaatcctagctctgcccctttctagcttgagcaggtgattttatacttctgagcctcagtttcgtctgcagggtagagatgacaatagcccttgtccacagggttaaatggcatggcacttgtagagtaaacatgtagtaactgcaatatacagcagttattattagtgatcccattttacagatgagcaaattaaggctgagagaggcagtgccttaccgaacgaaactcttccaaatgactgaaggcaagccaggacttggacctgggtcctcctacctcacgctccatacagcaacctcgaggtcacactttcccctccccagtcattcctgctgtttaagttgaccatcaactcacttccatacagtgctttggagttcacaaagggcttacaaaatgcgctaagctcattttttcctcctccccatctctgaagtctgaaatatcattagccccatttcacagatgcggaaactgaggcacacggaggttaagcaaagaatcaaggccaggtctaaagcccccacactgagaagtcagctcccctccagatgtggagatgaataccacaaccttgcatgccctgaaaccccaggggccagagggcaagaggctcaaagccttggacatccgattgaccctggaaagggtaggagagagaggaggaagatgtgggcgggtcttcacttctcctgggctctgctgtgtggggccaagggtctccagggctgcattgttaagatgatgatgatgacaatattattccacaaattcagcacttactgtgcaccaggcattgccctaagttcatcctccctatttgaagctcatttaattttcccagtagcagtgtgaggtaggggtggatttaccccacgttacagggcagatgtgggtcatgcaagagcacgcgtggctaggtcacagtggtgggatttgaacccacattggtttgactctcaaacccattagagtcaaagcaggagatgcctggagacttgtcctcttagttctttcctttttctttctttctttttttttttttgagatggagtctcactctgttgctgggggtggagtgcagtggcgcagtcttggctcattgcaacctccgcctcccgggttcaagtgatcctcctgcctcagcctcctgagtagctgggaccacaggcatacgacaccacacccagctaatttttgtatttttagtagagacagggtttcactgtgttggccagggtggtctctaactcctgacctcatgtgatccacccgcctcggcctcccaaagtgtggggattacaggcatgagccaccacgcccagccttggcctcttagttctgagctaggacagttggagaatctgccctcaaaaatagtcaggcccttgaagactctgtgtgtgtgtgtgtgtgtgtgtgtgtgtgtgtttgtgtaagagacacacagagagacagaagagagagagtgatagcaagggagtggggggtagggagagagagacatcgattcagtaggttctagaaaaaagtggcacaggtggcttctcccagaaaagggaaagacatgccctcttggttctctgactcctaactggcatttaaaattcacttttttgttgtggattttttgcccaactctactaggaattgtttaaaagtggaacgttcgtatcagctcactttaacagtttgctttccattttcacattcaaaagcctgtcttcggtttctaagggttgcacatgtatttgtgcagggtggctggcctttgttttattttcaagttcagcttaaatttgacctggcatgagagaatgagaatgagagagagagagagagaaagaaacagacagacatggaatcagatggacaggggcacatagaaaatctttggtttgagcccaggagaggctctcaagaggtgagaggaagactgaccctattctctttgtgggagagagaagggaaggagggaggaagggaggacacaggaggacatggcacaggagggtgatggctgcagatgggggaggggaggcatcaggcagcctggctctaggatcagataaacatgtttgccacagagcaccaggctggactttgtactgcccttccttctgagctctgactggcactcagcaaagcagggagatgaaggagagaggatcctaggagccccggaaagaagggagagagagaagctggggagaggcctgcgggggtggggtggtcctggcaacatgaaatatttttgagtcccaactagatcaccttgcacaagtgactgcacctttctgagcctcagttttctcctctgcaaaatgggcacaccgtctacttcctagggttataagatgtaagtggccagtcctcagcacggtgcctggctcacagtaaatcctcaagaaacatgagttctcagacttttttttttttttttttgagacaggatttcactctgtcgccaaggctggagtgcagtggcgcgatcacagctcattgcagccccgacctctcgggctcaagagatcctcttgtctcagccttctaagtagctgggactacaggcttgtgccaccacacttagctaatttttctattttttgtagaaacagggtcccactatgttgtccaggctggtctcaaactcctgggcccaaggaatcctcccaccttagcctcctgaggagctgggactacaggtgtgcaccaccatgcctggctaatttatttttttttttatagagacagagtctcactatgttgtccaggctggtcttgaactgcagggctcaagtgatcctcccacctcggcctttcaaagagctgggattaccaccatgagccaccatacccagtttacaattcagttttaaatattatatatgccaaggtgggaggatcgcttgagcccaggagtttgagaccagcctggccaacatagcaagaccctgtctctatgaaaaaaaaaaaatagaaaaaagaagaaaaagtacaaaaattagctgggcatgttggcatgtgcctgtggtcccaagtacttgggagtccgaggtgggagaaccaattgagcccaggagtttgaggctacagtgagctatgatcacgccactgtgctccagcctgggagacagagcaagtagcctctaaaaagaaaaataaataaataaaaataaatattggctgggcacggtggctcacacctgtaatcccagcactttgggaggccaaggcagatggatcacctgaagtcgggagtttgagaccagcctggccaacatggtgaaaccctgtctctactaaaaatataaaaattagctgggtgtggtagcgcacacctgtaatcccagctactcgggaggctgaggcaggagaatcgcttgaacctgggaatcagaggttgcagtgagctgagctcgcgccactgcactccagcctggccacagagcaaggctttgtctcaaaaaaaaaaactaaataaaaataaatatcatgtatgcatatatagtatatattatgtaatttacaaagtacacaaggacaacagagaaaactgtccttctcactcccatccccagcaccccgttctcctctggaaggaaccagagtccccagttccttgcgtgccctccggtattttacacgtgcacaaatatgtagaaatcctcttttacctcacttcaaattattcataagtagcagcacagcagacacaccagataaactctgctccacctgggcacacagagcttcctcagcggggttttttcagtggttgcattgaacagatgcacctccatttagttaatcagtatccttttgctgggctccttggtggcttccaatcttttgctatggcaagcaacgtggcaaggaattgccttctacttgtgccatttgtcacctgtgccaatattaaaagccacaaattctagaagcgaattgctcagcgaggcaggggaaagcacaggctttggaatcacgcagacccaagttcaaatcccagtctgcctgtttcagtgctgctgtattgagctgtatttatctgtaactttttgtttgtttgtttgttttttgagacggagtctcactctgttgcccaggctggaatgcagtggcgcgatctcggctcactgcaacctctgcctcccgggttcaagcaatcctcctgcctcagcctcccgagtagccgggattacaggcacctgccacaatatctgacttattttttatttttattatttttttcgtagagatggttttctccatgttggccaggctggtcttgaactcctaacctcaaaagacccgcccaccttggcctcccaaagtgctgggattacaggtgtgagtcactgcacccagcctatctgtgacatattggtaatataagttcaggagagggagagagaaagaggcagggattgagacagagcaggagaggaggagagaaaatttatatggctcaggcagtctgatcccttctgttcccccacagggagacccacagcagagacatgactcacaggtggcatcaggtccctttgagtctctctggtgggagaatctcaacccacagagtaggattccagtgttcacatgcatttttggtactatgaggcctctgaatgtcaaccctgtcacctgagactctgttgaaaaaccagccgcggccgggcgcggtggctcacgccagtaatcccagcactttgggaggccgaggcaggcagatcacaagatcaggagatcgagaccatcctggctaacacggtgaaaccccgtctctactaaaaatacaaaaaaattagccgggcgtggtggcgggtgcctgtaggcccagctacttgggaggctgaggcaggagaacggcatgaacccaggaggtggaacttgcagtgagccgagatcgcgccactgcactcgagcctgggtgacagagtgagactccatctcaaaaaaaaaaaaaaaaaagaaaaagaaaagaaaaaccagcctcctgttctggtgctgcagggaaacaggcctggccacagccaagggtgcagattttcaggaagcatttttaaaaatatatatatatatatatacacatatatatatatacagagagagagaagccactgaggcccacagaatttgcatcattttattccttgtccaaggtcacaggacaagcagagtcccacccacctgaaaggattcagttctaagacagcctttagggcaaaaagtcacaaagttgatctatctatctatctatctatctatctatctatctatctatctatctacgtgtttgcaccctaatcactggcagtaaatgcactttttttcttttcttttcttttttttgagacagggtcttgttctgtcacccaggctggagtaggtgtaaaattggagaatccatatttctttccttgttttcagatttaatgctttcctttttccagcaggtctccttcgtccatccatccatcatccatctacccacccacccaccaatccatccatccattcatccaaccatccatccatccatcatccatccacccacccacccaccaatccatccatccattcatccaaccatccatccatccatcatccatccacccacccacccaccaatccatccatccattcatccaaccatccatccatccatcatccatctacccacccacccaccaatccatccatccattcatccaaccatccatccatccatcatccatccacccacccacccaccaatccatccatccattcatccaaccatccatccatccatcatccatccacccatctatctgtccatccactctaccctaccatccatccaccagtccatccatctatccaccaattcatccatccatccacccattcgcccatccatccatccacccacccatccatccatccgtccatccacccattcatccattcatccattcacccatccatccatccacatatcttcatctgtgttgtgtgtctgtgtatccatgtttctaaacctttatctgttccagtgtctgtatccataggcctgtgtccacgtttgtcatgtgtgtgcgtctacaagtctctgtcctcatgaccatgtgtctgtgtccctgtgtcctggcataaatgaccatacctcaccgtccctgagtctatgtgtaggcccctgggctccataactgctttcatgcacagtccccaccctcagggttgacaaggttccagcacccaggaccgcagccccacctatggggagagacagcccttgctgagcagatcccgtccttgccctctcccagggaggacccgtggcgtgtggcgaagatggtcaagtcctacctgcagcagcacaacatcccacagcgggaggtggtcgataccactggcctcaaccagtcccacctgtcccaacacctcaacaagggcactcccatgaagacgcagaagcgggccgccctgtacacctggtacgtccgcaagcagcgagaggtggcgcagcgtaagtaatgaccctaccccgcatcttccctgggagggcccaggactctcccctaactcataggtgggggctggaagcttcaccatccccattacacagacaggtagatggaaaggaagtcagtgggattcaacctgcatttattacctattctgcgccaggcactctgtgggacgggagtagacttggtcctgaacatccaaagatgaatgaaatgggtccctgctttctttttctttttttagatagagttttgctcttattgcccaggctggagttcagtggtgcgacctcagctcactgtgacctcctcctcccaggttcaagcaattctcctgcctcagcctccggaatagctgggatcacaggtgcccaccaccatgcctggctaattttttgtagttttagtagagacgggggtttcaccatgttggccaggctggtctcgaactcctgacctcaggtgatccacccacctcagcctcccaaagtgctgggattacaggcgtgagccaccatacccggcctgggtccctgctttctcagagcccatggttaagtgggaaagtgggagaaaagctcattatgatccagcgagtcatgtattagaatgggacaacagcagccacaacaacaacaataatggccactatttatcatgcatttttggggtgcctggtccagtgcagagtattacacaaagcatttcagggtgctgagctgactgtcgactggggagtaacctgttcttcctcaggaaggcagaggtatcaggaagcctcacattgcaaatatgacctttagaatatgacctttagactaggtcttaaagtgggagttgaattttgacccatggagacgcagggaagggtgtttcaggcagaaggaacagcatcagtaaaggctcagaggcaaggtctacggtcaggaaatcctccactgcaaactcaggaagctctgggagccctattactcagggaatggtgggttttcttctccaggcctcataccccaccaaatcccaagggcactgtcaccttccaacctccatctatgtgtgacattttttgacatttcttttattaattatccaggttaatttttttttattatttttttatttttttgagacagagtctcactctgttgcccaggctggagtgcagtggcgtgatctcggctcactgcaagctccgccttccgggttcatgccattctcctgcctcagcctcccgagtagctgggactacaggtgcccgccaccacgcccagctaattttttgtatttttagtagagtcggggtttcaccatggtctcgatctcctgacctcgtgatccgcccgccttggcctcccaaagcgctgggattataggcgtgagccaccgcgcctggccttaattatccaggtttttaaaaaaggaaatagccaggcatggtggtgtgccataatctcagctactgaggaggctgaggtgggaggactgtttgagcccccaggggttcggctccaacctggacaacatggcaaggttcctcctctaaaaaagaaagaaaggaaagatgataggaaagggaggaaagataggaaagggaggaaagataggaaagggaggaaaggtaggaaagggaggaaaggtaggaaagggaggaaggaaggaaggaaggaaaagaaaagaaagaaaaagaacgagagaaagaaagaaaggcaatacacatttggttaaaaaaaaagaagaaaaacagagtttataagaaaaattagatgcctttaccctaaagcagccactggaattcccagactcttgtgtatccttccagagagattttctgcatatagtagcaatagatatgttattttcttgctctttttctgattaatgggaacatactagacacactattttacatgttgtgttttgtctcttggcaataaatcctgtatatcttttcatattggcactgagagattgatggatctcattctttataagggctgctggctgttatttgtttaactggccacctactgaaggacttttagggattttgcaatctgcgaatacaaccaactgcagcaaaaaacatccttctttatataagtgcatgttcacatgtgactgtgtctgtaggataaattcctagaagtggactgctggaacacagagtagctgctttaaaatcttgggtacatattggcatagttccttccaaagaagttatatcaatgtacacttccaccagcagtaaaaatcactgttgaaaaaaaaaatgtatgcaggccgggcgcagtggctcatgcctgtaatcccagcactttgggaggccaaggcaggtggctcacttgagggcaggagtctgagaccagcctggtcaacatggtgaaaccccatcttaactaaaaatacaaaaattagctggacatagtggcgcatgcctgtaatcccagctacttgggaggccaaggcaagggaatcgcttgaacccaggaggcagaggttgcagtgagccaagatcacgccactgcactccagcctgggtgacagagggagactctgtcaaataaatgtatgtatgtatgtatgtatgtatgtatgatgtatgtatgtatgcatgcatgcatgcatgcaatagacaactctagtccttactctatagctacccctcatcccaattattggggtgttcacactctactgtgctgtaatacacacttggaaaaacagtacattttaatactattttaatttgtatgagaagaaacaaagatttattctgaaaatctgttagaactagatttagtttctgagagaaatagtgttctcctaaaaccatcactagacgaaattttacaatattcgataaaatgcattaaaaaatttctaacagttagaaatgtcatcaaggacttcagcctagagctgagaatagagatgcaaactgtggcccaaatagctttccctgggggatttttaacttttaaggagaaattggagaatttgagatgcagagtcaatatatgactgtagtattaggactctttcagtaacaggggacagaaccccaactcaaatggatttaaacagaaaagggaatgaattgactgaagcaatgtgaggagtccagggctgcttcaggcatggctagatcaaggggctcaaatgaggttcacacagcatttcttgactcttttcttttttgttggcttcattctcagacaggctctcctcatataggcaaagatgggttctggaagccctgggctgccatcctaccagcttagcaaccttggaaggaaaagagctcttcttttcagctactttcagttgaatgactctttttatacttgataatgtaaacttttatttattttattttttgagatgaggtcttgccatgttgcccaggctagttttgaacttccgggctcaagtgatccctgcctcagcctcttaagtagctggaatggcaggcacacatcactgtgtctgctataacagaaacttttaaatgaagtctaacataaaaagtgcccaaatccaaagcatacagttcaatgaattttcacaaagtgaacacaccaatacagataaaaaatagaatattaccagctcccagcctggtgtggttgtacccacctgtaatcccagcacatttgggaggcaaaagtgggaggatcacttgagcctaagagttcaagaccagcctgggcaacagaaggagaccccatctctccaaaaaatacgaataaatgagccaggtgtggtgcagcaggtgtgtagtcctagccacttatgcccgctgctgtttcttggcactgagatggtgagggccctgctgctgctgctgcgcccctgattcagaatctaccttcctctcttctcataaagtgctgtcctagcacttgtgtgtcccagtcctttggtggcctgctcagggataagctggtagaccagtttccagtaaagtggtaccagctgatgaaggctggctgggtctcttcctctagctaacatttgcattttaagcctgattttcaagtctggaaagctgaatataattctgaatacactgaggacatatggctcaaatttttgctctactgcgtgactctggaaaaatatgtaagctctctgagcctcagcttcctcatctgtacaatggggatagtaaatgtgccaaatcagaacaaatgctaatgcttacctgcagtcttgtactgagaaggatggtgagatcatatcttgggttggtaggaaagcattcagggattgattagtgatgtttgccttgaacacaggttaagaaagtgatggcatgtgtgctgtgtgtttgtcatcagtagattagatgatttctaagttctagctgtaagctcctctggttcagcgccatggcaatgagaaagaatcaagggcaaggtcaggggaatggacgtgggaaggtgagagtggccagtaccccactcacggctttctgtgcctgcagagttcacccatgcagggcagggagggctgattgaagagcccacaggtgatgagctaccaaccaagaaggggcggaggaaccgtttcaagtggggcccagcatcccagcagatcctgttccaggcctatgagaggcagaagaaccctagcaaggaggagcgagagacgctagtggaggagtgcaataggtacaacggcgggcgggaaacagtgctggtttggtctgggctgcggcaaggccagggaaggggaaggtgactctaggtcctgtaaaaggctgtccagttgccgagaactcctgatattggcttagcctggcccagaaaattgagaatacttgaacctaagcccattcctcgcagcccccctgcaccctggacaccaagcaaccccttccatggatgctcacccaattcgattctctctacaatcctatggctcttttgctcactttatgaatggagagactgaggtcagacagactgtcaattgcccaaggtcacacagcagacctggcattggaacccagatctgccagcctcaaaccctccggcagagctcagcttctcagaaccctccccttcatgcccaggacagggttcctctgagcctggcctggaggctcatgggtggctatttctgcagggcggaatgcatccagagaggggtgtccccatcacaggcacaggggctgggctccaacctcgtcacggaggtgcgtgtctacaactggtttgccaaccggcgcaaagaagaagccttccggcacaagctggccatggacacgtacagcgggccccccccagggccaggcccgggacctgcgctgcccgctcacagctcccctggcctgcctccacctgccctctcccccagtaaggtccacggtaagtggtatgtggggacaagggacacgtgggaaggtgggagggttggggaggactgtcccagtgacagcagtcacctaaacctctttgcacttcagtttggttccattccattcatgccactccttatcactctacttcactctgttcattcatccattccactctatctcattccattcactctactcctttccactctattcactccatccaccacaattaaccccattccatccactccatccactaccttcgactccactccatccactctactccattcactccactcaactccactccatccactccactccgtccaacttcatcccatccactacattcaactccactccatccactctactccatctactaccttcaactctaccccatccatccactccactccatccattccatccaacttcatcccatctactacattcaactctactccatccactccactccatccattgcatccaacttcatcccatctactacattcaactccactccatccactccactccatccattccctccaacttcatcccatccagtacattcaactccactccatccactgtactccatctactacattcaactctactccatccactcccctccatccattccatccaacttcatcccatctactacattcaactccactccattcattccactccatccattccatccaacttcatcccatccactacattcaactccactccatccactccatacctggctccatccactccactccatctactacattcaactctactccatccactccatactctattccatccacttactccatccactccattcagctccactccatccactccactcactcaactccatctactccactccctctacttcattcaactctgctccatccactccactccacccattccatccactgcactccaaccagctccattagactccactccatccactctacccactcttctctccactcctctccactacataccattttattctatctgtcccatccactcaactccattcactccacatgactccacatttcatccattccactctacttcatccactcactccactctataccattccactccactctattcacatactccaccattccagtctactccattcactccactccaacccactcactccactccataccattccactccactgtgttcacacaactccatccattccactctagccactccattcattccactccacgccacactattcctcaccattccatccactccaccctataccattccactccactctattcctccccacccgtcctctccaccctttaccactccactcgactgtacccattccacttgatcccactcattccactcaattccatctactctactccacaccatccactccacttcatatcattccactcaactcaacctaagttgatttgggttaattcaattcaattcattcatttcagattgtatcaattcaattcatttcaattcaactaaattcagttaaattcagttcagttgtcttctactgagcacctactgcatgtcaggtatagcactaggcagtgggaggaatggagctaataaatgcagtcccagccttcaaggaactgggagcagctgacccagggcttggcaaaaggtagaaacaaaggcagatttgctggctgcataaaggcagacaggcagctggcctaagcaaaccaatggagtttgaagtgctgagggctgtggaggcaggggagggcagggaagtggggtgctgaggcaggacactgcttccctctccaggtgtgcgctatggacagcctgcgaccagtgagactgcagaagtaccctcaagcagcggcggtcccttagtgacagtgtctacacccctccaccaagtgtcccccacgggcctggagcccagccacagcctgctgagtacagaagccaagctggtgagtgtccttgcttgtaaggaaaacccaacctcatctttccttggcagggagattctggagcagtccctagggaggccctgtggggaccccggccccccggacacagcttggcttcccctcgtaggtctcagcagctgggggccccctcccccctgtcagcaccctgacagcactgcacagcttggagcagacatccccaggcctcaaccagcagccccagaacctcatcatggcctcacttcctggggtcatgaccatcgggcctggtgagcctgcctccctgggtcctacgttcaccaacacaggtgcctccaccctggtcatcggtaagctggtggggatgggtgggcacctgggtgggaggctcatggggcaaccgcagaatccaggagctggaagagccactgggactcattcattcattcatacaacatgtatttatccagtgcctactctggaccagtcactgtgctacatcagtgatacctgggtgaaccaaacagaccaaaatctcagcaactcaagcagggaggcaggcactaagcataatacatcaattctgtggtacctcagaaggtgaagggtctatgggcaaattacagcagggtaagggggactgatgttttctaagtttttgttttatgaagaaaaattaagcccagaaagcccttatttgcaggtacaattatgcagaagcccagtacataagatagataaggagctgctaggagaggggagcagagaactgaccccatggcctttgcactgctgtggaaccccagggctccagggaaccgcagtttgacaacttttgaacaagtcaccgcctgcctctcccactagcctagacaaagagctaaaggctcagagagggggaatgacttgccagagccacttaaattagtggcaggtcccagtggagggctgtttcctgaccaccctgccccctcctccaaaccacgggctctgggaaggagaggtggtgcccttgggaggtcttgggcaggggtgggatataactggggggcccagctgattccctccccttccactccaggcctggcctccacgcaggcacagagtgtgccggtcatcaacagcatgggcagcagcctgaccaccctgcagcccgtccagttctcccagccgctgcacccctcctaccagcagccgctcatgccacctgtgcagagccatgtgacccagagccccttcatggccaccatggctcagctgcagagcccccacggtgagcgccctgtgccccacacagcaggagatgatgatagaggttggctgtcaatggatgcaggggaaaggggtgcctggcaggcattgcagtctgcatgtgtctctgggacaagtgtgtttccgtgattgagggtgtctgcaggccagtgtgttcccatgtgaatgcacgtatctgtgtgtgtgcacgactgcttgtgtgagcagatccctagtgcgtgtctgggtgtgtatcggttgtgcatgcatttgtgtgcatgcctgtgtttctctgaaactcttagggccatatgaatttctaaaatctattcagattttagaaaggtaatctggggccaggcgtggtggctcatgcctgtaatcccagcactttggaaggccgaggtgggcagatcacttgaggtcaggagttcaagaccagcctggccaacacggtgaaaccccgtctctactaaaagtacaaaaattagccaggcgtggaggcacgtgcctgtagtcccagctacttgggaggctgaggcagaatcgcttgaacctgggaggcggaggttgcagtgagctgagattgtgccactgcactgcactccagcctgggcaacagagtgagtactctgccaaaaaaaaaaaaaagaaaaagaaaagtaatttggtggatatgccagctatcacataacactcccagcagggtttgagacagccccctgtgatcaaagcactgctatttctgcagccaaagataggatttccacaaggcagtttaaacactcataacctcataccaggttcaggctgggtttcgccaccaaatgagctctagtgccaatcttaaggaaatcttttggtttcagacctttttggaatttgggactgggttaagagatttggggcctgtgtatgtctgtgtgtacatggttgagagtgtatgcgtgtgtgtgtgttacatttttatctgagtcactgtgagaatatgtggtttatgtgcgttttcctagtgtctgtgtgtctcttgtagggtctatgtgtctcctgaggggtgggtggaggtgctgtaggcaaaacatggggttatatttggaaaggtggcctggagatggaagtactgctgtcctctgccttgctctttgacaggggccacctgaacttactacacagcacctgagtttagtacagtagcacctgtgcttagtacatagcacctgtgtttagtatagtagcacctgtgcttagtacatagcgcctgcatttagtacagtagcacctgcgcttagtacgtagcacccgtgcttagtacagtagccctgcacctgcacctcccgttccctttcatacctgctgtctccaggtgacaagaggagctggagttggtttctggcctcctccaggctcccctgcatcaagcgcagctgagcagttccctgtaatggggagagggtctgtccctttatctggagcctccagttttgaaaatcagccctggatctccaactgctgcccagtctggctgttcagcaggccccatgcccccctttccccagtcttgaggcctgggactagggctgtcaggcacgtctgccacgtctgcccctctctcccctgcggccagccctctacagccacaagcccgaggtggcccagtacacccacacgggcctgctcccgcagactatgctcatcaccgacaccaccaacctgagcgccctggccagcctcacgcccaccaagcaggtaaggtccaggcctgctggccctcccttggcctgtgacagagcccctcacccccacatcccccgggctcaggaggctgctctgctcccccaggtcttcacctcagacactgaggcctccagtgagtccgggcttcacacgccggcatctcaggccaccaccctccacgtccccagccaggaccctgccagcatccagcacctgcagccggcccaccggctcagcgccagccccacaggtgagaggccctggctccaccccctcccttactgtccctgcccccttccatgttggtcccaccccttctgttgctgtccgtcactgtggggctgtgcatgcagcaggcctagggctgctgtgaggaagcactggcaggcgtggaggggtggggtgggcttccatgaagcccaagaggcacaggcgaccccaggaagatggggcccaccttacaagaacatctcagggactggactgaggaaaatgatgaagtaattgttagaggcagtggagagtaacgataaggaccaggtctgtgagccagaagcgactcttgcatgtgtttggtttggcttggctcagggttgaacattctttgaatttgttgccaacatttcaaaatcaggaattttcacatagaaatccagatttctggcatcttttggaaaattggaaaaattcatattcccatataacagtgcaccaggcctcactgcatccactcacatcggctccaatgacccctggcggtggggcggtcacctgagtttgtaatctatgatgccattgtcaggagtgggcactttggagtcaggtgggtgggctttgcagcctgcctttttgcaagctgccccctttctataaggttcctggacccggccctggcagctgtcatgacagccactgaggccattctgtgtcctggcattcaccccatgaggcgtgtccatgaccacccccattttacagatgagaaagtggacactcaaggaggggagggacttgcctcatctcccacagctaccagatggcagggccaggactcgaacccaggtcccacctcaaagcccattctcttaaccattgccatcagtcagggttctccaggaacacagaaccaacagatttatttgaaggacttggcccgtgtctgcggggggctggcaggcctgaaatctgttgctggcagctctggggagtgaattctgcagccttgaggcagaattccttctctgggaaaccggtttttgctcttacggccttccactgatgtaggaggcccacccatattttcagggtaatctccttcactcaaagccaactgattgtggcattaaccacatctacaaagcacctgcattcacagcagcgcctagattagtgtttgactcagcctagccaagccaacacgtacaactacctacctcggcatctcaccggggcttctccagtgttcacactaagatgtactcaggccactccatgggcggccgtggaccctggctgggaggctccctttgaagaaccgagggtagaggtgtgactttggggttcctgttatctgctgtgatccaggaggtgtggccctgcctccccatcctgagtacccctagggacaggcaggtggggtgggtgtgggtgcctggtgggtggctagcagccttgtttgcctctgcagtgtcctccagcagcctggtgctgtaccagagctcagactccagcaatggccagagccacctgctgccatccaaccacagcgtcatcgagaccttcatctccacccagatggcctcttcctcccagtaaccacggcacctgggccctggggcctgtactgcctgcttggggggtgatgagggcagcagccagccctgcctggaggacctgagcctgccgagcaaccgtggcccttcctggacagctgtgcctcgctccccactctgctctgatgcatcagaaagggagggctctgaggcgccccaacccgtggaggctgctcggggtgcacaggagggggtcgtggagagctaggagcaaagcctgttcatggcagatgtaggagggactgtcgctgcttcgtgggatacagtcttcttacttggaactgaagggggcggcctatgacttgggcacccccagcctgggcctatggagagccctgggaccgctacaccactctggcagccacacttctcaggacacaggcctgtgtagctgtgacctgctgagctctgagaggccctggatcagcgtggccttgttctgtcaccaatgtacccaccgggccactccttcctgccccaactccttccagctagtgacccacatgccatttgtactgaccccatcacctactcacacaggcatttcctgggtggctactctgtgccagagcctggggctctaacgcctgagcccagggaggccgaagctaacagggaaggcaggcagggctctcctggcttcccatccccagcgattccctctcccaggccccatgacctccagctttcctgtatttgttcccaagagcatcatgcctctgaggccagcctggcctcctgcctctactgggaaggctacttcggggctgggaagtcgtccttactcctgtgggagcctcgcaacccgtgccaagtccaggtcctggtggggcagctcctctgtctcgagcgccctgcagaccctgcccttgtttggggcaggagtagctgagctcacaaggcagcaaggcccgagcagctgagcagggccggggaactggccaagctgaggtgcccaggagaagaaagaggtgaccccagggcacaggagctacctgtgtggacaggactaacactcagaagcctgggggcctggctggctgagggcagttcgcagccaccctgaggagtctgaggtcctgagcactgccaggagggacaaaggagcctgtgaacccaggacaagcatggtcccacatccctgggcctgctgctgagaacctggccttcagtgtaccgcgtctaccctgggattcaggaaaaggcctggggtgacccggcaccccctgcagcttgtagccagccggggcgagtggcacgtttatttaacttttagtaaagtcaaggagaaatgcggtggaa

SEQ ID NO: 61524 - DNA, 78825 bp, Homo sapiens
ttcccggacccctgtttgctttagagccgagccgcgccgatgccctcacactctgcgcctcctctcccgggactttaacaccccgctctcctccaccgaccaggtgaccttttgctctgagccagatcagagaagaattcggtgtccgtgcgggacgatgcctgagcaggagagacagatcacagccagagaaggggccagtcggaaagtgagttttgttcccccgcgtccgcgcagcgtgctcactcccaccaggaggattttcctccccgcgttcggcgcttactcgcccccagggggtgcgcagggaaggccgagccagaccccagctccagggatgtcttggcgtgggagaaaaggaccctttagaaaaagtgtgccgtcaactgatgtttgggagcaatggaaaaccccgcacctcaaaattcatctttatgcttttaaggggtctgatgctggagagataaagtgagcgtcgagttgctgtgctagagccctaatggctcaaaacgatgaagttagttacctggagaagttactcagagcctggtgcttggaccagatatggtatatcgaggtcctggaacttttataactgttttaaattcattttaattgtacaagtaatacattaagacagtcttttaaaaatggaaacagcacagaaatattttgcacaaaaagcagatctatttttcagtctttttctattcacgtacatatgtcttcattcggcaaatatttattgagaactttctatgtttcaggcacacagtgttgagttgatacagtggttaacaagacatgtatctatatgtaatatgcacacattcagagaaatctttaggtttcatttgtatgaggtgttaaaatttttgttttacctaaatgagatcactgtatgtgcattctcttttttcagtttaacgatatatcttagagattgtttcactaactgtctaattcagtgcaacctctgcacagtttggacgcatcatagtttattcatggtttcctagtggtggacgttctgtttgctactttttttctctctctcttgcaagtgaacatctttgtacatgatttttaatgctgacactatttctttaggatagatacttaggcctggattgctggacagaacagtaggctgtttcttttccacagatttctgaaactaattcactgacgttgctgggtgccctttagtagtgaattcatctaggctccggtgatacagaaatgaaaactaacggattagtggacagacagagagaggctggttagtaggtggtttgtagggtatgatgactatgcatttgataggagtatgaagaaatgttgggaggggtggcttgtacagaggagatttcaacttcctacagtgtccccacctagagaaagaaatcattatccttccaaatcaagctcaagacctgccacctccttgaaacgttctgtaactgctcctgcccatgttgacctgtcttctggaatcctctgataatagcgttgaccagcgttattgagcttactgtgtgctgggcattgtgttaggcactcatatccctctatgtgcactctcgcgtttaatcctcacaaaaaccctttgatgtaggtattatatcttgttatcaacatttattcaacaaatttttttgtgtgtactatgtgctcaaacacatagtactcaaagttttagacactggggatttaggtaggaccgagaccttgccctcatgaatttacatcctagttggagataggaaaaaaaaagggataaacaaatgtatagcgtaggagttaagggaaaacttttgtgccccgtgaagcgtcactgaaaaatcaactgacaaatggcagattaataggagagaaggcatacacatttactaacgtgccgtgagagtcttacaacataagatctcaaaggaaggcaaggtggttgccacaattatactatcctgaggttacagaaagtgtgggggctctaagcttggccaaaaacaggttatggttgtaaatcaggttataggagggagagaagaggagacctggctagcaaaggtggtcttatgtagatgaaacctcacaggtagcagccctcagggagaagaaatgtttcagaccttgaaggtgccaaattcagctaatctcacccagatccagacaaggaagggccctctgagaaaaactggctgcgtcaatggaggttctcaacagatgctcatctccctcacagtaggactacttttgtctgtaggccctctgaacggccatctcaaaatatttccaataagtctgttttgaggtgaaatgttttagtttccttcaatagctttatttcaggtactagtaagtactatgaagaaaataaagcagtttgggtccaggagttcaagaccagcctggcagcatatcaagacatcgtttatacaaaaaaaaaagaaaaattagctgggcataatggtgtgtgcctgtcgaaccagctactcgggaggctgaggcaggaggatggcttgagcccaggagtttgaggctacagtgagttgtgatcccaccactgcacttcagcctgagtgataaagcaagatcctgtctcaaaaaaaaagaaaagaaaagaaagcagaataagggaataagatagggattgacatgggtggagaggaagatgctgttttaagtaggtggtcagggaatgatttctcttggaaggtaggatttgagtagagacctgaatgattcagatttcagagaagtagcctaggttgagaaaccataaagtgtgagagtcctacggcagtcatgtgataagaagaaatatatacttggtcttgtcccaagttcctgacatagagcttcttaaaccgttgtaatttcctgagagatggtgataagagcatcttttgttattcataacaagtctctttcacccctacctgagtttctgttaatgagagggctcttgataggcccctagatagcttcaggatggagactgattgccagaagaaccaaccatgtgattaggggattcgaatgttcagccccgtgctccaacctctggagattgtgccaatcaccagtggacaatgatctaatcagtgatgccggcagaatagagctttctttaaatttttatttatttagttttttgagaggtagtctcactctgttgctaggctggagtgcagtggcgggatctcggttcactgcaacctgtgcctcccgggctcaagtgattctccggcctcagcctcctgagtagctgggattacaggcgcacgccaccacacccagctaatttttgtatttttagtggagacggggtttcaccatgttggtcagggtcatctctatctcttgatctcgtgatccgcccacctcggcctcccaaagtgttggaattacaggcgtgaggccactgtgcctggcctttttttttttaaccaatgcagtggatcacaaatagagctttcttaaaaaccctaaatgatgggttttggagagcttcctgttagtgaacacatcaaggtgctgggaaggtggttcctggaaaggatatggaagctcctggaaacctccattcccatattttgccctatcttttccatgtggtggtttcttagctgtattttgtataataaactggtgatattaaataaagtgctttcctaagttctgcgagctgttctagcaaattacccaacctgaggaggtaattgtaggaacctcctgactttacagttggtcaggagtacagatggcccagacccagcgactggcatgtgaagtgtgggcattcttgtggtcttgtgggcctgagcccttacctgtggggtccgtgctaactccagatggttggtgtcggaattgaattgaattgtagggcacccagttagtgtctggagagagagcattggttggtgtgaagaaaaaccccacacatttggtgtcagaagtgtcgtgagtggaaacagtacagaagacatgatgttagagtttggggaacaataggaaagccagagtggctgtggcagagggaaggagtgggagtgatagaacaggagatcagagttcatcattgctttacagatggggaaactgagccagacacaagttaagtaacttgcccgatgtaccttgcttataagaggcagatctaggattgagtcctagccaggcctgcctgactttctcagcgattttttattgtcaaaacttacttgacacttggtcataccacctggtatgattatttaatgaatatagcttttatttgcaactctgtgcttcttgaaatgggaaccgggtttttaccgtttaaaaaactatttcccacatgtaggtgcaccacagttgttcttgaatgaatggattctcgacatgatttctccacattgttttctcttcagaggcctctctgtggggcagcagtgacctggtcattcagccttcagtccacaaacattatggagcactttctgtttgcctggtactgggccaagcagggggatgcatagatgaagagaggtcagcccctgtgctggatgcatgctgggacagagctgtctacatggtacagcacccacagaaggggcagaaaaattccttcagtgggaggtggtgctcgagtgggtctttcaggaagagcaggcattgattgggcacacaggagcatggagagaagggcattgaaggcagagaccagcatgtataaaggtccagaggactggaaatggaaagaggcatttaggggactgtgaggggcgtggcaaggctggaagagtggaaggctggaaggtctgtggaagaccctgtttatcaggctaggagtttggactttaccctacaggaaaacagcgtaagtcactcctgcaaggcagagggtgaactgggcagggagctgcgggagaccagctagagactgttggaaatgatcgtccccatccagaccaaaggtggctgaaaagcctgaaaaagaactgtaagttgggtcttctacccttattctttatggaattgtcttctcagtagagaaactaggctatccaaactcaactgtcctgagtattagaggccagtggtcgttttagcagcaacagagtgcagttggtacctacggagcagggtaataaactaagcaagtgacagagatggatttaagtgcttctttacgtgacacacattttcttctcaatgggagggatggagatggcccagtaacatgaacactgctcactgatgccatagcatagatatcgaggaagtatccgtgttcagtgctgagagccccgaacaaagatttacccacgaatttattaacagcaagccagtcattagcattgtttctatagatattcattaactaaaagtatcccttatgggaaaggaagggatgggccgaaataaaggggtgggtctggctagttatctgcagcaggaacatgcccttaaggcacagatcgctcatgctgtttgtggtttaaggacacctttaagcagttttctgccctgggcgggccaggtgttccttgccttcattccagtaaacccacaaccttccagcgtgggcgttacggccatcatgaacatttcacagtgctgcagagattttgtttatggtcagttttggggccagtttatggctagattttggggggcctgttcccaacagaggcacaaagggactaagatagaaattggtaccaagaagtggagtgttggtataacagatccctgaaaatgcagagttggctttggaactgggtaaagggtagaggctggaagagtttggaggtacatgctggaaaaagcctagatagtgataaactaagcattaaggattattttggtgagggcttagaagaacagagctgtagacagaacctgaatcttcttagagattacttaagtggtcatgatcagaatgttggtggaagtatggacagcaaaggtcattttgatgaggtcttagacagaaatgaggaatattttattgggaactagagaaaagcccattctgtttttatttataaaatggcagagaacgtgggtcagttgtgtctgtgccctaatgctttgtggaggatagatgatgaactagatgaagagtgatgaactaggatatttggtggaagaaatatctaagcagagtgtgcagggtgctgcatggcttctcttgattgcttataagaaaatgcaagaagaaaacaaattaaagacagaaattataatcaaaagggaagcagaacttagaaagatttggaaaattttcagcctggctagatcataaagaataaaaaggctgctgggaagaatgaccttaaagggatttgggaggtctttgggactgctcctcctgtcacaggcccagagtgcctggaccatgagggcaggagggagaggaccataccccgccagcaggtctatgggtctagttgcccagggccacctcgagcctctgcttcctgcattctgcggtgctccttggccaccccaggtgcggctcaggtgtggcttgggctgctgctctggaaggtgcaggctataaaccttggtgtccatgtggtgctaactgcagctgagcagagttcaagagctgtggagtgtggctactttcatctagatttccgaggatgtcttggagaacccggggcccaggcagaaaacgtctatggggaagagccaccacagagtgcccccactagggcagtaccatcagtcatgaattgggcagtgccagactacatagttcagggctccatctagggggaatgagggaaagactttgtaagtgttcagggaagcaaaacaaagagaataattgattggttaaagtagaaaggcctagttataagctgtcatgagattggagaaaaaaataaaaataaggaataaaaaagaccctagttagagtttagttggtggttcctgattgatgaagtctctagttagagatagttaatggattgtgattggttaagctaagctttgttttactgtttatattgagttgggtttggtttgcttacataggaacctgaaatgttggagtcatctcagcctaattgcttcctgattaatgatttgttaacacaagttaggatgcaactccatcttcctgatacctcatggcctaaaacagttgttggtgctgcagccgtgtatttcaagttgcacatagctgaaataagggaaaggcaaggataatcctgctctctctttttttttgagacagagtcttgctctgtcagccaggctggagtgcagtggcacgattttggctcactgcaacctccctctgccgggctaaggaaactcttctgcctcagcctcccgagtagctgggtttacaggcatgtgccaccatgcccggctaatttttgtaattttttttagtagagacggggtttcaccatgttggccaggctggtcttgaactcctgacctcaggtaatccgcccccctcggcctcccaaagtgctggattacaggtgtgagccaccgcgcccggccagtcctgctgtcttttagggagcctgcttaggagccctgacaaacaactttgccttatattccattggctagaactttggccagttttcaacatcttaaaatgggaagattttactatgtaaaactccagctatccaccttctctcggaagctctggtgacaccaggccttttgacaacagttggctggagctgaggaacagctgcctgctccaggtggggcatgagctcctcctgtggccgcaagccccgcatggcctgttctgctcatttaagtcactgcctacttgtgacagtacaggcaaacctttgctttattgcccttttgcagatgctgtattttttttttttaccagttgaaggtttgtggcaaccctgcactgagcaagtctactgacgccatttgtgtaacagcatatactcacttcatgccacattttggtaattctcacaatatttcagatttttcattattattatatctgttacggtgatctgtgatcagtgctctttgatgctactgttataatcatcttggggcccgtgtaagatggcaaagttaatctataaatgtgtacattctgactgctccactgactccagcagttcatgtctctgtctctccctccctctcaggtctccctatttcctaagacacaacaatattaaaattaggccaattaataaccctacaatggattctaagtgttcaagtgaaagagtccactccctttaaatcaaaagctagaaatgattaagcttagtgaggaaggcttgtcaaaagctgagataggctgaaacctaggcctctggtgccaaacagttagcaaagtttttaatgcaaaggtaaagtccttgaaggaaagtaagtactactctagtgaacagataaatgataagaaagcaaaacagccttactgctgatatggagaaagttttagtgatttgaacataagatcaaaccagacacaacattctcttaagccaaagcctagtccagagcaaggtcctcagcattgaagcaaggccttccactagcagaaagaccatgacttactgacagctcagatgattgttagcatttttttgccataacatattttaaaattaaagtatatgtatttttttaggcataatgctattgcacacttgatagactatagtgtaaacataacttttatatgcacaaggaaaccaaaacctttgtgtcactcacgttattaggatatttgctttattgtgatgatctagaaccaaacccatggatatctctgagagatgcctgtatttgagcttagatccctggcttgaagggataaatgaatgagtaagtgagggaggagggagccagcttttgcatgaggcttgctcccttcccctcccctcccctcccctctcccctcgcctccctgcccctcttgtttcacaggttctctgttgctcaggttggaatgcagtggcaggctcactgcagcctggatctcctcgggctcaggtgatcctatcacctcagcttctcgagtagttgggactgcaggcatgtgccaccatgcccagataattaaaaacatttttttttttagagacacggtttcaccatgttgcccaagctggttttaaactcctgggctcaagtgatcctcccatttcagcctctcaaagtgctaggattacaggtgttagcccccacgcctggccctgaatgttgagtattgtcggaaagtttagcagtccttttacagcaagcacatttgtaagttgtttttgcttggcattctttgtcattcatttaacaaatgcttattgagaaattctttaagtgtcaagcactgttttagaccttggaataaagcagtgactgaacaaaatagatgtgaagaggctgtgtgtggtggttcagacctctaatcccagcactttgggaggccaaagtaggcggattgcttgagctcaggagttcgaggccagcctggataacatagtgaaacccctgtctctactaaataaataaataaataagcaagctgggcatcgtggcacgcacctgtagccccaggtacttgggaggctgagatgggaggatcacttgagccagggaggcggaggctgcagtgagccaagatcatgccactgcactccagcttgggtgacagagtgaaaccctgtccttaaaaaaaaaaatgtgaaggattcctgcacttgtgaaacttatatcctaactggggagatagttgttaaaaagagtaagtaaaagatgtattattgcatttggtggtgattgagaattctcaagaaaaataagacagggaaggatgatagggaattgggagtgtatgaaatttagatgggatcatttgggggaaatcattgagaagttgacgtttgagcaaagatttcatggaggtgaggaagtgagccctttggatatgggatgttggagggaggtatttctaagctagtagacagttccggaggcaggtgtatgctttgcttacctaaggaacagcaagatcagaatgactgtttcagaatgagtaaggggccaggagtgtgaggataagttggaaggtaatgggagggctgcaactgtatagtcttacaggtcatcattgtaaggattttaggttttattaagcacatgggaaccccctagaggcattttagaggaatgacatcttgtgacttcctcttataggtattctgacttttgtgttgagaatagactttaggggctaagagcagaagccaggaggtcgcttaggagattctaagcaatagtgcaggtgagatgagctggtggcttggaccagggttcttgtggatgtgttgaagtcattagatgctggatgcattttgttggtggaactaacaggatttgctaaacatttacatgtgggtttgaaagaagatgattcttttttactttttaattttaaattcattttaattattatttttgagacagaatctcacactgtcacccagggtagagtgcagtggtccaatcacagatcgctgcaacctccacctcctgggctcaagtgatcctcccacctcagccttctgagtagctgggactacaagtgtgcaccaccatgcccagctaattttttattttttgaagagatggtgtctcactatgttgcccaagctgttctgaaacatctgggctcaagtggtcctcctgccttggccttccaaagtgctgggattacaggcatgagcccctgcacctggatgagattattcttatcaaagagggatccaggattttttcctgggcaagtggagggaaggagttgtatttactaaggtggggaagactgtgggagcagcaggggaagggcagaatgttgagagctctgttgtagacaagttaagtttgcgatgcatatgaaacaccgaggagatggtgatgaggcatttgggtctgtaagtatagagttgggaattgtaggctataggtggtgatatagtctgaatgttaatgtccctgccaaattcatatgttggaacctaacccccaaggtggtggtattaggaggtgaggactttaggaggtgatttggccatgagggctctgccttctcgaatgggattagtgcccttataaaagaggcttgagggagccactttgctcttctgccatttgaggatgcagcagcaaggcaccatctgtgaagcaaagaacagccttcaccggatactgaatctgctggctccttgatctgggacttcccaggttcctgaactgtgagcaataaatttttgttgcttataaattacccagtctaaggtattttgtgatagcagcctgagtgagctaagaaaggtatacttctcctggcctggatgagtgtacaaggaatgagtagagatggaagaggtccaagggctgagctgggggccactgcagcacttggaggtttggggacttggaggctctggtgaaagactctgagtaggagctgttggtgggaaggataggaggaaaatcaggaggtggggcaacttggaggctgagcttggagacaaggactggtcaccttgggcagtgtgtcactggctgagagtaagtatgggggtgggcactggggacctgaggagccagagaggggataggaccactgtctcggagagcgaagggtgagcggactagggggtagttggactgccaggtggcagcacgggtcctcccgcagttcgtggtgctgaatcagagtgtgggcagccagcctggatgtgcgttctgtcacattcttgttgagctgctagaggacaggcgtgaagccaagtggaactgagagtaaagccgtgttggagttttgcaggaaggtgccagatgatgagggcagccagcgaagtcgaaggtgcatggaatgaactgtgaaatggaaacattggcttttacttttcgataatcccattgtttctctttttggccatcccatctcttcgtaatttagaactatcataatcgtttttcactcaagactgttcagccaagtgcagtttatttaagagcactccttcagtgagcttacttaggtatgtgtgtgtttgtgcctgtctcctgttaataagctgatatgaaagtcctgctgagctagttgtttcagtcttggagatcagcagcgatatggggaggagaagccaagcctctgttaaagcccaccagtccttccctcccccgctcccagcacctagtgtttgaggaattcagactttgaatactgctctttgctactgttcttctctcctaacttgccagtaaacttccaagggcagtatgtgtcttgtgctcctctcctggtcttctgttgtgcatacacttaaatacggctctcaggctgtgaataatctgctttggttaacactcccctctgttctgaaggctgggctgctagagccctgactgttggtggctgtgctgtttgcagtgctcatgttctcttcttgggaacccaacatatgcagctttaatgtcaggctctgccctcctgtcctgtcacaggatccgggactcctctccccatcttgggagggatggcctggggatttcgtctgggaagccctgcccagtgtgagcctctagctggactgagcaggtaatgtttgtgagtgctgaaatattttaaccagatgtccctcctccaaagagccctttgtcctggaggttcatggaaacatgagctgcccatctgcctttgggcccaggcttctcaggttgcaacaagattgtttaggacaccaaagagatatttatttttatacaggaaaaatccacagactgggaaggcgaataggaggtaaagaagatgaattttcttctggaaaatggctcgtgaaatttgtacatatggaagacagaataatctagtgcaaggaaatccttgaagacctagaagaaatatgtgagggactgatagagtttgcccttgtgttgtggtaagggggacaaaaagtaccatgaaattctaggtagaaagcacattctgagcagtatataattgaactcatttatttaaatatggttaaatatacttattcaaatgtaaatatgtaaatatttaactgcttaaatatacttatttaatgtctgatattgttcatcaccatgttaggtctgtgggcagctaagatatgagatccttgtgttccaggatctgaccacgtttcccaaagtgagcacatgcccataggcatcagtaacaagtgtggactgagctgactgcagcctcggtggacagagaagacttgtcctccagcagtgttacaggctgaccacctgctggcaccctgatgttgacattagtgatgctggaattcagataagggagagagctgctagcaggattccacagagaggcaggacttaaaggataagaaggattagatggtgccgggaaggggaggagcagggaagccagggtcaggtgtgaggaaaggggaaggtgctagaaagaggagtttggacttaatactgtagcctaggaaggtggcccatgccttggctgttccacacgtctcttagattctatgggagcaaaggagaagccactgtgtttaccccagacttgccttcttcccaccctccccgctcatcttggtgtactcatcaccatgtgctcaatctgcgaaactggaaatggcattgtcatcctcaggcccccactttttgtcacctgctgtgatccagcagtcactgagttgggaggcctcctcgtttgtttaatcgtattctactattaaattttctgccccttgtaatccctcctctcctgggtcttcattcttgtttctgcccaaactgtttccagatcacaaatatgattctgtgagttctctcctcagaaactcctggtgattctacaccacccacaggacaaagtctagactctgccctttctaacctggccccagcccccttttctggctgtcttctgggtctgagccaccatctagaaatggtttgaatggtgaagtatttcaatttcatggagctaacagaatagattatttaaaagcatgtgggacatatgatcccaacatattttccttattagctattcataggcacagcacagaagaagcatttatatttataatgatctcatgtcaccaaggaaaagttaaaatatgttcaataactcactttaaaaggcagcggaaaaatagatgtcacttatggggaatattttcacccagaatgacaaaatttttaaaaaatctaatgctcaaagcgatgagcttcagttacctggaaaatctacttctgatgccccataaatgaaatgtcaggtggtcagcagggcatgtgaggctcctgatagatcctttcaggaagggagagacatagataagcaagacctgaagaatcactagaaagcaatcacagatgcacctgatgtatttacatgggctcccatagaggcagctgcacagccccacagtgctggcctctggcagggaggctagggttggggctcaaggcctttagcatcaaatatacctttcctttgatgaaaatgggtttgaatgacatttcttggaaattgaggcaggttctttgttttttggctgagcacttaggagataagaaacaaacccagacacattttggaggagttggttgctcagcgtgtgctttagaagtgatagcaaccgccacaagtgtggtaagaagcagcaggataaagcaggcacgaaggggctttggtgcatggaccagccttggtgttgcctttcctcaaagagaacagatctctcagtcaggagttcttggggcagggatgacagtgttaatgggggaggaagcgtcactgtgggcaacctatgaggaggcagccttcagtgaccttgggcatgtgttctgagtgccctcactgggtgcacaccttagtgaccccctgctggtacattctgctgtgaagaataacacggagagacagagtgatcattttaccctgaattcaattccacactcacttgcagcaggaggtatggctggaattagtggctgtggtggagctgttcctgccatgggggatgtggtctctccttctggtccccgagtggtggggtgggaatggaggcagcgctgcccgacagagcaggctgctgctggaattaccacagtgtcgtgtgtctcctcctattaatccccatgtggaacagcaggtagcctgagaagcctgaattgtgccttagttcctggccgtggtgctgcttaaacagatgagccttgttagccagtttgtgcagtcagttcttactgaagtcaagcctttggtccaagggaaaacaaagctacaggaaacatggaactttcttacaccttcttgaaaatacaagtcatgttgcctaggaaatacttctctcaccaagtattctgcacgctgccaacattggagctgtggaagaggcagctgaagcaattccaagaaagtgctagcagtttggtaataaaaggaagtggcatatctctcctgcctctagactgggtttctaggagtgcacatggccaaaaggaaactgctgcactctggcaagtgattacatgttgtgctcatggacaccttggccgggtgtccagtgtgcactgggtgagggtgtgcatgggctgtgtgcaaagatctgcagtgctgcacacagtgtgttgagtgagagggtgccaagtgctgggacggttgtagataaacaaaagcaaataggtgcagtactgtgcagcctgcccaagttcccaaagcttgctgccaggctgaagactgctggcagcctctcctgggctgggtcaggagtagaagggtgtcttccccttgctaattaggaggacacttctaaagcatttctctctaacacaaccaaatagtctgctgaaggtgaactgctttagtgaggagggaagccgtggccgtgaactcagcgatagagaaagccaggggtgatgtgccccagagccccgagcagtccttcctggcaactctgagtgaccaacatgtgaccctgctgtctgtccacaagcagtggtcctttaggaagagccctggggttaggcattcagccaggccagtgtctactgtggaggaaggcactccaccgtcagaggaaggagaatttccacagagagttttgaatggaacctgggaaatgagttccagtcaggtcagtgcaattgcagatgggctaaaaagcctggaagggcctggacccattttaaagatggaggtttctctccatgtctcttgtgtgggatattggggagaggtctggggagcggaatgagagtgtgaatgtagcacctggcaggagtcaagctgattaattacaccatggcttggaagtttgggttttgttgctttttattttcagaatattttgtaagactctatgaagcaaaagttttccacaatgcaagtcaaacaaaaatgaatccttccttctttttactaatatgttttatagtgtataccttattttgttaatctgtacattttaactaaacattttgaaaatgctgcaaaatgaagttccttttcttaagcaagttgaagttttgttactccaaaggttaggtcatgtccaaaagtaagacagtataacgttttgtaaaaatggtgccttttagcagcatttctgagcagactggtggtgtgtacagggtcttcttcattgacctagtcagacgaaaataaaaaacaacttttgaaggcatttactagttagatacaaaggaaggtttcataagtactttgcttcctctaagacttatttttgtgctgttcattggttaaagtcccaaagactaaaggaaattttgtgaaaagaactttcaaatgtgctatgcaagagatttacatacgttgaaatcacagggtacttggatattgaagacagaaactccttttgagtatttaaagattctgcattttgctatcaggtttttaaccaaggatataactatgctcggaggtatttattttaaaatattaaaagtgttttttggtgttctgaatttgtggaaatttccaagagactcctttaaagttttttcctaggcaaatttaaaaatatgaaatgtagaattattcagtggctgcccgtttgggtagcttctacacagaggttcgagtggttttaggggagggaagtgaggtgatagatacaattttaattactttgttttctaaagtagttttataaatttcattttatgtctctttaaactgtattaagccagtagctaaactaatgtgttaaatcacttagaattttaaagagtgacagagcgtttaatcttttaatcagccttttcatatgttgccggtttatacaatatacggtgaacatttatacttttagccatgtgtttaaaatagtgaaatactaaatatgttggggtgaaaatgcttgaggcatttttaaaaaatgtccaaactgttactttacaatttccagcctatatctgaagttttgagatatgacgtgtgctggtgatttttaaggccagcaccaatctgtgactagtggggcgacctgaagctgactaggggagcctcttcagaaaggagggctggggaagaggccttggtggaggggatctgagtgcagacccaacacaagttgtgggacctgggcaggtgagtcttggacactctcctttagattcttcattgcaaagtggatgataaatcctgcctcatatgattgtgaaagcactttgtagattatcatgcaaatgcaaaatagtgttacttctgccaaaattatgctttttcagaagaatttccaactctgagatatgtttgatgtgttgtctgaaggtctggacaggactgtgataacccagtaatctatctgagcacagttgcaactctatttttcctttgtttgtttttttctaagttttttattttgggacatggtctcttgctgatgccgaggctggagtgcagtggcatgatcatggctcatagcaccctcgaccttccgggttcaaatgattttcctgcctcagccccctgagtagctgccaccacaggtgcatgccaccatttccagtttctctttatttgtagagatgtggtctccctatgttgcccaggctggtctcaaactcctgggctcaaatgatcctcctgcctccccctcccaaagtgctgggattatagatgtgagccaccgtgcctggcagctctattttttctaaagctctgattataaaagtaacatatactctatataaaaaacaaatttacgatggaacgaggagaatacaaaaaagtataaagaaaaagcagtcgttttcccaacaaatatgaatgtgtatacgtgtatgtatgtttatgtttacataatgtatatttttaaaataaatatgggatcaaattatacatactatcttatactttgcatttcttactgaatattttgtggacatttctgtatgtcaatatatatgtaaatctgtattatctttttttttttttttttttttttgagacagagtcttgctctgtcatccaggctatagagtgcagtggcgtaatcttggctcactgcaacctccatctcctgggttcaagtgattctcctgcctcagcctccagagtagctgggactacaggcacctgacaccatacctagctaatttttgtgtttttagtagagatgaggtttccccatgttgcccaggctggtctcaaactcctgagctcaagtgatccactcacctcagccatccaaagtgctgggattacaggcgtgaaccaccctgcctggcctatataatcattttttattgcagttccacttttaaatttaggattaatttttagaaagaatttagttatccttaaatagaagaaatttgcagtagctggtttatgattataaaaaccaacccaaaagttaatttcaattgtgactcaaagtctgttataaatcagctttgcaccttgagaactaacatttagcacttggtatatggtaggaaccttactcttgtcacttaatcattttaacaactttagtaggtatcatcagtccacctttaacagacgagaaagctgagtgagagcttaggtttcctgaaaaatttaatcccaggtccgtctgatgacaagtccttgcttttccattggaacactgaagtattatttaatacactgggcaaaatagagttttgaaagtattggaaaactgctaattcatagtgaatggaaagttagcttttaggtggcacgttgttcagaaaggccgctgctatgaataaaacatttaaaaattgctgtttatgcctagcagatttgtttgcttatattttacatttctttttttttttttttacatttcttacacaatgcagagtacattctgtacaatgtagaatgaaatcatgactttggaaaacctgtttctttgattcttctatgtttcagacaggcagagaggggaaaaagatctgttttaaaaggcataactggtaaaagctcagagtctggagggcacatttccgcccgctcctctcccacattagaaagtttctgtttgctgatgtgagcagggctaagcctggtgaggttcctaggaattaattatgaaaagggggaaatagggaggagggccttccccgcaaatcccctccataagagcacgctaaccagagtagaagtcaggggctccgtgctttggcccaggtgttcctatcaaaggttccacagacaacctttcaggcccagaatggtgagctggagaggaatgggtgcctgccactgaggctctcccttctctagcccctccttaactctctcctctacttgtcttggcaggtgggaaatggttggaggttactagaaagttgttccagctgtatacagaattaccctttgtttccagaaacaactgcttaagcctccttactcatgactctgttgacttctttggccaagcttggctgctgtttttttttgtttgtttttttcccgacagggtctcaccgtgtcacccaggttggagtgcagttgccgcagatcttggctcactgcaacctccacctcccgagctcaagggatcctcccatcagtgatcctcccaccctagcctcctgagtagctgggactacaggtgcacactggctgctgttttaatttgtcatcgtatcctgtatctgacagagttcagtccatggtatcaagctattgactgagtgaacaaatgaatgaactagaagtagatttatactgcagcagggaggattgatgttagacacattgaactgatggtgactataaggttgttacgtggtggacttagcatttttagagaccagaatatggaattttgttcttaggtaagtggtggttaggttcttttttttttttctttaaatatgagacagagtctcgctccgtcgccaggctggagtgcagtggcgcgatcttggctcagtgaaagctccgcctcccaggctcaagcgattcttctgcctcaggctcctgaatatctgggactacaggtgcatgccaccacgcccaactaatatttgtatttttagtagagatgaggtttcaccgtgttgtccaggatcgtctcaatctcttgaccccgtgatccacctgcctcggcctcccgaagtgctgggattacaggtatgagccattgtgccagggtgggttcggttttatttttgcctagttgaaatcaggatgacttggctggcacagatatatcccttctaaaataaaggaaaaacaataaatgaagtggtgtgatctagtcatttaaagaagttatctgtcattatggaatcatcagcattcgctattattttatttgcttttgtagagaccatttgaagtggattcttgaatttagtttttcctaaaagtagtatctgctggatacaaacattagtagcaaagtatagaagtgtagttcttttcctctcttagataaagaggactgtcttaatacagttctgcaacttttttttctttttaacatcatggaagtctttccacgtcaatacatgtaaattcacctatttttaaaaaaccatgacatagatttctgttcgatggactatattttatgtagacagttctctatagaagaatattgagatggtttccagtttttcactatttgaatgtagcaatgaacattaatatgtaattgtatatctatatggtaaaattcccagaagtggaatttctaggacaaaagcagtaatactttttgaagagcaattaggcaaaatttagctttctacaaacagtggttaagaactgtttttccttatactcttgtttactgtatcatcagactttttaaattaataaaataacatttattttattaatgttataataaatgttattttaattttaaaaaagatttattagatacttaatatttctttttctaaggattattttaagtagcatttcccatcatgcatttatagagtagtgctaatttataaacattaggtttgtacatgtcttaaaggaatacatttgttttatgtgtcatacctataattctaggcagaaaccaatactccttggagtacagagtaaaaaaaataaataaataaaacctctttgttgggaaaggcttgaaatacagagtgttattagagaagattctgaagcaggaaaatgctgttaattgataaaagttagatggaataattgttacaatagacataaattaaaagcagcacattctctgaaacggttgattataaagctgtgtagcacgagattgtgaatgggttttctaagataatattgtgaagtgctccttggagacgataccctgtcttatagtttgtgaatttctaaatttcattttgttgtatattgaaaataacatatttgtatgtacatatgtggtgaggtttgttaattttgtttttaattttactcacttttttttttttaggcaagtgtcagatatgctacattttgtttctcagtaagggttaatattttcccttgctgtggttgagagaagcaaataggcaatgaatagtcatttgcacagaattacccagaaagtttacagtctgtcctcagaagggcagagattgggttaatgcacacatagccctggcacatagtaggccctcctatgtgtttgaatgaatgccttcatttttaaagtagataaaatttaaataattgtcagtggaaagtctttttggaccattgtgaaacaggattcaaggccagagtgaagggcttgggggaatatgtacactacttttaataattagtttgccttatcagtaaaatggagaaaactatgtagagtactcgaaccttcctgggtcatgtttgaagatcaaatgaggtgatgtttgtcttcatagtcatttgttttcaaacatgtatgatgttaatctttttttaaaaaattatactttaagttctggggtacatgtgcagaacgtgcaggtttgttacatagatatacacgtgtcatggtggtttgctgcacccatcaaaccgtcatctacattaggtatttctcctaatggtatccctcccctagcccccccacccccgacaggccccagtgtgtgatgttcccctccctgtgtccatgtgttctcattgtttagctcccacttatgagtgagaacatgcactgtttggttttctgttcttgtgttagtttgctgagaatggtggtttccagcttcatccatgtccctgcaaagaacatgaactcatccttttttatggctccatagtattccatggtgtatatgtgccacattttctttatccagtctatcattaatgggcatttgggttggttccaagtctttgctattgtgagtagtgccacaataaacatatgtgtgcgtgtgtctttatcgtagaatgatttacaatcctctgggtatatacccagtaatgggattgctgggtcaaatggtatttctggttctagatccttgaggaatcgccacactgtcttccacaatggttgaactaatttacactcccaccaatagtgtaaaagtgttcctatttctctacatcctctccagcatctattgtttcctgactttttaatgattgccatcctaactggcatgagatggtatctcattgtggttttgatttgcatgtctgtaataaccagtgatgatgagctttttttcatgtttgttggctgcataaatgtcttcttttgagaagtgtctgttcataatcttcacccactttttgatggggttgttttttttttcttgtaaatttgtttaagttccttgtagatcctggatattagccctttgtcagatggatagattgcaaaaattttctcccattctgtaggttgcctgttcactctgatgatagtttcttttgctgtgcagaagctctttagtttaattagatcccatttgtcaattttggcttttgttgccattgcttttggtgttttagtcattaagttgttgcccatttctgtgtcctgaatggtactgcctatgttttcttctagggtttttatggttttaggtcttacgtttaagttttaatccatcttgagttaatttttgtgtaaggtgtaaggaaggggtccagtttcagttttctgcatatggctagccagttttcccaagaccatttattaaatagggaatcctttccccattgcttttgtcaggtttgtcaaagatcggatggttgtagatgtgtggtgttatttctgaggcccatgttctgttccattggtctatatctctgttttggtaccagtaccatgctgttttggttactatagccttgtagtatagtttgaagttaggtagtgtgatgcctccggctttgttctttttgcttaggattgtcttggctatctgggctcttttttggttccgtatgaaatttaaagtagttttttctaattctgtgaagaaagtcagtggtagtttgatggggatagcattgaatctataaattactttgggcagtatggccattttcacgatattgattgttcctatgcatgagcatggaatgtttttccatttgtttgtgtcctctcttatttccttgagcagtggtttgtagttctccttgaagaggtccttcacatcctttgccaaattgtattcctgggtattttattctctttgtagcaattgtgaatgggagttcactcatgatttggctttctgttattggtgtatagaaatgcttgtgatttttgcacattgattttgtatcctgagactttgctgaaattgcttatcagcttaaggagattttgggctgagatgatggggttttctaaatatacaatcatgtcatctgcaaacagagacaatttgacttcctctcttcctatttgaatatcctttatttctttctcttgcctgattgccctggccagaacttccaatactgtgttgaataggagtggtgagagagggcatccttgtcttgtgccagttttcaaaaggagtgcttccagtttttgcccattcactgtgatattggctctgggtttgtcataaatagctgttattattttgagatacatcccatcagtacctagtttattgagagtttttagcatgaaggggtgttgaattttttcgaaggtcttctctgcgtctattgagataatcatgtggtttttgtcattggttctgtttatgtgatggatttcgtttattgatatgcatgtgttgaaccagccttgctgcatcctagggatgaagccgacttgatcatggtggataagctttttgatgtgctgctggattcggtttgccagtattttattgagaatttttgcatcgatgttcatcagggatattggcctgaaattttctttttttgttctatctctgcaaggttttggtgtcaggatgatgctggcctcataaaatgagttagggaggagtccctctttttctattgtttggaatagtttcagaaggaatggtaccagctcctctttatacctctggtagaatttgactgtgtatccacctgatcctagactttttttgattggtaggctattaattactccctcaatttcagaacttgttatttgtctattcagggattcgacttcttcctagtttagactttggagggtgtatgtgtccaggaatttatccatttcttctagattttctagttcatttgcttagaggtgtttgtagtattctctgatggtagtttgtatttctgtgggatcggtggtgatatctcctttatcattttttattgcatcgatttgattcctctctcttttcttctttattagtctggctagcggtctatctattttgttgatcttttcaaaaaaccagctcctggattcattgatttttttgaaaggtttttcatgtgtctatctccttcagttctgttttgatcttagttatttcttgtcttctgctagcgtttgaatttctttgcgcttgctgctctagttcttttaattgtggtgttagggtgttgattttagagctttccagctttcttttgtgggcatttagtcctagaaatttcccactaaccagtgctttggctgtgtcccagagattctgggatgttgtgtctttgttctcattggcttcaaagaacttatttctgccttaatttcattatttacccagtagtcattcaggagcaggttgttcagtttccatgtagttttacagttttgagtgagtttcttaatcctgagttctaatttgattgcactgtgatctgagagactgtttgttattatttctgttcttttgcatttgctgaggagtgtttcacttccaattatgtggtcaattttaggataactgcaatgtggtgctgagaagaatgtatattctgttgatttggggtggagagttctgtagatgtctattaagtctgtttggtccagagctgatttcaagccctgaatatcgttgttaattttctgcctcattgatctgtctaatattgacagtggggtgttaaagtctcccactattactgtgtggaagtctaagtctttttgtaggtctctaagaacttgctttatgaatctgggtgttcctgtattgggtgcatatatatttaggatagttagctcttcttgttgcattgatccctttaccattatgtaaggcccttctttgtctcttttgatctttttggtttaaagtctgttttatcagagactaggattccaaccccgacttttttttgctttccatttgcttggtaaatcttcctccatccctgtatttcgagcctatgtgtgtgtttgcacatgaggtgggtctcctgaatacagcacatcaatgagtcttgactctttatccaattcgccagtctgtgtcttttaattggggcatttagcctgtttacgtttaaggttagtattgttatgtgtgaatttgatcctgtcattatgatgctagctggttattttggctattagttgatgcagtttcttcatagtgtctatggtctttacaatttggtatgtttttgcagtgactggtaccagttgttcctttccatgtttagtgcttcccttcaggaactcttgtaaggcaggcctagtggtgacaaaatctctcagcatttgcttgtctgtaaagaattttatttctccttcacttatgaagcttagtttggctggatatgaaattctgggttgaaaattattttctttaagaatgtcgaatattggcccctattctcttctggcttgtagggtttctgcagagagatctgctgttaagtctgatgagcttccctttgtgggtaacctgacctttctctctggctgccctcaacattttttccttcatttcaagcttggtgaatctgacgattatgtgtcttggggttgctcttcttgaggagtatctttgttgtgttctctgtatttcctgaatttgaatgttggcctgtcttgctaggttggggaagttctcctggataatatcctgaagagtgttttccaacttggttccattctccccgtcattttcaggtacaccagtcaaacttatgtttggtcttttcacatagtcttatatttcttggaggctttgtttgttccttttcattcttttttctctatcttgtcttcacgctttatttcattaagttgatcttcagtcgctgatattctttcttctgcttgatcgatttggctattgatacttgtgtatgcttcacgaagttcttgtgctgtgtttttcagctccatcaggtcatttatgttcctctctaaactgattattctagttagcaatttctctaaccttttttcagggttcttagcttccttgccttgggttagaacatgctactttagctcggtggagtttttttattacccaccttctaaaacctacttctgtcaatttgttaaacgcattctccatccagttttgttcccttgctggcgagggagttgtgatcctttgaaggagaagaggcattctggtttttggaattttcaggcttgttgcgctggtttctccccatcttcatggatttatctacctttgctttttgatgttggtgaccttcggatggcgtttctgagtggacgtcctttttgttgatattgatgctatacctttctgtttgttagttttccttctaacagtcaggtccctctgctgcaggtctgctagagtttgctggaggtccactccagaccctgtttgcctgagtatcaccagcagaggctacagaacagcaaagattgctgcctgttccttcctggaagcattgtccctgaggggcacctgccagatgccagccagactctcttgtatggggtatcttttggcccctgctggggggtgtctcctggtcaggagacacaggggtcacggacccacttgaggaggcagtctgacccttagcagagctcgagcactgtgctaggagatccactgctctcttcagagctggcaggcagggacctttgagactgctgaagctgcacccacagccaccatttgccccaggtgatctgtcccagggagatggcttcatctataagcccctgactggggctgctgcctttttttcagagatgccctgcccagagaagaggaatctagagaggcagtctagctacagtagctttgctgagctgcggagggctccagccagttgccatttccctgtggctttgtttacactatgaggggaaaaccacctgctcaagcctcagtaatggtggatgcccctcccccgaccaagcttgagcatcccaggtcgatttcagactgttgtgctggcagtgagaatttcaaaccagtggatcttaacttgctgggctctgtaggggtgggatccgctgagctagaccacttggctccctggcttcagccacctttccaggcgagtgaacggttctgtcttgctggcattccaggcaccactggggtatgaaaaaaaaactcctgcagctagcttggtgtctgcccaaacggctgtccagttttgtgcttgaaacccagggccctggtggtgtaggcacccgagggaatctcctggtctgtgggttgtgaagaccgtgggaaaagtgtagtgcctggaccagagtgcaccattcctcatggcacagtccctcgcggcttcccttggctagtggaggaggttcactaaccacttgtgcttcctgcatgaggcaacaccccaccctgctttggcttgccctccatgggctgtacccgctgtttaaccagatgagctgggtacctcagctggaaatgcagaaatcaccctccttctgcgttgatctcgctgggagctgcagactggagctgttcctattcggccatcttgccacaagctgatgttagtcttttagggcccattagctctcaagccttcctgtacaactgtaagatggccattattattactcccgccagatgccagccggagctttcttgtatctaaacctgtgtttgttttttaaaactcatcaggagagttttttcctccaaagatcatcttaattgaagaactgaattaaaagcatacatgtgccctgtgtctacacttaaaactatccaaaacacaaacctttatacctaaaggaaactgaggcctggatttgctcagataatgctggaattcatacttaaaactctcagacataccctcaagaaattcagaagtaggaaagacagatatttaaacaaatatatgtgaaaatgctctttgaactataaagcaatttacaaaagtgtcatcaattcatcattgttgttatctttatcacagtcaataatattgttgcccaaattagaatggtttaacaaaacattttcttccttgccttagagcaggggtgtccaaacttttgactttcctgggccacattagaagaagaatgtgtcttcggccacacataaaatacgctaacactaataatagatgatgagctaaaaaaaaaaaaaaaaaattcacacccaaaaaaatctcattatgttttaagaaagtttacaaatttgtgttgggccgtattcaaagccatcctgggctgcatgtggcttgcaggccatgggttggacaggcttgccttagacaaacgggaaaatcacatttattttctgcttgtgaaagtaacacttgtttttttaatttaagtttgaaaaattggaactatgtacagatatttttaaaaatcagtatttcataactcaccaaaagataacctgaattttctctactgatatttacgtttatccccctgtatacttaatgttcatagaggttaatatgggacattgattcttcctcagtgggggttttagagaccaacccccactggcctggatgcctgggatggtttgggtgagatcctttcttgagtcaggcatcatttttgacctgtgccctcccctgtgaatttgtggcatccagagaattcttagataaggccgagcaaggcagtactcattccagatattcaggatgtacgtggtccagagctgttgtcttctctgacttgtgtcttgtgtgccttctcctgtaagtgtggttgccttgattagggatattgaggaaagtggagcgagtgtggatattttgctgtagttttcctgaggtgacagatactagtgggtgaagccagggctcaggcagctcagctctcttgtgtgttagcctggcttgctgcttgcaggtatggctgtttattttcatttcacttttctgcattgtagtctcttcctataattaacatggctgaaaagaaaaggttactctaaaagttgtttttaaaaaatacagagcctctcggatttctcagcagcgtttaaatcccagctctgttacttaatgttgatttgtgctcttggataagcttctgagtcagtttcaacagtgaaatggtgataatatctccttctagaattgccctaagcatgagggatataaaatgccatcctcataaaataacactcagaatcattaattatttgttattattggatctgcgtgcatatgaaagaatccggacttttttgtattttgaatcccatgaaagttcagatgtgttaagttgtatggggggaggtgatatattggaaaagttgccttcatgtataacatgtttgcctcataagttgttatgggtgttatacatccttcaaagtgaaagaattcttgaggataggcagcaggggactgactggtatcctatttaaggttgatgggaatccaagagtgatcaagagacctccaaagtggccagtggtccttcacttgtacatgagttagtattttttgatttgtgatcacagccactttctaacaaagcatgttgtttctgctttttcactatcagattggctttgaaagccttcatgaaaacatgccacccagtttctgatttcttcatatcagaatggcttatccagagattttgttttcctttctggcttcatcttggtgaatcagtagttatttttttaacctatattttattttaaaagccctggcactctcagcaaatttcgtgtgacttgggtacctagagaggtagcagagaattgaaattcacttttggactcccttctgtggcctcctctgcttccagtcctttctcatcctgacgtctaccatcatttatcaaaaattcaaaagctagaaaaagtcattctaaagcctggtgttgggtctgcagaaaatgtcccaaatgtctgtccgtaaggagtgcagaatctagtgggaattagataaactagggctttcacaaggctttctgggatatccatgtggaaccttggcctgctctccatttctgtgactctttgatgggcccttaaatctaaacctgtgtttgttttttaaaactcatcaggagagttttttcccccaaggatcatcttaattgaagaactgaattaaaagcatgcatatgccctgtgtctacacttaaaactatccaaacactaccagttgtttaatgaggttgttcctagaccaacagatactttagtgttttgtagagatatgttatttgcaaggctttgtcttctgtaactgcttggccttaaaaacctgcctgtctagaaaggggggcctctgagtagtgtttgataataagaaattgctttcagtactactgcaaacccttttggcagaaacatagaatcaacattctagaaattaagggctgctgttatggtttggggtttgtaaagttgtagttggagcgaggaccaaaaaatgtaaactgggttatcatgagggatttgtttttccaacaaactagatggttgagggttatgtctttcttattatgaggaagaggtttttgcctaataaggtactatatgaaaatgaatgtctttgaatatcttcttagtttttcttttatccttggttcttttttaattaaagaagtatttaattaacaccaactacaatcaagtcactgttctgagtcttctttgtgctcatgttattttaattttaaattaatttttagattttggtaatgtgtgtattgtacagttaaattatatagtgaaagtaattctctgtatcccagccacctggtccccttcagctgcctaatcttcctcaaattctgtactagcttttgcactgtcccagagataatccatgcctatacaagcatccatttgtatgatattctcttgtttcacacaggtagtcctagcaccatgacagaattgtagccctctcagtgaactacacacccttgtattcaagctccgtgtaattcctgcccatattgactgtgcttggccgtgtgactggttttggccaatgggtgttagcaagtgtgatgcaagcagaggtttgataagagcttgcactttgaaatgtgttctagaggagtgcttgctattgtgacactccctctcagtacccagaagcccccagctgtgaggtccccacctagtcataaagagaagccacatggaagagaaccgggtccctgccaacagcctcatctgagcccctagccggcagcaagcatccacttggcagccatgtgatgaatgaactatcttcttggaagtggaactgccagccccattcaggccacccccagtggtgctatgtggagaagagacaagctttccctgccaagccctgtccgaattgaaaaattgtgagctgttgctagtaatgtactaaagttggtttgtcatgtagcaacagataacaaacacatgctatatatatgatattttctgtgccttgcttttgttgctgagcagtatattagatatcagcttatttcattacatacagagtcacatcattcattttaagagctgaataatattccatttatggctgtacagtaattaactagcctcttattgatggacattgatgtttctaatctttctcagcatttaatatctccatggcatgctttgttttgcacatgaacaaatatatttattgggtaaattcttagaagtagagttgctgagtaaaagagtacgtaaatttgtaattttaataggtattgcaaattgccctccagagaggttacactcccactagcaatgtaggaagactgtgccagtgtggttggaatgttacatttctttttaatattttcccatgtattttaaaaaccatatgcatttcttttttgatgaactgtcttcttttttgtttggattgttggcctttttcttttttggaggaactctctgtatttaaagaaattaactcttaatgtatgctatgtgaagcaaatcttttttcccccagttttttatcttttgacttcatttgaataattttttgtccttattgtgtttagttatgtcaaatcttttatagcttttggattttcttggttttgttctggtttgttggtcatatttaggcttttctcactttaagattattgtagatattctcctgtgttttcttctagtgtttttgttatttcttttttacatgttaatctttgatctgcctgaaatgtcttttgacgtagacgtttccaggtaggtgtccgaggtggctagtcatttgtctgttaatattgttataccatgtcatccttactatacagtcatgatgctttagtcaatgatggactgcacatatgacactggtcccatgatattacaatgaaactgaaaaattcctattgcctagtgatctcgcagctgttgtaatgtcatagtaatgcattactcatgtatttttggtgagctggtgtaaaccaacttactgtactgccagtcatataaaaatagagcacatacaattctgtacagtacataatactcgataataaatgactatgttactggtttatgtatttactatactctattgttattttagagtgtactccttctacttataaaaagaaaaagttaactgtaaagtagcctcaggcaggtcctaggaggtatccagaagaaggcattgttattataggagatgacagctccatgcctgttatcgcacctgaagaccttccagtgggagaagatgtagagatggaagacagttatactgatgatcctgaccatgtgtaggccgaggctaatgtatgtgtttgtgtcttagtttttaacaaaaatgcttaaacagtttaaaaataaaaaaattttaaaagcttataggataagtatataaagaaaatatttgataaagctgtccagtgtgtttgtgctttaagctaagtgttattacaaaagagtcgaaagtaaaaaaaaaaaaaattaaacgtttatgaagtaaaaaagttacagcaagctgaggttaattaataaattattattattgtttcagagacagggtcttgttttgtctcccaggctagagtacagtggtgcaatcatagctcactgtaaccttgaactcctgggctcaagcagtcctcctgcctcggcctcccaaagcattgagattacaatgagccactgtctggctatgttgatttattgttgaagaaataaaactattttttataaatttagtgtagcctaagtttacagtgtttataaaatcgacagtagtgcagtgtcctaagtcttcacatctactcaacactcattcaccgactcacccagagcaacttccagtcctgcaagctccattcatgataagtgccccatacaggtgcaccattttttaatcttttatattgtgtttttactgtaccttttctatgttcagatatgtttagatacacaagtacttaccattgtgttacaattgcctacagtattcagtacagtaacatgctgtacaggtgtgtggcctaggagcaacaggctacaccatacagctcaggtgtttggtaggctacatcagctaggtgtgtgtaagtgactctatgatggtcacacaacgatgaagtcacaatgatgactcatttctcagaatgtatcaccatccttaacatcattaaacattcatgtatttactggattcagcaatatcttttgaactgctgtcccccaaattacttaattattcccttttttctcttaggaaatgctacagtgaatatttaaaattctatgtaattattaatcccaaacctttgtggatatagaaatcaacatttatatagtctgcattttacaagttatttaaacatttgtgttgttaagctgctcaaaagccggttggcaaggtctgcattttatgcacaggaaaaaggagaagatcattccatgtaaaggagattcatctgaagacaagcaggattgtgtacaagtagagagaaatgtgcttttttatgatgtatcatgtataaaggcctgttcccaaatttctgaagcacatggaagttctggtgtaaaaagtatatctagttaagacagctgtaggctgggagcctgtgaaaggaagattttgcttgttaatagaatgactgagactacatcatcctgtgtagaaaccagggaataacacttgtactgtgttgtgttaagaaaacaggttctttaattaagtgatgtacctgaaatttcaggtaatgactacagctctcctgaacacccaggagggcggtgacactgagtcacaggcagaactatgaaattccttgtgaaactcaactttctgttcttccagcctttcccctcccgcccctcggctcagccacaggtgctcattaaacctcgcccagggagcatacctccaaagctttttcacaggcatgtggcccacctttggattccgaccctatggtcctgggaagtctgcatttggagcgtgtacctgaagggtgttaagcacatttaacctctgctaagataatcagacagacacccctagaaagagatatagaagtaaggtgttgactattctggggtttgtatttcagcaggacccccaaagtttgagctgaaaggactaagttctgtggggaggtatcagccagaggtggggacctcttttgggatacctgtgccttcccaccgtgagccgctgtgccctctgcctctgctgcaggccagccgtgctgcattccatatgtaaagctgtgtcgtgctttccttctttccctcagaatcctccacgtctgttgtgtgagaacgacatttcactaaggaggacagacagttagcttctgtcagagaagaatgtcagagctctttcattttgtagatgctgcctttagcttgctttctgtgtatgttatgttcttctacccttgggatattttgacaccagtggcattgttttccattttctcagtgccagagaagctgggatgttgtagaaaatatttggtttcaaggttaaaaaatgttatttcttttctttttagatcttatctaagctttctttgcctacccgtgcctgggaaccagcaatgaagaagagttttgcttttgacaatgttggctatgaaggtggtctggatggcctgggcccttcttctcaggtggccaccagcacagtcaggatcttgggcatgacttgccagtcatgtgtgaagtccattgaggacaggatttccaatttgaaaggcatcatcagcatgaaggtttccctggaacaaggcagtgccactgtgaaatatgtgccatcggttgtgtgcctgcaacaggtttgccatcaaattggggacatgggcttcgaggccagcattgcagaaggaaaggcagcctcctggccctcaaggtccttgcctgcccaggaggctgtggtcaagctccgggtggagggcatgacctgccagtcctgtgtcagctccattgaaggcaaggtccggaaactgcaaggagtagtgagagtcaaagtctcactcagcaaccaagaggccgtcatcacttatcagccttatctcattcagcccgaagacctcagggaccatgtaaatgacatgggatttgaagctgccatcaagagcaaagtggctcccttaagcctgggaccaattgatattgagcggttacaaagcactaacccaaagagacctttatcttctgctaaccagaattttaataattctgagaccttggggcaccaaggaagccatgtggtcaccctccaactgagaatagatggaatgcattgtaagtcttgcgtcttgaatattgaagaaaatattggccagctcctaggggttcaaagtattcaagtgtccttggagaacaaaactgcccaagtaaagtatgacccttcttgtaccagcccagtggctctgcagagggctatcgaggcacttccacctgggaattttaaagtttctcttcctgatggagccgaagggagtgggacagatcacaggtcttccagttctcattcccctggctccccaccgagaaaccaggtccagggcacatgcagtaccactctgattgccattgccggcatgacctgtgcatcctgtgtccattccattgaaggcatgatctcccaactggaaggggtgcagcaaatatcggtgtctttggccgaagggactgcaacagttctttataatccctctgtaattagcccagaagaactcagagctgctatagaagacatgggatttgaggcttcagtcgtttctggtacgtagtgtgtttgaggcatgtcctgagcttgtctccttttctctttgtgtcttatagctcctggatggtggtataggtgagccctgctccctgcctcccatgtcaacagtggaacaaaatcctgcaaactttccttgcatgttaaatttgttaagatagaggaaatataatctccaagtgtctagattttgcttttcatgtagttgggattttgtattagtctgttttgtgttgcttataacagaatggctgaatttgggtaatttataaagatatggaatttgtttcttatagttactgagaagtctaaggttgagggccacatctggtgagagccttctgccagtggggactccggtgccacagggcatcacatggcaggggtgctgagcatgctcacgtggttgcttaggtggctcttcctctttttagaaagcctcgatgccacacctgtgataacccattaatccatgagtggattccattcatgagggtagaaccctcatgatccagtcacttcttaaagccctcaccttttaacactgccacattggggattatgtttccaacacatgaaatttgggggacacagtcaaaccatggctgacttgaatgcgaacctccttggatttgggcttcttttctggagagaattctgattctgtatcctgaaatagagcactgtgggaccatccaggcccttttcttaccaagagaactattatcaccttctcaaaagattttactgctaaacaacagaaccttagtctcatcacctagagaccatgctggtaaaaatgagagttaaggaaaggatttataaatgatttttttctccctgtttgatgaatataagagaagaggtaaaggtgagggagccaccaggcttttatattttttaattaaaaaattttttaatttttttagggacacggtcttgccctgttgtccaagatggaggatagtgacatgatcataggtcactgcatccttgaacctttgggctcaggtgatcctcgcacctcagcctcctgagtagctgggactacaggtgtgcaccaccacaccgggctcattttttatttttatttttttgtagagacggagtgttgctgtgtttcccaggctggtcttgaactcttggcctctagcaatcctcccgcctcagcctcccaaagtgctgggattgcaggcgtgagccactatgctcagccaccatcatgggttttaatcagaggaagcacgaagtcagattatattttagaagactggtgtggtgtcacagtacagtgtccatggaggcaatgagaccacgtaggaggccgggtgagaaagaggtgggtttgaaagacattcaggagggcagctccaccaagcttggggtcaccaagaggggtgtgtgatggggagggccatggaggaaaggggtaactgggatgagcctttagctgagatgctggaggacagtgggatagaagggccttgaattttgagggagagtgtggggccggaaatgcagagtgtgggaagatgacagagacctagaaagagtgattgtgagatgggaaagaattagagggaggaggaggggtctcctagtcaccctggacataatgcgagccgcagaggccaaggtctgaatcgtatcttcgcgggttaactaggggaggccattggaggcctcggcagctgcttcaggaccctgggaaggtgggagcccagcttggctgctggtaagggtggagaccactagtagcttagattagggataaagaggatgataggtgagtggagatggttgagagaaatgctgaagataaggagggaaggggcacatgttgtgaggggcagctgtgtgggtggtgtgttgtaaccgattaggtcccagacatgggccctgcccgtgcgtgtctctgtggactggaccaggacatggctggcttcctcagccttttggctggagctcggtactgtagggagcagcgggcccaacactaagaagagctgctttcagtggcgtgggcaagcccactggcagctcagtgctcagggatggctgaactttggtttcccacatcatttcctgtggtcactgagataaagtttgtgtccttgaaaagttcactcagctgtgagtctttgctgcctcccctctgtgcccacagcacacacctactgctgaagggagtgggcattcatgtggagtggcctggccccattttgtgctttgtcttttgtatcaagtttcaggaaggagtttctttaaaacaaaaatcaataaggaaaacacaatagaacagtaaatcctgtacgcaataggtaagaaatatagtataaggtaaacatctgcctgtttttgtgtgatgtttaaagtctttcaaccgtgcaatcaggttattagtggtaaaaagaaattagcactgaacttacatattacagaataattggatttgattaaataaacctagaaagaaaagaatagtgatttttttaattgggcaggattatgagaattttatttagccgaagaggtatttagggtatcagacttagcaaataaaaatataggacatctacttaaattttaatttttcataaacaatgaatggttttttagtataaacatgtccagctcaatattcatgacatatgtatagtaaaaattatttgttgtttgtctgagaatcaaatttaactggatgtcctgtattttacctggcaactttaatttggaataaaccattagtgtgccagtttgtatttgaagagcccttcttgattgattaggagctccttgaggacagccttgcggccagcgtgatttgtttctccttggactcaatagcaccccgcatgcagtaagtattcctgaaggaaatgaaagataaggtgaagttacggggtagctcagtggaaggatttaatatagagaactatttacaaaggtattagagagctggaaatccaaataggcaatgggaagaaccccagagattaacaacagcagggagctctgtcctccaggatggctgagggacaaggtagttactggagcccaggggctgaggctgctcggtgggagccgggacaatgaaccctcaccaagagccctgaaacctcttgttctgaaaaacatattatttgctcttctaatttgaatattttctgacattttatcctagaaagctgttctactaaccctcttggaaaccacagtgctgggaattccatggtgcaaactacagatggtacacctacatctgtgcaggaagtggctccccacactgggaggctccctgcaaaccatgccccggacatcttggcaaagtccccacaatcaaccagagcagtggcaccgcagaagtgcttcttacagatcaaaggcatgacctgtgcatcctgtgtgtctaacatagaaaggaatctgcagaaagaagctggtaagagatgaacgcccatgttgaacttaggaatgctgcgtatagacctcgtattctcccttcagaatacccagcaactgtgtttatcagtagccctgataaccaggtagcaagttcattatatagcataaatgtttgtctaatgtccttgtataactggcattgtgttctttaagaagtatttagtttgagataaaatatatctctgagtaagttagccattgaaaatccagtttaaaggtcatagtaccttttgtggatagacttctcagttaggttgtactagtattattccatattttgttccctcccatcccatcaaccccttactataaaatgaataaataacctgcattttgtatagaagttccaatttcaaatattctttcttgttgttcctgtaaaccagagagtgtttgtaggaacaacaggacagaaatatgtggaaatgtcaaagttttgtcctccagaatgcatttccaatacttttaaacctgaaagtacaataaaattcggatccatttatttgtttggaaaatctcttaaccatgactctaccttgccaccagaatcactttctcttttcttaccccagtgatgtgtctttttacttgaactccctggcccttagaatcagccctgaattcagatgacatgtttttccagcctcttgttcactatgcattatagcttcctgcagctctagagtgactgttagcagatggaggtgttaataggagatcccttgttatccatggtctgactgctcataaaattagcctataatctcctatagcctatgtttctgttcctgacttgaatcctcatttttatcctatgtggcatcctttctgaagcacttccttcctttcatttatttgaacgaggctttttttcccatgtaaaactaacacaatagtgttagcaagattgtgggatttctttttcatacctgaaagtcattagaaactataaaagagtaaggaaaaccacttttgaaaattctttattttttccttgtatgaaagtatctggagaaaaggagaaaaaaaaaaaaggatatccttccggtaacagcagtcaataactgcagaccacattccttatttcattggtgtcttctaaagcctgagtgagaatgtgtccatgggcaggcagcatgagcatcacctgggagctggatggacctgcagactctcaaacctcatcctagaccgactagtcagaagctctattttaacaaggtcctcgggtgattcatatgtccattaaagtttgagaagcattgttcttctagaatagtggttgtcagacttccctgtacattaggatcacctggggagctttttttttttaaaaaaaaatgatgccttgggaggccaaggcgagcggatcacaaggtcaggagttcaagaccagcttgaccaacatggtgaaaccccatctctactaaaaatacaaaaattagctgggcatggtggcacgcacctgtaaccccagctactcaggaggctgaggcaggagaatcacttgaaccctggaggcagaggttgcagtgagccgagatcatgctactgtacccagcctgggcaacagagtgagattccatctcaaaaaaaaaaaaaaaagaaaaaagaaaaaaagatgcctgccacctaccctgggatactctgatttggttggtctgggtaagagaccagacatcgtgattgtcgaaggctttccaagcaagcctcatgtgcagcctcattttcaaacagtgtttgaaaactgctgttctagaggattctgggaagatgtgtttctttgttcggttatattgactgtgtcaacctagaggccctgcccacccagagtgttacagccatgacctgatggttccaggtgttctctccgtgttggttgccttgatggcaggaaaggcagagatcaagtatgacccagaggtcatccagcccctcgagatagctcagttcatccaggacctgggttttgaggcagcagtcatggaggactacgcaggctccgatggcaacattgagctgacagtaagtactgtgggtgcgttacggggttacaggcttctgacagtttgcattttggacacatccatctttgtgattagtaaatttccccatcttggacgtgtctggtttgttgttgttgggtattttgtttgtttcactttcctttgaagccgacaacaatgacttgttcattttaagaaaggtcagttacgttaaacagtcatggggaggatcccactgagagtattcagggtgttaggaggaagagatggtgagctgcaggagtatagaagaaacaggaattaaagacggtggactgccctgagctgggtggttagggggagttgaacatgaacacagtccttcaagcctaaaaagaagctagcatgcctgcaactatctcaaggcagaagagggaagtccatgtggtagaaagtgccattctaagagaaaagggcttgtgataggtgcatgggtgtctagagggccaaagtgctccacaacactcagtctgaggggaatgctccaggtagtgattgttgccagtgttttgggtggggaggtattatttcccatctgtctacgtgccaacacattattgaaaacaatggatgtgtctgatgcctagaacatgctatgtttgaaagcacttctgtactttttgtacagctctttttgtgtaagcaaagggagacttagaagaactcacagagaattgaatgatgctgctttacccaggccagagggtttctacttcctttgtgtgttttgtcagtgccattagtggtaactggatgtttgaggggaaagcactgaggacacagaggcccatgagctcctgataagccgtgttctttgtggagcaaaccctttgctgtggtagggcctccctgtgtctggagggcatagctgatacttgctgggacacagctttggtcagccccacaagaggtgcccaacaagaggggcagggtctctgctgcaaacctctggatctacatgtggacatctctgcctgctcagacttctatgtggaaaatctaaagcaagaggattattggaaaaggtgtacatttcttttaaacaatttttttattgtagtgttcttttttcttttagcacacatttattaaacaaagggataatcctaattaatccaacacactttgaaataactgcatgtaaaatgtttgtgataaagataattgaacacagtaatgaaaaaaaaaagaaagaaacagtatggagatttgctcattgaactgagcttggtcattctcttagttaactcctgtccaaagtgatgatggaatttttattctactttttcatagatccgagtacaggtgacattgttcatgacacactccaccactaatttcccatctttcaattttcttgttattgtgctttccttcccatcccactcctgatgctgaaccaatgcaccatctgtaaagttgcagacagtctgtgtttttctgccatcagctgtggtttcttcaaactcatctcccagggtacaagaaaactgtgttgttttcaaagtgctctcggtttttgtggtgaggtttctgccatcacaagtgatgatacaatctggcttggccattgcgcccattttttgcaaagctattcccactcctagctccttcatgtattcatcaaagcctttgctgtccagcaggcgccatcttccttccagctgctgaactgtggccatggtgggtgcgggcgggctggcgtgcagagcagggtctacgtcggcatggcagcatgctgtgtctgtagtgttctttttttaaaaaaaccatgctgtatcaatagttgcattgtcatcacatattcagattttatgtgaatttctgcatttaactagtcttctaggaagtgctgaccactgatactcagaagagtgaattgtctgtttgcttcatatttgcctaatacatatcccaggaatagcacgtcacacttaagacttccctttcccatgtcaggatacacaacatggtacggcacaagcggtgtaggctttaaaaaccgggtttgagttttggccctgtcgctgcagggatacttctgaacctggtctgagaagactcacctcatgctgcagatggcagtggctcagagcagattctggagccagcccatctggggacgtgcttcagctctacccgtcactagttgcgcgactttggacaagttcctaaacctctcagtactgcggttttgagacttacctcttaggtttggtgtgagtagcacaatgcctaggacagcaccagccatgttgcaagtgcaaagtaaatgctacctgttattgttgttgttataaaaacaaaaggagagcagagaagtaccattgaaatatttggatacttgatttttaaaattctgttggcagtcacctgccaacagataagctcctaagttttcctggtggtccttgcagtcccattttttccttgggtcttgggccaagttgaatgcattctgattgcagatgagctcccctcttcttcctccctaattccagatgggacccttggctctttttgtatttattctgggatcactgatgcgaatttcagcatgcagctccagtcacatcattccactgctcattacccctcagtgacttcgcatcaggtgctagcttagcaacactttagctggctgcttgagagccttcaggctgtggacccatccagccctgcagccttccctcctctccctcgagcatcctgtgtccagagaagcctggcttttgatgtttgcctgaatacatcatgctatcctgcctgtcgtctttttcgagcttctccttctggtagtgtccttcccttcacttgtcaatagcctatttgtaccttgggaccacctttgattacatctcctgcatcagccacttttctcctgttaataagaggtattaacatcattacccttggagccagcagagcactaaaatagggaggatgctagcagcagctgcagaccgcatgccagcaacactcaggattacggagagtatttcaggagtgcagcgagtttcacagaagtgcacaaccccgtacaggcattagtatcccggctttgccagtgaggtaacagacagtggagaggggcttataaaagcccatctgtatcagagccggaagtcaagccttggtctgttgccatctgcttcacgattggctgtctcttgtacctgttttggggaagagctactctttagtccctgaagccgctggaggaacgttgagaatctcacatgcggggtttggaggtggagtccagggtcttgagagcagtgctgaggagggaaaggctcttggctgcctgttacctagactccctggactggctttcacaggctttccttgatcctgggtctgtgggattcttgccatcctgtgttgcagatcacagggatgacctgcgcgtcctgtgtccacaacatagagtccaaactcacgaggacaaatggcatcacttatgcctccgttgcccttgccaccagcaaagcccttgttaagtttgacccggaaattatcggtccacgggatattatcaaaattattgaggtaagtaattcattaaaaaattgtagtcacctttttaaaaacagtaatatataatcagtgaagaaaaatgagaaaatatagctaagaaaaaatgaaaataaccaaaattcttcaacttttcccatggaaataagctcagtcattttaaaataaactgcaggtaagtaaataataaataatctgagggaggatatcagtgaatgggtaagagaaagatgaggaaaagacattattattgttttaattttagatattccctaagaaacatcaatattgtcaagataccctgtacatagggttaaagtgcctaattgtaatttttaagtgtgatctttgcccaaacgaagtatctgtagagcaaaggaacgttggccttggaaaaaatgatccacattttgccactatgccaggccactcttgttgtggagagcttggccgcttctgctttggaaaatccgtgagaattttcatgcgtgccctgcctcttactcccttcccagtttgtccacagacatgctatttcctttttacattttatacaatactaggctataagagaatgagcatcagtggtgatctgaatgggttaaggcagtcaaaactgaaaaagattaacttgtaacagctagtaaggataaattaagtttagtgggaactacatgttataaaatcgcttatgaaatgaagcctcttatagcaggcttaatgtagtatcctgaatttcctcttcattgtgtgtgtgtgtgtgtgtgtgtgtgtgtgtttaaagagagatgctgtctgttatgtggcctgggaaagctttttttttctttctttttttgacagagtctcattctgtcgcccaggctggagtgcagtggcatgattttggctcactgcaacctccgcctcccaggtcaagagattctcctaccttagtctccccagtagctgggactacaggcgtgcaccgccatgcctggctaatttttgtatttttacttgagatggtgtttcgccatgttggccaggccggtctcaaactcctgacaccttaggtgatccacctgcctgggcttcccaaagtgctaggattacagatgtgagccactgtgcccggccttggagagtttttttttttttttttttttttgagacgtggtctcgctcttgtcccccaggctggagtgtgatggcatgatctcggctcactgcaacctccgcctcctgggatcaagcgattctcctgcctcggttccccgagtagttgggattacaggcacctgccaccatgcctggctaatttttgtatttttggtagagacagggtttcatcatgttttccaggctggtctagaactcctgacgtcaggtgatccacctgcctcagcctcccaaagtggtgggattacaggcatgagccaccgtgcctagccccgggaaagctttttgacatggaaatgatcatgctgctgatggtccagggccccacccttggaggcagacagcatagcttttttatcagctgaggaaagatgctcagagaggttaagtaactttactcacaatacccagctcacggacagcagaactggtgttcaaacccaggtcttgtgcttccgagctcagtggcctttgtgagtctagtacaccacaaatcttaaagaacagtagtgatatggcattgatgaggctcagacatcagactgatgcagtcaacagcaaggagagtcccatgtggtgcttttgaacacaacttagtcaccatttctgatttctttctttctttttttttttgagttggtgttttgctcttgttgcccaggctggagtgcagtggcatggtctcagctcactgcaagctctgcctcccgggttcaagcaattctcctgcctcagcctcccgagtagctgggattacaggtatgcaccaccacgcctggctaatttttgtatttttagtagagatggggtttcgccatgtttgtcaggctggtctcgaactcctgacctcaggtgatccacctgcctcggcctcccaaagtgctgggattacaggtgtgagccactgtgcccagccaaccctttttgatttctgatacctcacttgcttctatgctacccagcctgctaagtgtggtgtggcatccatgctgaccttatttggggactattgctaatgtctgtcctccattcttgcatctctgggccattttttgctaatataattaggctggtattacttgtaaaaggatttgtctttagacagtctcagctgctcttcctcccaccccaacttttaatttttgtgtaaaagtcccagcaccagagttctggggcccttctcttaattgtgctaccagacaagagcattcgtggcagtttttcctgtgtgtattcataaagagtatcagagatatagtggtcagatgaacgtggtaacaaagcgcttgagttaaactgtgagcaaagcacaagattgcggtgtaggctctgttggggcacagtggaagctgtgcttccaaatgctgaaggagccgagttctgccgcagtggcaagaagcctgggctggaagctggaggctggagctctgagtccagctcttctgagaagggtggggctttgggcaaggtatttatcctctccgaccttctgtttcctcatacatggaatgaagatttctgaccattaggtatctgggattccttcactcaaaaatgctgagtttaaattataagtcagcactgctcagctttggagtctggggaagctgtcttcccagaagtgctgaacttctgcacagggtttgtagggctattgggtaaagaagttgtaagcagaaaacccacaaagtctactgaggcacttttagattcactttctaatttccaaagctgaaaagtgctttctgccaatgcatattttaaccaagtaccttcctcctttttccccacccctctctttttaatgacaaggaaattggctttcatgcttccctggcccagagaaaccccaacgctcatcacttggaccacaagatggaaataaagcagtaggtagaacacaaaagataaactccagctctcatctaagtcccttcctctacctgggcccaactctgccagctggtcttgtcttcccatggtgccttcctcctggattagctgcctttacccttgtaatgtgaaccctctgaaacagtgctgtccaaaagaagttctggaatgatggcagtgttctgtatctgcactgcccagtgtgatagccgctagtcacatgtagctagtgagcacttcaaatgcagctagtgtgactgtggaaatgaatttttaatttttaaggaatttcaatttagctacctttagctaacagattggacagcacttaagttgggagggagggagagagtgtagattttttttcctttgacaatgttttcagactttatttgcatgggttctagaactagaatttgaaggcaggcataatggctgagtggaaagaaaatggcccaggcgcgggagacctgagatcattcattatttcagatggccagttactcattcagcaccataaaggctgctgttgtgtgcagggcagtgtgctaggtgctggggataaatactttccctgtctcggaggggcccatagtctggctgagaaagagtgagtgagcaatgaaatcaatggctctggcagattctggaaggtctaggaaaactccaagcaggggacataagatctgagcctcaaagaatgagtggaagtttgcttggctgaaggaattggtggcggctacccttggggactgctgtggcttggttcagtaggcatgcctggggcacaggaggagcttacgggagaggcatctgaacagccagttgggggtctggttcttgggtagcagtccaacagcctaagacttcagcctcaaaggccagtggttttcatgtcatgttttaggtgcatttgaggttccacaaccactcggttggaatttcatggatgctgcagctaacatgagaccacagctgtcagccatgacccccgattccaaactatggtgttcattgagacagccagtgatcactgttctcatggactctattttaaataattgtttaaagatagaatgtataagtttatactaataaaatactgcttttatctatttttttctttgggggtctgtataagattgcattttgaaaagaaagctataggcaaccataggccgaggatggtaggcacctttggggctagattctcagctttggggcctcacttgcctcacccgtaaattggaggtaaccacagtatgtgaaggcaggggctgggcctcaacatctttggaacctccttatagtgatgtttagacctctagatgctccctcagatggccagtgtcagagagagagagttcttactttcattttaacccctggtggtctgtcccagacatgtgacaaaggcaggtcttaaactgtgtcctcagaaggggagtggcttgtaatccaggtgacaagcagcatctgatatatctgtgttgctgcatttgctttccaggtggaagaagtctttcctgtgcagcctggtgtttggcatccctgtcatggccttaatgatctatatgctgatacccagcaacgagccccaccagtccatggtcctggaccacaacatcattccaggactgtccattctaaatctcatcttctttatcttgtgtacctttgtccaggtatatatgagaaagtgggcagacctctcccttccatgctgtgtgtggccctcagatattctgcccgctaagcgcaaacatagtgctttagcttggtttaaatggcactttattgcagctttcctgccccacccaggcagttgctgctttttttctctcttaatgaccagtaggtggggcttggggcccccccagtgtgggggactactaagggcctggtttcactgtcagtttcagttgattgcaagtgatcagaactggccctggaatagcaacctccttgctgcaaggtgtggtgaactctgtgtctccaatgtgcatattgtttaggttaatttacgtttgttgctggaagcaacaactggatcacccttgagcccatgccactcttgagtgttctatcttaaaaggtggagatatggtccttgtctttcaggaagttataatttaaaagagaaaggcatgaaacgtctgctttggtggtgatattaaggaactagctgtgtgtctggtgggaagtgtgccctctatgtgtatattttggaatataaaactaaatccctgtcctaatattggaatgtttaggggctatttgggggcaagcattggtaggctggatttttttttttttttttttttgagacagggtctcaccctgtcacccaggctggagttcagtgatgtgatcatagttcactgtagtcttgaactcctgggctcaagcgatcctcccacctcagcctcctgagtagctaggaccacaagcgcctgccaccatgcctggctagatagggtcttgctatgtgcccaggttggtctcaaactcctggccttcaacagtcctccaagctcagtctcccaaagctctgagatgacaggtgtgagccactgcacccagcctgaatttgtgtttttctatattttgtttgattataagtgtaatgtacacttattattaacaattcaaaccgtactgaagtataagaagaaaagaggaagatgccctttcactgatcacattctgcctcccgcccaatctcattccccagtgttgctatggtgatattaatagttgggcattaatctctccaaatctttatatagagaaaatgcacacttgcgtgtatgtgtatgtatatgttcacgtaatacagatacagacttttttaactgaaatgggatcatacaagatagactgatgtgcagctggctttttcacttaactatgtattagacatcttttatgccagtgggttatagatagagcccattctctttagggaatggaatgccttgtgctgtctacagtacaaatgagtcgtgatttttttccccaacttttcaccattctcttattagaggacatttgtgttgtaagcactgggttttaaaggtctcacatgctcttggtcatccattcctgtggacagtagtcctctgaatgggaaagtatatttcataaacgcccatcacagaggaagaagtactgtcacgactgtgcacaaagctagaggctttgccatccccagggcccttggccctgtgtcgctcattgaactctcctccctacttgctggcagccttcactgtccttgtctttcagctcctcggtgggtggtacttctacgttcaggcctacaaatctctgagacacaggtcagccaacatggacgtgctcatcgtcctggccacaagcattgcttatgtttattctctggtcatcctggtggttgctgtggctgagaaggcggagaggagccctgtgacattcttcgacacgccccccatgctctttgtgttcattgccctgggccggtggctggaacacttggcaaaggtaacagcagcttcaggttcagaaaagagctgctccttcagtaaacaaatctcacttcctctgaacaccatgtttagaattactaattatacacagcatagagacagacttaaagaaataggaaacctccatataattaaggtgctctagtcactaatctccaaattggtcactacttctgaaatcccagctaatctggttaattattaaaaccatcattcaggtgtattgtgtaaactaaagaaacctggccttcagggcagagcctacattgtctcttggtgcaaaactgaatatgtagttggtctagacatccatacatcctcctcaaggtcatgccatttttaacacccttcattgtccccaacactgaaatgtatcttacaagagaatggaactcaggccctaaaagaaattagattgaacctaaaagaaaatggtcagtgggaagactgatgtttgtttccagtctgaaatgtaattcccggactttagtggcacaggcactgtgcatcactgtggaagtgacatgtggccatgtgtggtggatagcaagtaacgcccacctgcagagccttttatcgtgccgtgcggctgtttctctcgcaccagctgtctctaacaccacgcttgtgactctcaggctgggtttggacaggtctgctttcgatagctctcatttcacattctggttatttcctagagcaaaacctcagaagccctggctaaactcatgtctctccaagccacagaagccaccgttgtgacccttggtgaggacaatttaatcatcaggtgagttatggttatcaaatgtctttgtggttggtatctatcaatctgtgtgagctgcatcagatgcccatgttgtattgacattgcaatagaccttgtgagtgtgggcagagacacagtaagatcaccactctcaatccagctacgaaagcaaggcattgaactataaaactagcaagatttgtaggtggtgtgtgtgtgcgaaatggcacatgggaggtgtagatgattagtattccaggaattaagaagaggaaggccagtgttggtcaagggaaacttcacagagaacatagagtatgaattaggccttcctagtaagatacacattcagacaggcagagagataaggacttcaacttgctaaagaataaaaattgaaggagaaatttatcttcttcttaaggttgcctgatattaaaaataataattattattattcctggaaactcttgttgcatttattgtttgctagacactattctaatctctttgtatttaatctaaccaaagatggaaactttctgaggcagggactattattactcttaatttacagatgaggaagctgaggttcagagaggctaagcaactggcccaaggtcacacaggtattcagtaatggaattgggatgtaacccaggctggtggatccagagtctattttcttaacctttacacacactgactcttaatgcatatttaataatatggaaatttttctaattaaggcttctgtatttccttggggttagcttcttttttatattctaggcaatggttatttcagccctccttcatattcctaaaatctctccctggtcccaccacattttctattagcctgtggtctcgctttggactactggaaggagaagtgttcagatggaaaccctccagttccctgtccctcagcctacacagctagcctcctccgtggcacctcccgctcctgccccgttggtgggagaggcgtctcctccaatgcctctacccgggaacctttctctgttggttttctcagtggtttttggtgtctctgattcttatcctccgatgtcatgcagactctaaccactcccattttcagaggcgttgtgccttgcccctcccttgtgtgcccttgtccatgtatcacactgttgatggagccagcctgccctagctgtgtcctggaggcctgggcgtgaaggctgagacagaccccttgcttccccatggggtctgcagggctggtgcagctggccctgggcacgccccaggtgagtagaggaactgaccggggccacacagatgcatgagtgttcatgaggtgcaggctggctgctgcgcggtggcactggttttgttctggatcctggcttttaaatgatcatcacaattgtaggactggcaactgagatttgagtccttctggtgttccaggctcactccccagcacttgccacagatcgtctagttccactctgtagctgttccgtgaggcagcactgtcatcatcccagctttcctcaggaaaagccaagtgcagtgaggtggagtaatatccccagagtccatggcaggcaggcagcagagctgggattggaaccctggaggcacagagcccccctcagccactgtgctgcgctgcccccaaacaggaccctgtgtgacggcacctggcatgctgggctctgctgtgccatgggtctgcagcagtcacatgccttggcttcttttttttttcttctcttataaattaattgcatgaaagtttctgagaagtgaaaacgttcagacagggagccaagccgctggcagctgtgttggttttgactcatgtttcctccaactcgccttgctagggtcttcggtacagtttgaggcgcctctgatggcactgactgcagttgcttggaactattccagggatctgaacaggaggagaaggcatctgccggccgaagtgcccacggggtgcgtgcagcacctgtcataactcagttcttttccaagaatgccgattcattttttggctggggacgcacggcctgactactaccatgcaacatgacaggacattattaagctaggggccagaagaccagagttcattctgcctttggctcactgtttgggtgtggtcattcctacttgcctcctgacagcacaccccgagcccaaccctctgtcccaggccaaggctgcacccactgccgcctggattgccgcagtctaggcctcccctgagctcaaccattctgtgctttgaggtgcactggacactggtttcccagtgactctgcctcccacagggccctcccgcgtctgggcctctgcttgtgcctttggtccatggcaccatctgaaggcccccagaggttctcgcataactgccctctttgactgaggcttgggcttcttcctctgaccatccctttgctggggacacttgtgctttctctttactccaagtcttgggtgctggcagcgtttctaggtgcgatccgtctggcacactgtagtttccttgctgctgctgctgcttagtctccatgggctttcttctctcctttttccttgtggatggtccttggggttctggtggtactgcctctgtctttgtgtgttacacaccgtcactgggacgtctcactctcccacgtctttggttaacagccgtgagaagctcattctcaaacctacgtctagatcccagagactacctgctggttggagtgtttttcttggttgactggtaaaggctcagactcggcctgtctgtattcttcttcaccttcccccactttttccccaaaaatattccccttccttggtgcctgtctgtctcaggcaaaggtaccctcatgccagctcccagtgtgtcctctacaatgcctgtctgccctcattcacacatctgcagtccatcctcatggttctagcacctctgtctctaggggcgtcatccactggcaccatgctggtccaggccactgtggccttgcccctaaaacaccgcagctgtctcttcatactgcttgcagccatttatcaatccagtatttttccacattcaaaccagtgatcttcctgaaagcacaaattgatcatattacagtgctttctgaaagcacaaattgatcatattggaaaatccttcaatggctgcatgctgtccttaggatcaaaaccaccttcctaacgtggcagtgaggcccggcatccgcctgcatgcctgttgagcccagcctgtcttgccatcccctgcgttgtgctccagctgccctgcaccactggcaggtcccaggaagggactgcctctctctgcagacctctgcacacatccttccttccctctgaactcccttcttccttaacctttgcctggctccttgccttcagggctcagcatggaagttgcatcctccagaagcctttcctgattccccaggcctggctcagctgtggctcctcagtgctctcagaacactctgtgcctcagccaccctgggatgtaaacatggcgggtgctgagatactcactggtggaatgaaactgctgtcagatgttaaagaaacatactgcacacatgcatgtgtgtgcttgatattaaaaggcttgcacagccccatccccagtctcccatgttgaaattttctggtttttttttttttttttacaattgatggggaaacaaattacaaatcatatctagaccagtgaccataatgctataagttttttctttgttttcttaacttgtgtttaatgaggaaggggagtagaagagaggagacaagtgaagtaaacagattcctggcagaaactcttaaagatgaagtgctatgaaacaaaccactgtcttttaattaagagggttcctatcgctcagcacttggagaggaatagtagcttctgaagaatacatgctattgagattcaccagtaggagccacattaaccctcataaaggactattccttgtaagctgcttagagttagaaagatgtggttaatttagatcaaaggagaaattcaaagttagatttaacagagattagcattactaaagatttcttagaaagacacccaactgtacattcgtgccaattttaagtctccttacagaagtggacattttaaaacttagtgattaggttctgctggaggagggtctgacctttagttcttggggtctttcatttctaaattgaatgcagggagctcctcctcccgacttgggcttctcaggccatgtggagacctctgtgggatgataaatcctccaggttgttcagagggggcctcaagggcaatgttcagcctggacttctccatcgctggaggactttaaaattaagcagagaatattcttgggttctcgagatccttccgttctcctggctcactcagccaccaaacagatttacacaggtatactcccagcactaaagacttcagtctttgaaagtctccttttcagtactccatttattttggttgccatgattgaactttctgtgtgtgtcttaactgtccatctgtgtgtctgcttttagttatgaggctataaacctcctgagaggaaggctctactctgtcctgtttgtaaccccagcctaccctggtgcctggtacacaagaggccaatcaatatgaaaatgtcaattaggtgataataaaaatcaccagcattcattgggcacttactgtgtacaggtgccatactaagcatctcacgtaatcacaggaagtagccacacaagccttgaatcctcgtagcacagagactgttcctgaacaatttttacaaaggaaaataatgatgcaaatatttaacatacatgcctgcatatggtagttactaagttttatatagttgtacatagcaacatttaaataagtgggcatgtatgttcaattttgtgcctttctaagacatcttcaggttttgctgaaatgggggtaataagactcaccttgtatgtgtctgggaagattcagtgaggtaaaacatgtaaaaatctagcacagttcctagcactcagtaaatgtctatttctccttctcaagtaagtaagatggcttttgtgcctgtgatagtttaaatgtagtctttgtagaatgaaagcaaggtgtaaaataacctcagagccctgcttgctttccatgcatgctcttctggcttgttgaccattagctcatgagccagtattacctatacaattaattctgttgggcccatgccatgcttttagtgagctgctgctgaagctggccctgggccgtaggtgccctccctctggctttgtctctgttcctgccgtcttctcctctccccccgcagcatctctgtctctgcaggacatgtcccactagcacacagttcacatgtatgtacaagacacaatccccactttaatccaccctcccttctactgctctgtttttctgttccttcacaaaagccttctttaaaaacgtgactttcgctgttgtctttgccttctcactgcgtgctctctcagcccattctagttgagcctctgcctttaccagtttctgaacttggtttggccagtgccatcaagtaatttccatataccccaatccaacattgcttgtgttaagtcctcatttcagtctctcaccagtatttcccccttgtctgtttctttgattttttttcttttttcaatgtgtaactcacagtcactgcaacacacaaaccctacgtgtagagtgtgatgaattttacgtatatttgcccctgtggaactacttgtgcagcgtttggtgtggttggatgggtgctccctcctcctcctcctcatccccactctcattttcctcctgtgtcactggctggtccttcagcttctgctcagctttcagatagtggagtgtctcagggatgagttctaggaccccttctgtgttttctccgtcactcctaggggcgcttatatgatctcatggctttaaatgctatctacatgtgacagctctcaggtttgttctctacctctgacctcttctttccacttcagactcatattttcagctccctagttggcatttctacgtggaagtcaaataggcatctcaaacccgacatgtcaaaatgaaccatttctctccatcccctccccttctcttccctcaccctcccttagctgcttctccataatcatctccatctcattaaatggtttctctatccacccagttgctcaaaatgaaaatttggagctcatctttgattcctttctttaccctcatattcagtgcattttcacatcttgttaacacatgatctaagaatatgctgtgtatttcttctccctctctctgtagtccaggttacttccatcttccgcttgggctgctgcaacagcctgactctccccctcactcctgtgatcatccctacagcccattctcatgcagcagccaaagagatcacttaaatgtgaatcagattgtgtcactttcctgctaaaagccttacatccaaaacccatgctctgctccaggagactcggcatgatctggactctgcctgcttctctgacctcaacttgcacgtcacttacttcctgccagccttgcttgctttcttgctgtttctcagacgcacccttcctgcctgccttaaacctttgtgtcagttgttttctctccgtgaacttcctttccgtgtgtgttggaccttcttggcatgcaggtctcagcttaaatgttaccttcccagagaagcccttccatgtctcctcctccctctgccactctaagaagccctccagtcacattatccttgtttttttcatcacagcacttattaatatttaatacctgattctatcttgcttgttgtccatttctaccacagaacttgtcttcatgaggtagtagggcctttgctgtgccattcacagctgtatcaccagtgcctagaacagtgcctggtattcagcagctgcacgataaatatctgtaaatgaacagatcaaatgaatactgttgctcagtataagcaaatacagtgtaactattgtaacagctggcctagaacctgacccggtgaccgaatgagtggccatgtgagtgataagtggcgtttgttgcagggaggagcaagtccccatggagctggtgcagcggggcgatatcgtcaaggtggtccctgggggaaagtttccagtggatgggaaagtcctggaaggcaataccatggctgatgagtccctcatcacaggtgagatggcttgtttcatgttccctcaggaggatatcatagcagctgtcaggtcacatgagtgctggatggggctgagcaagtgacagttgtctctttcctacgtctaggagaagccatgccagtcactaagaaacccggaagcactgtaattgcggggtctataaatgcacatggctctgtgctcattaaagctacccacgtgggcaatgacaccactttggctcagattgtgaaactggtggaagaggctcagatgtcaaaggtaatgaagaaatttttaaaactaacttcatctttctcgttttagaaattatgtgaagagttctgggaaatcagacagttttattgagtagagattgattagtaaatgtggttaaatgaaggagattatcccaatctttatccatgcttgtggtgttttatttcttcataggttgtaatttcccatggtcttggtgttttattttcataggcacccattcagcagctggctgaccggtttagtggatattttgtcccatttatcatcatcatgtcaactttgacgttggtggtatggattgtaatcggttttatcgattttggtgttgttcagagatactttcctgtaagttgaatgccttgggctatatggtggttgtgttttaaataatctactgacattgatcctgttctttcatatcttagattcactgggctttaattattcattacattttatttgcttgcttctcttattgacagcaaaatctaagccagagtaggataaacagtcactctccttctgcaggtttctattaaagatctcctttacattctacttagataattttcacagacaccaattggtgctcagttgtaatgcttgaagcatttacaatatgtattattggtcctttttgaggttatgaggcatacatcatagaaaatagttcactttaaatctcaatggcatgataatattatttaatacattttaagaaaaatatcttttgatgtatatatttaccagtaccatctttgacctcccagcttcccaagtaatgtaaatagctttttatgtttgtttgtttatttatttatttatttgagatggagtctccctctgtttcccgggctggagtgcagtggcttgatctcggttcactgcaacctccacctcccaggttcaaccagttctcccgtctcagcctcccaagtagctgggactacaggcacacgccaccacacccagctaatttttgtatttttagcagagatggggtttcaccgtattagtcaggctggcttcgaactcctgacctcaggtgatctgcctgtctcggcctcctaaagtgctgggatttcaggtgtgagccactgcacccaggcgtgaatagctttttataatagttaaatatttactaaacattgtatgtgaggcaatggaatatacatttttgagtttaaaaaagtggttgaagaacactatcttaggaaatatggttttattaaacctcagaaaaagaaaggaaaatacaggccacccctcaaaaaaacatatctgcttgaggaataaaagctatattacatctgtgattctcagttggcagctgtgacattttcggtgtttgtgactggggggatgctgctaaacatcctgcaaggcacatcacaggccctacaacaaagagttatctggccccaaatgtcagtagcactgaggttgaaaccttgataatgtacttaaaaagctaatggcacacttagaacagtatttggtaatggcacaatgagcggaacaatgtttttaccttatcttattcctagcccagtctagtgcttgttataccatagagccatagaatgagaaaccatactgggtgtggtgatgcacctgtagactcagctacttgggaggctaaggcagaggatcatttgagtccaggagtttgaggctgtagtgtgctatgatcgtgcctgtgaatagccactgcactccaacctgggcaacgtagcaaaaagtacaaatacagaatggataatttttttcttttaaaaaaaatccttcacataattaaaagtatatcaaatattctcaggacacatgtcatttactaggatgtattttctccctcaaatttcccatcttaaattgaacaatgttcaagttaaacactttctgacatctaaggaacctcagtgctcttaaaagtaacttacagatatattggtagaatgtgcctgtggctatccatggcacctgactgcctataatttcggctttttcgggaaagcagtgcgttggcatatggccatgggaagactcagtcctaaacaagttggaatctgtggctttctgctgttccatgcctttccatcttactttggcttcttttgtttttatctgcaatatcagggaggatgctggcaaatgaggtactgcatgttcctttaagatactgtcatctctctgctgtacaaaagtcattgtagagaagggctcatggtaacttccagaagtccacccagtcctatcagaatgccaggtgtgattttgacaagaattagtgtatttttaaaaaagattacataatctttatgtctaaaaatcttaatatatccctctacctaaatataactgtttctatgaaaattaaaagacccctttaataatacattattttagaatcctgcctttcagagtgaaataataaaatgtagatggaagctaaagaggctgtggtccatagccttaccttagacaactgtgctttttactataagtaagtgaacatagtatctcttgattatactccatagccaccagccatttttaaaaataaaccaagataattcaagctctcagaatgcaaataataccaagtgtctggaaagtaggtcatattttgtttgttttgggtacaaagaaaaaatagtgaaaaatacagagaagaaaataaagatacctccaaatcatatccctagaagtaatttttttgcatattggtggatacctttccagtattgttgaaatgctgtattcagatacaggcggagatttttgcacgaataaatcccagcacatgcgattttgtacttgctttttaattttgcagtgctgctggtacctttccatatcagtatgttccatcatcattccaatagttgcctcgtatcccattatatacatcacacctacagtttaattaaccaattccgtattggttgtttccattttttatcattacaaaaacaaaacaaaacactgtggtaaatatccttgcatcttttcttatttatatgattatcaccttagaatagcatttttaagctttcctaatgatgagaaaaataacgataatagttactgtttcttaaatgccgctcctatgccaggtgttatgtactgtgtatatttatatgtttatatgtgtattgcctcattcaatccttgccacaatttatgagctatgcattatcatctccattttgtgtatgaggaaaccaggatctggatctgtgtggtccatctccagagtctgctttcccctatcaagggcttttatttgactctgctcctgtaatgcctctttgagggaaacctgtaggatgaagttggatagctgggatgtggagagcagtaacgtgttctctatgatggcagagcagtgtggaataccatctgtttccggaacccaagttcgtcacgttgtgtccagtgcccccctgaaatgtccttatgtgattagagttctgggagcttccttattgaactctcaacctgcctctgactctgtcctgttttcagaaccccaacaagcacatctcccagacagaggtgatcatccggtttgctttccagacgtccatcacggtgctgtgcattgcctgcccctgctccctggggctggccacgcccacggctgtcatggtgggcaccggggtggccgcgcagaacggcatcctcatcaagggaggcaagcccctggagatggcgcacaaggtcagcctgtagcacggctttccccatcctgagagatgaaagtagtatctgtttactatttcacattgagagaaaagcctgagagccactcaagacagcagtgttaattacatagaataggaagtcaagtataactgggaataacaacagtagcaacagagtagccaccagtcatataatggaacgctttatcaacattacttgatttaattgcattaacaactctgtgtggtaggtgcttatcattcccattttacagatgaggaaactgcagcaggaggagattaggtaacttgaccaaacgcctgcagctaaccagaggcagagctgggattcacacccaggtagccaggcttcaggacaaaagccccaccgtgacatctgtgggattagtggtgggtcctgtgaccctggggagtgaagagtgagtgacggtgtttgtgaagagtcttccttttgcccaacttactaacctctggccttccacactttcacctatttaatcagtatttgctgggcactcactgcgtgtgagccctgcactgggttctggcgatggtcatggtttccagccgccaaggagcccaccagggggaaagacagacagtgaaaaagtaaatagcaaagctgactgagtattacgagatactgagtattgactggtggtgcttgacgtcctggggacacttgaacaggggccaatcctagacttggggtgctcgactcagggacaagggtgctgcaggtggtcagggaagcgaatacgaacgttcatctgagaccttactgttgagtgagagctggacaacggagctggggaagagtgttccaaaatggggacagaaggtggaaagcacctgtggaggtggaacttcccctccccgcggtatccccagcatctaacctgagacatcaagtgcattcagaagttatctgttgaatgagcaaatgaggaactggaagaaaatcattgagagagaggaaccagagatgaggccgttgagggaggggccagaatccaaaggctgaagatttagtaaagtgttctgaacgttagcctagaagccacgtaggggatggcatacccacgtgatgtgactggatcgtgtgttgggaagatcattccggctgcagtgttaaggttgcgctgaaagctggcaagaatccctggaggaagatgagttaagtgtgttgaaggaaggaaggccaccgctcagcatcagaaacaaaaagctgaattattgtttgcttgtaagggagaaccctgcttgtgggacatggtctgagaagagcaacctgctggccttaaatgggtaaaattatacacttcaggaattactggactttcagaagcagggctcagggctcgactggccctggtcatggaagtgcaggtacctgaatgtagctgctgcccatatctgagcccagaggtgtggggactctgcagactgccattgactaagtgtgaccaacttaaaactggctctgggggtttgtttgtcattatggccatagaatagtcctttcctttcttgaactcagagtgtgaggactctattcccagtagcttttgcacttaggcaggcaaaaggaagctgaggttgggctcggcggatggcagtggacagggaggcaggtgtccctcagggtcctgactcctgacctgatgtgggggagtatgtggatggtgtcactgtctgggggacagtgctgtgccatctcctgtacagccgactgagggtttctggctttgcctggtcaaggtcaagcctcagtgtggctggtttgactggacacatagggaaacagtttctttgcagtgggagttgttgaaccctgagattgaacgacagaggatcacgttaggaagctgtgcaggtgtcttgtttcctgtctgaggcaggttgggtgaagttctgcctcaggagtgtgactatggaagcccctccatctgtattgtggtcagtgagttgtggttgtttttggcagataaagactgtgatgtttgacaagactggcaccattacccatggcgtccccagggtcatgcgggtgctcctgctgggggatgtggccacactgcccctcaggaaggttctggctgtggtggggactgcggaggccagcagtgaacaccccttgggcgtggcagtcaccaaatactgtaaagaggtacgtggacttgggcgtggccctgccctccccgccaatgctcttttattcctcaccatgtccttctctcctagctgccctcgaggagccttctctgtgtggtctggaaaaccacttagagggcccttctgcagcaggcggagatatagggctcacagtcagcccttgccacagttccaggttatcacaaagggagttcagtgtcacaggcatttgctgaacatcaccaggcgccaggctcaggagaacaacaggagtgggatatgaactctaccctttgggagctcacggtcttggggagtacgggcagtctggaaactcagtgctttgacagtgcttagtgcaaggggacacaaacatgaaatgggagtactggggtggaagggagaaatctactcccctgggagcacctgggacagagaggaaccagcagaggtgagccagagtgcccagcaggttcctggcacttcgtggagaagcattgccttcttttggtctctccacaggaaaggttctattttgttttctcttaatttcagtctgaatataggggcagcagaacgcgtcacacagaatattgccctgacaacttttaaacagcctgagcaatactgttagcagtaaatgtagaaaggtgacatcattgccttgaaaaacaattgacaactcttcctgatcaggggctcttccagaaacctcatttctagttttgtccttcatgtagggtcagacagcccactctttctcacctcacccttctgacatttcagggagaatcttgctcaccctcagtcatcctttatttgttgtgtggtctggaaaaccgcttagaagggtcctctgcagcaagtggagatgaggggctcacagtcagcccttgccacagttctaggttgtcataaagtgaggtcggtgtcacagccatttgctgaacatcaccaggcgtcaggctcaggagaacaacagaagtgggatgtgaactctaccctttgggagctcacagcctgggggaggacgggcagtccagaaaccccagccattcctttaccctgccaccttgtcccctcctcctccagggtctgatatacaggcagttatctcttgatagtctcaaagagctttgttaacactacttattccattgtttttaatgaaattatttgcaacataaaattcacatctccctctctttggcatctgcagtcctctttaatttgaggtgtttgatatgagttgcctttttcctttccagtcggtaacctgttcactgtcatgaggcacccacccagggaaggattttaggctgtttaaaatagtctcattcaacttacagctataatatctttaccaaaggagggagaaataattacaagttactagtcactatcttaacctttcctatctgttccacctccctcccctcctttctctcagttcccgctttccgctgctctcttgccaccttcaccctgtgtccctgtcctgcctgcccctccctttcacttcacccctcttggcttacagtttcctcttcctctctttccaccttcccaggaacttggaacagagaccttgggatactgcacggacttccaggcagtgccaggctgtggaattgggtgcaaagtcagcaacgtggaaggcatcctggcccacagtgagcgccctttgagtgcaccggccagtcacctgaatgaggctggcagccttcccgcagaaaaaggtattgctggcttttgtctctgcagctggttaaaagtagaggtgggtcaaaccacagagagcaccacgcccagcagtgattgcctctgctgtgcggcagacggttcatggctaaggcacccaagcctgcctccccacacccaggaaagtttctcttatgttcttgggtgcgtctaaattttgttgcttatggctgccttaaattcatagagcattgtttagctgacccatgattttgattctcctctttcttatcccatatcggtcttgcttctcataagctacagagtagacagacgggaattccactttcgttcttcctgtttccattctgtatggtagaattctggtatttacaaagcaggcagaaaaagtcagggaaagcagagggaaatgtctgcccaagccaggaagggacactgcttggagggacagctgcttttgaagaatggccttttttattctcaaggtagcttgccagccaccagaataaagggtggaaaacactcaaaatctgtgactagtgtttttcctaagtgttggtagtgaaattgtggcttagattgtgtggttagaagccatccaccaccttccagcctttaaaaccccaggatggcctttccatgagagcttccagagcctggccgttcagtgacacctcagctagcagcacacgctgttagaaagtgataggtgagaggtgcattagcctcgggagttacagttttaaacatttcatgtagacgtgtctgattatttgttgattcacctggggttgttgataccaagcagtaatgaatgtagtcaacacttgctttgtgtgctgggcaaatacctgagtgcttctaatccctgcagaaaaagaatcagtggatacttctaagacaaagacggacattgccttatgtttaatacgtttataccatttccacccatgtagcatgtactattaatgccccatcttaattcatacccacatgtcctacacattaattttactttttttttttttgtcctaaaggatgctgtcacaagaggtgcttacaaggttacagtttttcagaatggttaaaaggatattttgctgttaaaaggattgcatggtttttagttcacagtgaaattggaccatttagaaataaccacagcctcttttgaatagatgcagtcccccagaccttctctgtgctgattggaaaccgtgagtggctgaggcgcaacggtttaaccatttctagcgatgtcagtgacgctatgacagaccacgagatgaaaggacagacagccatcctggtggctattgacggtatcttctgcttctgccttccttccgctctctcagaaatacagttttctgcagatatcaggcaaaagagtcctcctttataaaagaaaagaagacaaacaaaagccttcctctcttaatttcaggcctgttttccagaagattgtctttttgtcttttctcttcattctttccactggctccatcttggccccagagcagctctggtctggcctcagtctccttgaccttggaattctaaactgtctgtgtcatcatcattgctcttgtccaggtgggcagttcagagtcatccttctccttcatccctgcagacagagcaggaattcacttcccagcaggtttaactacaggatgcatttaaataatgagatccatgccacccttctctgtctgctttatttatttattattactttctttttcttttttagactgagtttccctcttgtcacccaggctgtagtgcagtggagtggtgtgacttgtctcactacaagctccaccttccgggttcaagcaattctcctgcctcagactcctgagtagctgggattacaggcccccgccaccacgcccagctacattttgtatttttagtagagacggggtttcaccaggctggtctcgaactcctgacctcaggtgatctgcttgccttggcctcccaaagtgctgggattacaggcgtgagccaccgcacctgcccttctatctgctttatacagactggtgtcgcacagagtacaggtctcaagactgtgtgttggccaggtgcggtggctcacgcctgtaatcccagcactttgggaggctgaggtgggtggatcacctgaggtcgggagttcgagaccagtctgaccaacatggagaaaccccgtctctactaaaaataaaaaaattagcggggtgtggtggcgcatgcctctaatcccagctacttgggaggctgaggcaggagaattgcttgaacccgggagttggaggttgtggtgagccaagatcacaccactgccctccagcctgggcaacaagagcgtaactctgtctcaaaaaaaaaaaaaaaaaaaaaaaaaaaaagactgcatgtgttttagtgctcagattctatcctgggctttacatcccagagagattagagtctttactttgttaatgttagtttctgctaatagaagtaacagtatatgcaagcaagaaataaaatacatgacaccttttgaatgctccagccaaatatgtctttctctcacattctctctcttttttccctttttctaagtctttgtaaatccacccgcccctcggctatcaaaccagaattggcacaactaaaggagtcgtgccctctcgtatgtcatcccttactctgttctcattcacacctcagccctaaaagccctcctgcttctatagctaagattcactcaaagagaaattctgccgaaatgttttctgcaggaaaagacgaaggattgattttctagtttggacatttatcactttaagtgatatctgttatgtctcttgaattttagtagctaatgtgtattgaattcttattacaagccaggcacttcgcaaagtgtcatacgtgctccttgcagaaagtttggaaaattcagctataaaggagaaaatgaaatcactcgtaatcctattccttggggagccactgcgaagatttcaattatattgcttccagacttttgtgtacatccgtaaatgcatgtactttttaaaaagcaaaaaaaccacattgtgttatataatttgatgttttgttttttgcacataatattatatgatgagaacattgcaagtgtggtatcttggtgcggggtgccccaacttgtgtagctgctgatgctggctggttcgctccaggtgtgctctgtgggatgatcgcaatcgcagacgctgtcaagcaggaggctgccctggctgtgcacacgctgcagagcatgggtgtggacgtggttctgatcacgggggacaaccggaagacagccagagctattgccacccaggtacagccctttaatgttgcaaactgtgtaaagctcataaaagcagttagagacaaaagtaagcaccagttggcccagcactgagctgtactcctgctctttctcccttgctggatgcttttctctccacgtgtttcattctgtggccatgtagtgttgcacgtgagcactgtggtgctgtgcgaagatctcttccctggagcttgggcgcatgcatcctggaaaaaaaggagttccagggttctctaaccgtttcccagtctttgcaatggaaaaaaaagtatgtgacctaagggctgagatagacattttctaacctttatgttaagggaagattttgccagctcagctcttctcactggggtgctcagataagtgactcctgggcagttctccagcagcccctgatgctgagtttggtctgtgaggacagcaccactggatggctgcctgacttctcacacagcagcggctccagtttggattcctagaaattatgcacctccaaatgtgtgcagagctctaggcttctgaaagcttaattgtgttccttgagggaagcagcagtacccctgttttccatggtcctccttgctaattatggacctgtttagcgtccttccccccttttctggctagcacttgttcatctattcagcaggcacttacgaagcaccacgaatgtgacaggcaggtgtggggccaggctctgtgaggagtgaaggggggtctgcccttgacgggctcatggtcttgcaggaaggtggaccagtgactgtgtagatctgagaagcgggaaagggactaggaaaggaaaactgcaccttcccaggacagagcaggcagcaggagcatttcccaggggcacagagtagcacggcggtttggagatgccgcggggagctgaatggtatggtcaagtgtggcaccagctgccagaccctgggaccctgggactctgggaccctcggaagcagacccaagagttgagctgccctcctctgggagatgcatggggtctactggatgtgaagcaggagagtagggagggacatggccggacggatgctttggaaagaccatgggggcagcacatggagaagacagttggaggactgagccgtggacagggagaccagcaagggggttgtttgcacatccagaaaaggacagggcctaaaccagtgcagggtgttggggcaggagccagggataaactggccctgtgacagcaaacctgcagggtgtggttgaccaacatcactgactggacccagaggccgagggcagagggggcaagggtaacttgaggtttctgctgctatctgataccttttgccaacactaggcattgccttccttttgtcttaggttggcatcaacaaagtctttgcagaggtgctgccttcgcacaaggtggccaaggtccaggagctccagaataaagggaagaaagtcgccatggtgggggatggggtcaatgactccccggccttggcccaggcagacatgggtgtggccattggcaccggcacggatgtggccatcgaggcagccgacgtcgtccttatcagagtgagcgtggctgcagccaggctgtgggtgctgggagggcaatgggcagaccccttcctcactgtgtgctcctctccatcagaatgatttgctggatgtggtggctagcattcacctttccaagaggactgtccgaaggatacgcatcaacctggtcctggcactgatttataacctggttgggatacccattgcagcaggtaggcagctcttacccactgtgctccagctgcgcccagaaaggcttctgtctcccaggttcctgctggggttagtgagtggctcactcactggctggctagaggcgttttagaaaggctgtttttttttttttttcatgtcccctgctttatatgtctttaaatgagaaactgtggagaggacctgaaaccttcattcactctggtcctttctaaaaagctagtggagatgcttggctgtattttctgatccctattttattgtggccttattttctgagccatttgttaagtcatatagtctgagaaataatcattagtaagaattatggggcatctgctacatgctaggcacaattattggtgtttcagaaccttatcctgaacattaatcctgcccaagtttcactctgagttacacaaatgatcatggaaagaaatggctctttgaccaggcatggtggctcatgcctgtaattccagcactttgggaggctgaggcaggagggtcatttgagctcaggggttcaagactcacctgggcaacatggtgagactccatctctacaaaaaattttaaagttagctgggcgtggtagcgtacaccttagtcccatctgggagtacagaggctggggcagaaggatttattgagcccaggagttggaggtggcagtgacccatgatcgcaccactgtactgtagcctgggcaagagtgaaaccctatctcagaaaaaaagaaaaagaaaagaaatagatttttctgctttgtaattccccctcattccccctccttaagaaccatctctcccccgccccctgctccctgccccctgcccccaggaacatggcaatgaaaagttccagagtgctcctccatgggctgaggagagatcaagtttgtaatcacagcattcctgcctcagtctcccttgtgtctgagtggttagtggtgacttgtgtaacagggccttggcttcctgagcccagtgagtcaggcaggtttacttcttgtccccagagccggctcaggagcttaattcccccagtgtatgtgcctctgccacacaaagttgaccatacctgtctcctgaccctgtcctgggacctggctctcattcctcttctaaagatgtcatgaagccctggaggcgagatcatctgctagagaaggactgtggccctcagccgtgtttgtcctctgtgggactgtggctacaggatgggcaactggctccctcagctcctgccgcttttctcctcccgctcctcccactccttgtggtttgtcgctgccctggagctcgccctgaaatgggatgccacctgtgggtggttctgggaacatcagggcgagtggaagagagccaggcccactcaacagcatcccacacccagctttctaggaagcctcactttggggggggcctgtgggcaagatccattggcaggggcttctgagcacgccaggtggagacctcactgggggccgctgagggtggggcagcccggtgcctgaagccctctcctggctcctctccccagacctaggtgtgagtgcgagttctttcttccccaggtgtcttcatgcccatcggcattgtgctgcagccctggatgggctcagcggccatggcagcctcctctgtgtctgtggtgctctcatccctgcagctcaagtggtgagtcccctcaggtggagcatctgtgggaggctcccaggaggccttgtcattctgcatgcttagcacagtggaacttgcctctcatttcccattcattcacctgggacaaatgctgcagtggcagcccacatggagcctggtgtgcatgcatgtaacttatcagcaccatgagcaggcaattcactgctgcccattcacgtgctgggctgcccttactctgctcctcaagggctgtttatgtgaacatcaagcagacatgggtccctgtgtatgatctatcacttttttatttaaaaaagatgttcacttatttatgagtgcattcatttaacaaaagttagtggcagcctacaatgtgcaaggcatttgcttaggaagtttctaaatcaggtgagctttcctggaaccatagggagtttaatgtccttttccttggaaactcttgaggttttgatactgaatgttattaaaagatggatgagaggccttcaccaggcttagaaaaaaaaaaagccttgtttctagaatggctcagatgctgttgcgttcctgctttccagctataagaagcctgacctggagaggtatgaggcacaggcgcatggccacatgaagcccctgacggcatcccaggtcagtgtgcacataggcatggatgacaggtggcgggactcccccagggccacaccatgggaccaggtcagctatgtcagccaggtgtcgctgtcctccctgacgtccgacaagccatctcggcacagcgctgcagcagacgatgatggggacaagtggtctctgctcctgaatggcagggatgaggagcagtacatctgatgacttcaggcaggcgggccggggcagggacttgcctccactcaccacaagctgagcaggacagccagcagcaggatgggctgagctagcctccagctttggggacttccgctccctggatatgtccagtcatcctgccctgcagcacgcggccttgtctgggtgcagctgggcttggcctggagaggacggccctgcctgcctcttggcctcacgggaccgtcagcatgggctttgtcttggactctagtccttggctggactgtagaaggtgagaggcgagtcaccctcctcacagacctctgcttggagtatttaggatgactgctgtgaaatggagaacagtttcatcaggaccaaaaaacctcactgggcctttccagagaactgcagacctcactgtcagggtctttctgatgacgcctgtctgtgtgcatcatgtttctgagaccacagtttacctcaggtgtgcctgttgctttcttcctgcatagtctgttcctttcttcgtacatagtctgttccttttctctcctgtgtgcttgtcagtggggacccctcgcaaccctgcctgtcacctgggagggtgggaccaatgtccttgtggtctttgctgctgctctcaggcgcttctccaatgctctggagtgtgcatttcagcttgaacctgcttcctggctcacacatccccagccagggagcttgccacactcttcttcaagttgaggagagttcttttttgcttaaagcccccttctccatggagtgttggcttctcaatagagtgttgttgctgaccagctggagtgagggcctcagagcctgacctgagagtccgtactcggcttcctgtggggtgtaggttctcgcgattcaggacgtccttccatatccctgcccagcctgtggtgcttgaaacgtttgccccatgggaaacgtatgtgtgcaggagcctccctgcacggcccaaggggcttcgttttcagtcttctgactgtcacctcgtggggttcagtagagaattcatgtgactagcgcctggccttgtgtggcttggaggaaatggtactgcccaaataggaggaaaacacagcctccctgagcctgcattctgcacgctgcccaggggcttcagaaaaggagtggccacagcaccccgaagggagcatctgtttacctggcagtggctctcagagcagcagaacgggttcagttttagactctgaagttggttgtgattgacagaaccctttgggagcaaactagtagagttggattaaattctgggtgaaacccttttctcccacacaaaatagttttagtgatttttttcattgtccattacttgccaggggcagttttagcagcacttttgatagattacgtctaatcctcccaaccaaccagcagggtagctattactgtccacattttacaggcaaggaaacaggctccaagaggctgaggactttgcccaggatgacatagccaatggacaagcagtgtctgtcagctgtgaaggcttcactcttattgtccttctaccttgaatagaagttttcctgataagaataaacgaggaaaaggtccttgcctcctggaagaacaaatctaccaggtgatctattcattgtttcaactcagaatgcacttgattcaggaggtcatctgaccttcaccttggatggttagtttcactttttacatatagtttttgcagggttttattttataaaatccaagcgcgctgttgattgtgttttccttgttttcagcccccccactccagcccgcagcacatttccgctgtccgtcagtaattgtgtcctctctttatgcttgcttggggaatgttgttttctgactaggctgatcattatctaaagaatctaattctgttgatttttaaaacttttaggaccataaacgttgtgttcatatatggacatggaaatatttatataattttatagaaaataaccttttagatggtcaaagtgtaaggagtttttttgtcagataatcatttctacttcaaaaacatttcatgcaatattagaataaagttcctgtcattcctctaaaa

SEQ ID NO: 61525 - DNA, 33692 bp, Homo sapiens
gagaccaaaagtcaggtaggagcctccggggtccctgctgtgtcacccggacaggccgtgggggcgggcaggggggcggggccgggcctgaccacagcggccgagttcagtcctgctctccgcacgccaccttaggcccgcagccgtgccgggtgctcttcagcatgtccttcatcccggtggccgaggattccgacttccccatccacaacctgccctacggcgtcttctcgaccagaggcgacgtgagcagtggggctttggcgtccgggcgcggggagggagtggagtggagtggagtggagtggagtggagtggagtggaatggagtggaatgaggggcgggatggaggcttgtgccatttttctcttaagattcgttccgtgagagtgcctatgggctcgagtcccgcctcgtaactttctagctgtgcacgttgtttaacttttcagcctcattgtccgcaggtttgctgagaattaaatgcaaaatgaaatgaatcgtgtcactctcccagacaagcagagcaagcaggattctgttaccggaagctgcagcacacaggcatgctgcctactccgaggtggttgcggtgtgtttctctcgcccaagaggccaggtcagggctggtggttcatctcgctggatagcccctaaccctagaacccgggaaatgataacccggtatgcgtagcaggtcagaggggcacgcgcgtttcttggcttagagttgtgagatctaagatggcaagtgtctctgcctatagctgaaattctttcagctcctggtgtgggctccctggcattcccctactgatcagaagaaagagggcagggaaacaaactttgactaagtcagtgtagtctgattggtagaaagaagtatttgaaaactgggggtttatcagcaaatagataataagaggttccctaggttggaaaagcagattcccttggatttgttgatgatatttttggcttagatttctgctcccaactttaaaggtaaactcctgattcatctctgtaagccatagaaccccagaatcaggaaatgtttgctaaacgaggggcctggcagttggcttcttcttggaaagtggggttccctccttcccccatggcttgtcattggatgcaagtggctggccttttgtgggcctgtctgcggtaagtgctttggtctagaagagtcaacttgtggtttcacatctggccgggctgaccagatgttgcaaggatacagaaagtggacactcaatcccctggaggacacaatctgaggcacattaaatcttaacttgtgatggccaacaacctttctgcagacagagccctccctctgccctcctcaaacactttgccctcggcagatgtgtcctccctcacctttcctgggagcacaaatccattagacagaaacatttgtgagaggcaggcacaccccagtagggagctctgacttgctttctcaggggaatcgaattaatatccgttagagtgtggctaggtgttttcagacaccatgtcccgctgtttcaacatcagaatgtgcagggcagccactacagatgtctggaagagagagccccattccgctgtcctctgatacagtgctgggggtggagagttggccctttggccttccagctgaacaagcctcttctgaagctttctctgcaggcattggacattccaaccgtgatggctgccttgccaggcaagactagttgccaaggcaaaacctcccttcccccatgtcagcagtcagcctttcctaatttgagtggaataacaatgaatcctgccatcactttattcatttttttttattcagcgaatgcttatgaaccccaactctggtccagattttgcctgggctccgagttggcatcaaagacacaggagacgccttccttccatttctggttgatggactagtaaggtgtacaggggtgctctctgtgaaggtaggggtggtggcctctgagaacggggttgtagtagtgtggagctggttttgccgggtgccttgttaaagtccccgtggtctggctgtgctgctgcctcctggcctctgctttctccagccacattggctgcctttgagtctctgagatgtgctaagagcagcttcctgccttcaggccttagcacatgttgttccttctgcctggaatactcgtccttctgctctctatatgcttggccccttctcactctttgggactcagcttaaatgtcacctcctaagcaccctctctgaatgagctccccgctgcggcccagccttggttatctctcaccacaccctgtgtttccttttgcttctggagagaaggaaccacgtcactgttcccagggcctcagcagcctttgtgtaatgctggtactgagaagatgctctctaaatctttgtggcatgaatagcgtctaccctgtgtctgttcttgtggtgagagatttacagatattaattaaattctcacaataaacctactgtgaagttattgtccccattctacagatgaggaaactgaggtccagagaggcaaagcatcatgctccagatctcacagccagtaagaggcagatatggggttgatccccacatctgtcagcctcccaatctgtaaggtccagccctacggggcttagcgggttttctccctgtgtgcggaaacgagagattgtaagaaataaagacacaagacaaagagataaagagagaacagctgggcccggggcactgctaccactgagacacagagaccggtagtggccccgaatggctgggcacactgatatttattgcacacaagacaaggggggcagggtagggagggtgagtcatccaagtgattgataaggtcaagcaagtcatgtgatcatgggacgggggctcttccctctaaggtagccgaagcagagagggaaggcagcataagtcagcattttcttctatgcacttataagaaagatcaaagactttaagactttcgctatttcttctaccgctatctactacaaacttcaaagaggaaccaggagtacaggaggaacatgaaagtggacaaggagcgtgaccattgaagcacagcaccacagggaggggtttaggcctccagatgactgcgggcaggcctggataatatccagcctcctacaggaagctggtggagcagagtgttccctgactcctccaaggaaagggagactcccttttgcggtctgctaagtaatgggtgccttcccaggcactggcgttaccgcttgaccaaggagcgctcaagcggcccttatgcgggtgtgacagggctcacctcttgccttctaggtcacttctcagaatgtcccttcagtacctgaccctatacccaccggttattcctaggttatattgtactacaataaagagtaatattaaaaactaatgattaataatgtttatactaataatcgataattgtccatgatcatctgtatatctaatttgtattacaactgtatagcagtatagctacagtttatgccttcagtctcttgcctcggcacctgggtaatccttcgcccacaccaatcccatgcttccccctctatgtcaggctgggagttgggtaatgctttcctttggacaactttatatcagatatgaccaactattttaaaacaaaggcaatgcacattcattctcttgaagttagacaaatgcggtctccctccttagtttgtttccctcaagttgcagatgggaaactgaggcccagagacttgtccaaggtgataagatggtgaatgagggagcagacttggagcccaggaatcctggatctgacctgtgagccccctctagttttgtgctgaagaaaataactcccaaggttgaaagtagagggactcactctctcagactttttctgggtcctcaggtcatagtttgaagcacaagtttgaagcttctaggctttgtttgcatttgaggcagcaggcagctgcacttgtgaccccattttggaagttgcttactggtggtgactccttcttgccttcagctggggtgtggggaccagggtcagagatgtggtccaagggtctgccctgcacattccctgaatggaaagccacttggattcaggtggttcagctctttgcctaaagcagatttgccattttcaggaggggaagactgaggcccagggagttggcagtggggctgagaatgagtaactaagctctccaggcagcctcttctagggtaggctctgctgggacctcagatgaggagtatggctctggtctaccccgattccaagagctgacatgcgtggagaaatggtcatcttttctcagcccaccccagtgagcagccaatggagataaggccagccaataatcccaccactaagctcgctggcactgaaatggccaagctggtggttcaggagagctggaagcctggctcaggacagagccctgggaagttgagtctgcaaacatgccctcgggttcttgttgacgagcaaagctcagggttgtggggacaaagaccaggacttaacaaatatttaagacatctttgttgatgctgggattttgtggtacagaaaggaacttgccttgcatgttctgagcagtctggcttcctgcagctcccttacaacccgagctctcctccatttgagctacaacagagctcattaatccaagccacctggccctcagcactgtgtgttgggcactcatgctccaccgcacaactgaactaccctagtcaaggcctagaaacctggaaaataatccaacatcctggtaaggtggtaagctcctcatcactggaggcatttatgtaatgcctagggaactttgcaggggtctttgcccaggttaagtggctaggaccaggctgactgctcttcccccagtccaagggatatttgatttctttcccattcagggaacacagattatttttccttttagttctggaagcagagatggcacaagggagctggggcaggatgctgagaacatggttcttcagtccgctctgcatacagggccacctaaagggggacctgtggactcttcaatagataggctttctgagtaaatgagccaagcccagccaggggctttttctggtgctgacggtgtcgtcttcctcctagccaagaccgaggataggtgtggccattggcgaccagatcctggacctcagcatcatcaagcacctctttactggtcctgtcctctccaaacaccaggatgtcttcaatcaggtaggacattgtgaaacgacttgtccctgacctcagtggcacttactgtggatgccaacaagagaatgctccttgcgttccatttccgatagaggtaatgccatcgaaggtctcagaggttatacttggataaggctggggttgttttgagacagacaaactggtaggaggtggccttgggacaattcagggtggcttctcacctcagggcgagttcctaggtgaaaaaagtgtcagtgtctgcagtcctgggtcgttcctagttgtctatgagatgaagctcttcaggaactctggttacttttcttgtcaagctgtttgagcctctgcctgtccaagggctgtgtgggcccccaagggagggagctacgagcccagccctccagttctgtggaagcagctacggaggagtcagcctgaagtacatgttcacatgggatggacatgaatttgcttccctgtaaatggtcatctactttgatatagcatcttctcattgcatgggtcaggaaggagggtgggatttatgggtacctcttgtgtgccaggagcttcgcacacatcctctccttcaatcctcctgaccaccctctggcataggaattggaattcctatgggggcctgagcatctagatggggacctgaacttctggaatgagacatggttttcccaagctgcacagctagaagtatcagagctgggactggaactctgactcttagaacctacaagggctttttctgctatgcttcactggctataaaacctcttccttttttaaattaaaaaacctctcggctcacgcctgtaaccccagcactttgggaggccgatgtgggcagatcacttgaggtcaggagttcgagaccagcctggccaacatggtgaaaccccctctctactaaaaatacaaaaattagctgggtgtggcagtgcacgcctgtaatcccagctactcgggaggctgaggcaggagaactgcttgaacctgggaagcagaggttgcagtgagccgagatcacatcagtgcactccagcctgggtgacagaatgggaaaaaaaaaaacaactttttttttttaatagagatgaagtctcactatattgcccaggctgatcttgaactcctgggctcaagtgatcctccacctcggcctcccaatgtgctgggattacaggcatgagccatcacacctggcccaaaacctcttcttaactgatgtgaaaggaattagtttaggctgtgatcactctgcagactggagtgtgcctctactggaagaacatggccaccttcaactgtgggccgggccaagcttagcacagttgctgtgccaggtagcaactcctgggcttggacaattgtgtgcaggtgcacgagggcctgaggcaacgtcaagagaggatatgcttttctccaggttgatgaataaatgacaaaactaagagcagaggtcctgagagtttgagttagcgggagagaagtggcaagggctggcaggctggctggccttccattggaaggagggatactccctgggttttcctgtacgtgatcttttttctccctgttttggtcttagcctacactcaacagcttcatgggcctgggtcaggctgcctggaaggaggcgagagtgttcttgcagaacttgctgtctgtgagccaagccaggctcagagatgacaccgaacttcggaagtggtgagaagcacgtggtcataggggggatgaggggatgcagcaggggaggtgaaggctgtgtggttatcagtgccattctgagtcacggcttggcagccttagtgtggccaagtcagacctgccctcatccagcccctgcctgagctgcctattgatgggagggctttgggaggactgggattgccttggcgcctggaatggagctgcccaagctaggccaggccaggcccattggccctctctcttactcaggctgtcctcattagcatcatctgtgacctcatctggtttctagagtaggaaagagtttccacttgtctagtcccatttcctagggtagaatatagaaacggcttcagtgggtggatgtcctctcagctgtgaaaggttcagcatagctctggccccaggccagccagaaggtgcccactggagattgtggataatcttggggatggtctgggctgagcccgtgggtgggaccgcgctttgctgcctacttgactttgaagcccctggttctgtgtttcagtgcattcatctcccaggcttctgccacgatgcaccttccagccaccataggtgagtgcagtctcttcaccaagataagaacggagcagcttcgtgggccaagagggctggccaggtgctttggttctgcatctgtgtggagggtccctgctggtggggggagatggaggaggggctctggggctgttacccgctcctcatcactgacctttcccagcatccaggcccggcattcactcaggctattatcttgcctcaggtagtgagttgcagactgctcaagttcatgactagccgcatggctccctgcacagcaaattgctttccttcccccaaaggctatgggacaaattctctgagctcagtctgtgagtcagcagttttgaggatagaggccagagggctatgaagggccccagtttgagcacgtggcaggatgtctggttggagtgtcattcaggaagttggagctgttgaaactctcaacctgaagcagagagagaggctggctcagcctgcggcccaaagcacagccctcttccttgtgcacaggtctcctctgctgggctacctgggcacctgtgagctgaggggccagttgaccctgcccctggggtacactgcctctctggaacagctcctgctgtccggggagagtcctttgctgctgggctgcttgggctaagctgactggaggatggggttggggacaggggccgagtcacctgcctcctcccagcccctctcactccccactctcatacactcatgggactgtgctatgttttggcaaaccagctgttgtgcaaaccatatgtctttcagggatatcatgtctggttgactgatggtgccctttcttgtttttttttttttttgttatggatttattcttttgaaaaatctctcagctattacttctgtgcaatgggactgaagatgggaagcagcagctaaggctccacctgccctgtggactgttcttcctctcctcacccttcaccatgactgttgctagtctaggctgttggtattgatgaatatccagcattttttttttttgaggagacatttaggaagataaaacaggcagactgtcccaactggtttttctttcagatttttaattctccgaatggtagatatgcctacagcttgctggctagcccattcagttcatcataatcaacaagcactgatatgcatctgcagtgtgcaagcccttgtccttggcactcgggcagagtccaagaaaatgaggactgggctggggctgtcctggaatgtccacagtctagcaaagatgtgcacacacataactggagcaccagtgggaagcgaagcctgccccagaaggattcaggggaggggatttggagggggaagagatcctgctagagagagcagggagggcttcagggaggagcgggcctcaaagagttgccaggatttgaatacacagggacaagggagaagtcaatcagtataggcgtggtgagggagcctgtgggaactcgggaatggcagttgtgtgtgggaaaagtggggagcctgagaagggaggtggtatcagccacttggtgttcacattccactgtcagtttcagaaagtctggactcctgatttcttatttgtttctcagctgagggctctaaaaacaaatcttcagtgaggatattttatattgcatttggtgctgccattgctggctgcaggctgagctctggatgtgtaaacagtattgtgtgcacactcgtggctccagtgcttggaacagtccattcttcctgaggcatgtgggttgctgatgggatctgttgggtctttcctctgcaggagactacacagacttctattcctctcggcagcatgctaccaacgtcggaatcatgttcagggacaaggagaatgcgttgatgccaaattggtatgaactgggccaaatgtctgcataagttcaaagtctttcttttcatttccagcagcatatttgtctcaggagctgccaagttcttcttaaagtaaactggggaggaaaagcagttatgatgttgcaacctctggaagcagtggtctcagcttctggtctcctgctcagcttggcttaggacttgctgtgggatcgaagggcaagtcccttaaacttccttggacagcaggggttggaattagattcccttaatccctatgctccttctggagtctttcatttataagctgtgtattattgtactatgggcaagtcttagactctagcatgctccatacttacattttctgatgaatgagaatcctcaaatgtgcccagtgctgtatattcctcaacatgtgatcggtttcattcatttgtttgatcctcgtagtagttctctgatgtcacaaggccatgattgtaagccccattttacagacaggaaaatgggctcagagaaggatcaacttgcctgagcacaacagggccacagcctgtctcccagcccccagatcaggccattgaccaagctgaggatgcagagctgggatccttgccctttgttctgtgttgtcccctggatgtgatggttccttggaactgaagagggcctggactcagtggcaggcatacactccaggccccagtgccatcagtcacacacaggagctgggttagggacggggctttactctctctcgagtgagtgtctccagtaggctatgccatgaggggagggtctgttagaaccaagatgaggaagaaagaaagggagagagagcagttccaagccagagatgttgaacaacaaggccaaggttgcagaatgaggcaggggtgaatctgagaccagaacccaggctccaggttccaggcttccacgtgagatgcgcaaatatttgagaatcttgcactgtacaggctccaggctgtatttgtccccagccagcttcaacttgtctatctgatgggctgagtgtctatatgagtgtccttggcagtgatgacccagtggactgcccagccccagaagagctggctgtcacctgtgtgccaggatcccagtggccaaagggcaggggcaccaggaagtgagaggagagccgggacctgggaaatgagtgttgactgtgtctgaaaccgagtgtgggggccgcagccatccttgccccatgtccttctgcagaataagagtaaacaggccttctctagccatgtttgatgcaagatggcccacagctgtgactttttagctttatgtacatagtctttattataaaggtaacatatatttactggaattaacccaaacactacagaaaatatgtaaacatttacaattaaaaatgtgtctactctttgacctgcaatgctcactttcatgcatctatcctacagaaataaaagcaccagtgggttgtatccaagagcaaggatgttaattagcagagtttctagtggcccagaactggaagtaatctgaatgcttatcggtggaggaatggttgaaaaattggtctattcacaatatgaaatgttttgcagctagtgaaagatttagatcaagaaagatgtgcactgatctgtgttaagtgaaataggtaaactataggcaattaggtaaagtgtgtctcacttttataaaaaaagcacaaaaaatatatatgtacatacacactgtattagttttctgttgctgctgtaacaaattaccacaaacttggtggcttaaaacacaaatatattctcttctagttccggaggccagaagtcaaaaatcagtctcactggctaaagtcaaggtgtcagcagggctggttccttctggaggctctaggagagaacccatttctttgacttttcagctttagaggttgcctgtatcccttgccttttgaccccttcctcatatcactccaaccacttgcttctgctgttacatttcctacttcctcctttgaccttgcctctgtctataaggacccttgtgattacatttagggttcactcaaataaccagggacagtatccctatctcaagatccctaacttaatcacacctgcaaaactctttttgccatgtaataatatccacaggctccagggattaggatctggatatcttttggagggctatttttcagcttaacacacacacacacacacgcatgtacacatgcacacacacacacttatgcatacattagttccataggccggtatgagcatagagaaaggcaaaaaatattagactccagattaacattgctttcctcaggggagtggccgggtggggagagattactaactcctttttttcatctgaattgtttgaattattacatgccatgtaattgcatgcaatggaattttataatttaatccaataaaggaaccaaggtgggtaaaaaagggagctcttcctcagccactcaccagaggcaactactttgaacaagttggatgtgccgcttcctgtactttgctccaggttacacatgcatgaccacacgtatgcacgcatacatatgcattttatttctttagttaacaaaacgagggcatgctgaaatttgctttttttacttcatcattgacatatctccatgtagataagtttaaatctatctcagtcttttacaaaataagttttttggggtaggtaatacaagacaattacacagtaaaatatcatttttataaaaagatacaaaaatacagtacagtagggctgggcgcggtggctcacatctgtaatcccagcactttgggaggctgaggtgggtggatcacaaggtcaggagtttgagaccagcctggccaatatggtgaaaccctgtctctactaaaaatacaaaaattagcagccaggcgtggtggctcacgcctgtaatcccacaactttgggaggccgagacgggcggatcacctgaggtcaggagtttgagaccagcctggccaacatggtgaaaccctatctctacaaaagtacaaaaatttgctggtcatgatggcgggtgcctgtaatttcagctacttgggaggctgaggcagaagaatcacttgaacctgggaggcggaggttgcagtgagctgaggttgtgccgttgcactccagcctgggtgagagagcgagactccatctcaaaaaaaaaaaaaaaaaattagctgggtgtggtggcgggcgcctgtagtcccggctacttgggaggctgaggcaggagaatcacttgaacctcggaggtggaggttgcagtgagctgagatcacaccactgcactccagcctgggcgacagagcgagactctgtctcaaaccccaccccccaccaaaaaaaaaaaaaggtacagtaataaaagtgtatagaaatatagggaaatgaggaccatgctggtttcctctagggtgaggggcaggaagggagggaaggagagtgagaccagggagggatcccaaggatgcattggactggataagtgaactgttatttctttagctccttggtggtgcatggtgacttgtgttattacatgtttttgtatatcataaatattacaaaataatttatcaaacatttaaaaaattaaaagcaacaaaaacagtcaatatatatatacatggttgagaattcaaaaggtacttaagggtaaacaatgaaaaaaacagaactcaaccacctatgggccaccatccagttcccttctccagagacaaaactgttaatcggtgtcatacatatattttctttttcttttttttttgagactgggtcttacttggtcacccaggctggagtgcagtggcatgaccttggctcactgcagccttgacctcccaggtgaagccatcctcctgcctcagccccctaagtagctgggattaaaggtgcacaccaccatgcctggctaatttttgtattttttgtagagatgggttttcgccatgttgatcaggctggtcgcaaactcctggactcaagtgatcagcccaccttggcctgccttagccccacaaagtgctggggttataggcatgagccaccgtgcccggccttcttatatattttttcacagatgtttttgcatactctgccagtttatatatacagtcatttctctattattagtttacaagagtgttttataagtgatagaaattaaccctttgttgcaatgcattgcaaatattttctcccagtatgttatcttttttctttgtttgccagtctttctagatacagagttttgcattttctttttttttttttttttttgagacagagtcttgctctgtcgccatggctagagtgcagtggcaccatctcggctcactgcaagcttcgcctcccaggttcacgccattctcctgcctcagcctcccgagtagctgggaccacaggtgcctgccaccactcccgcctaattttttgtatttttagtagagacagggtttcacctgttagccaggatggtctcgatctcctgaccttgtgatccacccgcctcggcctcccaaagtgctgggattacaggcctgagccaccgtgcccggcctagagttttgcattttcataaagtcaggcatgccaatcattttccttatggcatttacttttgtgtaatgtttagaaaggctttctccaccccaagaatttggaagttttttgtgtttttgtgttttttttttctagtgcctgtaatagcctttgtttgtacatttagatcttgaatccatctggatttccttttatgtgtgaggtgtggtatgggtctgtatccatttcctggggctgctgtaagaaaaagccacaacaacaggaatttatcccctcagttctggaggccataaatctgcaatcaaggtgtcagtaaggccatctcctcctgaagcttctaggaccgtccttgtccttgctgcttccagcttctgggggctgcaggcgttccttgtggctgcatcactccagtctctgcctctgtcttcacgtggccttctcctcctttctacatcttctcttctcttctgtctcttataaggacatttctaattggatttagggcccacctggataattcaggatgatcgtgtctcaaaattcttaacttgattacatgtataaagactctgggagttaggacatggctgtatctttttttttttttttttttgagatggagtcttgctctgttgcctaggctggagtgcagtggtgcgatctcagttcactgcaacctccacctctcaggttcaagcgattcttctgcctcagcctcccgagtagctgggactacaggcgtgcaccactatgcctggctaatttttgtatttttagtaaagacggggtttcaccatgttacccaggctgttctcgaactcctggcctcatgtgatctgcccacctcagcctcccaaagtgctgggattacaggcgcgagccactgcacccagcccagaattttcttcctttttgaggctgaataatattccactgtatgtatgtaccacagtttgtttatccattcatctgtggatggaaacttgtaagcacctgttgatttttgagccatgtgtatgtggcgactctttgtttctagtttttgaagtttttaaagttaattgacaacatataacagctctgatgccctgcattctcttgccttcctttctcaggctgcacttaccagtgggctaccatggccgtgcctcctctgtcgtggtgtctggcaccccaatccgaaggcccatgggacagatgaaacctgatgactgtgagtgaccgcagcgtccaggccttgctggtacccagctctctgttcccacacagagagttctgtggcctcactcacagcaccgttttttttttttttctggtgttattccagctaagcctcccgtatatggtgcctgcaagctcttggacatggagctggaaatggtaagtgagcttgatgttttattgccatgggatctatagacacccggcaggagagccctttgggatggctccccgcaccatgagccgcccactcccctcctcttcagccacatcggcagccgctctgtgtccccacctggccatcagaaggacagttgatccttattacttgcagattctgtatttgagaattcacaactacttgctaatatttatttgtaagtccagaattaatattcacagagcttttgtgggcatgtgtggacatgcgcagggcagtgaaacatttgagctgcctggtgagcatgttcctaggtgaggctggacaaggtgttactctgccttcttgtctcagcttatgctgtaaacatgtgtcctttgtagtctattcggtgccatgttttttgcagatctgtgcttttttggctgtttcattgtttttttataatgaccccaagtgctgtgctaaagtgccgtctagtgtccctagcacaggaagactgtgacgtgccttatggagagaatatgcgtgttagtaagctttgttcaggcaagttacagtgctgctgcctcagctcaatgttcatgaatcaacaaaatatattacataaagcatttttaagcagaaacacacataaaacaggctatatagttaggttttgattagttgataaaaattttctgaccaaaggcttgaaggaacctaatcctgtgtttcctctaggaagtcattctatatttgctaattctgtgttcatggtgactttataaaaaataattacctggccgggtgtggtggctcacacctgtaatcccagcactttgggaggctgaggtggatggatcacctgaggtcaggagttcaataccagcctggccaacatggtgaaaccccgtctctactaaaaatacaaaaattagctggggatggtggtgggtgcctgtaatcccagctacttgggaggctggggcaggagaatcgcttgaactgaggaggcggaggttgcagtgagctgagatcgcgccaccacactccagcctgggtgacagagcgagactctgtctcaaaacaaaaaacaaaaaacaaaaacccaaaaataataattaccacgagtgacaagagtcaagtgtatcagccccatggctgggcccatacaacctcagaactgtggtcactttaggctgcatacttttttatttgttttttgttttgttttgttttgttttgtttttctgagatggagtctcactctgtcacccaggctggagtgcagtggcactatctcggctcactgcaagctccgcctcctgggttcacaccattctcctgcctcagcctcccgaatagctgggaccacaggcaccttccaccatgcctggctaattttttgtatttttagtagagacagggtttcaccatgttagccaggatggtctcgatctcctgacctcgtgatccacctgcctcggcctcccaaagtgcttggattacaggcatgagccaccgcgctcggccagggctgcacacttttttaaattaaactttttattttgaggtcattgtagactcacatgcagttgtgagaaatagtacagagatcccaatacccttcacacagtctcccccagtggcaacatccttcgtaaccatggtgctctatcacaacctggatgttgatgttgatacagtcggtcccaccacctgaggatccctcatgctgcccatttttcagaggggacactgaaatctgggcagcccccaaggtgaggggaccagggaagtgatggaaaggaggagctgacctgggggaggcagcgctccggggacctggcagggtcttcagcatctgctgggttgtctgatgcccaaggttggagtcagtctccgtgtgggaaatgcagacaggcagatggagggggctttcccatagtcagcacctacagttttaggcgttgcctcaggaagctctgagtgcctcatcactgatggtgtagaagaagctgtcatggggccaccgagtcaggctgagacagtgggaagccctggttggtggaggcaggctgaaaggcccgtctgcttttctggagctccctgtctctcctgggcttccctgtgatttctctggattcagtccagaggagggaaatgagtgggcactgccgaatagcccgtggatagcagggcattccctgccagccctctgcctcctcctgccttagcaagggtactatgtgagactgcgggaggaggacccccagctgagattcatcagagcagggcatctgagccctggtttggggccatggtcttctctctgggagaactaaggactctgcaggcagacacttcacctgttgagagggagagagaaaagacagagagtcagcatgtggagaaatggttggggcagagagcccaggtcacctggactagtgcttttgggttctttttttcatcttgatgaaaaatttgcaatgtttaactattgtcacagaacaaataaaatggtgactaagttttgcaaatgtcatggctgagtctatgtttttcaaagagattttcccaaatttttctttctaatgatgcctggctagtctgctggttcatggacatcacgttggtgctgtttttctttagaggtagtgggatgacagataggggttagaggccgtggggtgtgctctctctggtactatttgctgcatgaaggaggcagtcttttggtttttcatttttcattaaaaaaatttattttttattttttatttttatttttaaattttattattattatactttaagttttagggtacatgtgcacaacgtgcaggtttgttacatatgtatacatgtgccatgttggcgtgctgcacccattaagtcgtcatttagcattaggtatatctcctaatgctatccctccctcttccccccaccccacaacagactggattaagaaaatgtggcacatatacaccatggaatactatgcagccataaaaaatgatgagttcatgtcctttgtagggacatggatgaaactggaaaccatcattctcagcaaactattgcaaggacaaaaaaccaaacactgcatgttctcactcataggtgggaattgagcaatgaaaatttttatttattttatttttttattttttgagacagggtcttgctctgtcacccaggctggagtgccgtggcgtgatctcggcctgctgcagccttgacctccctggctcaagcaatcttcccacataagcctcccaagtagctgggactgcggacatgtgccaccatgcctggctaattttgtttattttttgtagaggtggggtctcactatgttgctcaggcttgtctcaaactccgaggctcaagtgatccttccacctcagcctcccaaagtgctgagattatagacgtgagccacagtgcctggcctggtttttcatgacatgaatacaaaccctgatagtttcagttttacaagcctcatgtggctgtcaagtcttgaaaggcaaaggctgtatgggatgaagaggaaagagcagagtggcctgggatgcactgaagggaggggaggctgctttggagctcaggggagtggaaggaaggccgatggcgggggcagggcacaccactgcactctgctttcctgaggcgtccatctgacctctgacttagaaacacagtggattcatgccaggcccctgtggcagtcctggtccatggctggagtttggaaatacctgacctttgctctctaggtgacaagtgacctgggcggcagatcagctccagattctaatgaactctcccccatgtaaggctttttttgtaggccctggaaacagattgggagagccgatccccatttccaaggcccatgagcacatttttggaatggtccttatgaacgactggagtggtaattactggagctctgctcctgtagagatgacggggaggaggctggggacttggggcaatttcatagaagctgaagatctggtgcaggtcaaaagtggcaggtgatgcagtgactgagagtgggggtctgggtatcaaacagactttcagctctaagaactcgggccactcacttaactcctctgagctccaattttctcgagtggctagggacacggctgacatcataactaatatttactgagcacttatgtgtcaggccctgtgcttaacacccttcgtatattctcccgctgatccctacacggtatgtgcaatattatcttcccattttacagatgaggaactgaggcacagggagatttcagttagttgctgaactaagatttgaagcaaaacagtccagcttctgagcctgagctctcaaccctttgccatacgtgggaggaagatggcaccataagccccagaaagtgtctctctcatagtttgagaatgagcttccagccccttcctgggagatatcctgaccaccgtttggtcatccttctctttgctgtaacctggcacagtgccctcaaaggacctctgtccttggcattgaatgctcttgcccctttgtcctggggcagcctgactggggctgatctttgtggagatggcagtgctaggtgtctctgctccttggtcaagggcaggagggggtcgttgggagatgccctgatcagcctttgtaagtcctggctgtgcccttcttctgcagcacgagacattcagaagtgggagtatgtccctctcgggccattccttgggaagagttttgggaccactgtctctccgtgggtggtgcccatggatgctctcatgccctttgctgtgcccaacccgaagcaggtaagcacattctctgcaggaagctcccaaacccagccctgctgcctctgaggctgcttgcccactgagtggacatgccaggcatgcagaccatcaggagggaagctctgtgcccacggcatgcccacagcagagtgcctgggagttcctggccacgattacttccaggcagccagggcatcattctcccttgtggtttccctggccctggcacagttcttggagaaaacacagaattttgtaaccttaagaatcttgcaagacccgggggatctggccagttggcaggaggagtccctgcaggtaccaacattgcacaacctcccaggtggccatcaaatcttgttctgtgcaaatggcgccacctggaccccaactcatagaatgcagcttggagcccagcaacagggagtccctgcagcctctggttcccggcaccgcttggtctaccactgggtctaggccttgacccctggttccagtcctcccttctcagcctgttgcaatctgccccactccatcactggcaacacctggccagagtcacctgtgacccgatagtcagtgtcatgaccttgtgtccccttcagcatggacttcctgtggcccctcactcttgttggcattccctcaccccttggtttctggcatgtgacctgtcctcgttctccagtgtctctgagtcctcacgatgcccctctccaattctgacctccctgtggggatccaggctgagctcccagccatttgcacatcctcgcttgagcatctcaccacgcatttgctgggggcctctaccaacacccggtgctggtcctgcacccacactgctctcccatgctcctctgcctctggggtcatctcatgtttgctgtgctacaaacaaccctgaggtctttccttgcaagccagttctagtgaagtcctgtggggctttcaccctcatcccttgctctctcctcgctgctccctaccacagcaccccctgcccaccctggtcattttcagtcgccaggacttgactttctctctagctggcagcggccttgtctagtctccctagggctgcaaggccacagcctctctttgcttgtcctccagtcatctgccttcttccgggtcggtcatcacagggttttgcctgccttcctctgtgccagcccttccccaacaccatttaggtacaacactactattccccctctgaactattatttacttaatgttttccttcagagtggctcccagtttaaacttaatatattaagaagggaactttatattcctactggcatcactagctacactgtttcataaccattagtatcaccaaaaacgatctcatgtcccgtgggtgactcatgtaccatgctttggaaaacactgcttttggccggagtgcaggcgttctggcccagccatccaagctgcctccctagctggctccagcaccagccagggctgtctacttctgttgtgacccctctgccttccaggggccctgcaatgcgctttcaggcccagcctttcctcacaggccaggctttgttctccatctcggcctgtctgctgcccaccttccctttctctcccctcctgtggctttcaggaacatctctggtttggctcctgtgacctttgacctgctgatgccccttccttggctgcatttcctagagacccacagtatgatcccccctactgctatccagggacacagtgctgggtccctggagagggaatgctcctgctgtctcagaccctctgcctaggggagcaggtgctgctgggggcctggctggtatgggggcccagccgggtgagctcagcccacctgccagtgacctctgtgctgtgctttgccctctcaggaccccaggcccctgccgtatctgtgccatgacgagccctacacatttgacatcaacctctctgttaacctgaaaggtatgttgtagggggactgacatggccaggagctctgaggcaatgtgtgcctgtgtgccttgtcctgaaggctcctgagctttggcaagggtgagggcacgtgctacagccctggagatgtgtgtggctcgtctaaaggaaagaggaggggaggggaggggacaccctggtgctcactgggaacctaactgggcccatagggcattaaccctgtcactgagctctcagtggtagggctgaaaggatggagtccgggacttccatcttctgcttgaatcccctccccagcctctccaggggctgcctggctcctgctcacatatcgccactgaccctcacttccgtggtgggtggcacatttcattgagtgcctgtttgaaagcatgtccttgtgggtctgttcgcttggctgagcccctggggccacacagagccagcgcatcaagaccccagattcccaccatgggccagccctgagtgtcttgcagacagacccgagatccccaccctgggccagccctgacatagacagggcccacatctccctgtggctgctcagcccgcctccgcgaacaggcccaatggggcgttggtaataaagagactggctctgcaggccatgactctgctgctcagctgtgggactttgggcaagttgccaaacctggccatgtcctcatttgtcatctatgaaatgggataatagcggcgttgacctcatggtgtgttgtgaggaccaaacatgtcaattcatgcaaaggtctgggacagggtctgtacctagaaagagtcaggtgtcattttccaatcccaacgggggccctcggatggggagggtttgcctggtggccacacacagacctcctagccacactctggccaaatctcctttttagctccattccattcctttttcttttcttttcttctttttttttcccccgagatggagtttcactcttcttgcccaggctggagtgcaatggtgcgatcttggctcaccacaacctctgcccctgggttcaagcgagtcttctgcctcagcctcctgtgtagctgggattacaggcatgcgccaccatgcctggctaattttgtatttttagtagagatggggtttcttcatgttggtcaggatggtcttgaactcctaaccttaggtggtctacccacctaggccttccaaagtgctgggattacaggcgtgagccaccatgcccggccagctccatttctttcttctgtctgctctgtctgtacactccaggctttgccatgtctgtctcactgtcagttccagggtctcggcccttcatgaggtggttcctgtcaggaggcgcagtacactgcaggagctgtcgccatgggagcaggatgctccatggagaaagagctgtcacagagagcctcctggctgcccagggccctctgggaagctgtgctgggcccgctctttcaggttccaggtcaggaagctgaggctcagagaggaaaaggattcaccccgagccacctacctggctaatggcagggctgggactcaatccaagtgtgtcacaagttctaggttggcctcctgccacccacaatgcgtgcttggagtatactttctatctggttttgtcctcagtattcctggctgcctagaggtgaacctgcccgcccgggggaggccactggtagaaaagggacaagattatccagaaagcacagtgtccagagatgtagtcctgcatttgcagttctgatgttctgagttgggatctgggcgaaagggtctggggaggagcagccttggcagacccagacctcgcatggctgaagagcacacctgttctgtgccacctcagaggggaagttaggaccaagggaggaagccaggttttgagggagcagaggagctttctacttattagtgctgttcagaagtggaacggcaacagcccggtaccttgcatgtagtagatgtttagtaaatattgtttagtacgttgtgaagtagcacactgcccatcactggaggagctcggcaggggacagatgacccagctatccagaggactcctgaggggacagcaggttatccttgatcaaaggtcacaagtagctttcaaatggcacactatctttagtggatttgcgggtgccaggatcactgtgttaagaaggattctgaggctacatatggactcagagcaaacatgtgctgtgatcaattaatgctgcctgctgtaggcgtgggaggaggaagtgatgacttgtgtgcatgtattggccaaccctggacctcccagctctgatgtcctaggagctaattgtttcacagactctaagtgaaatcatgttggacaatgggaagcttcagccacagaacaattctttttttattttcctccctgatgcatggaattaagttttcatcaatattgcttttctttccaacaggagaaggaatgagccaggcggctaccatatgcaagtccaattttaaggtaagctttgacgctgatcagactgctttttagaattgagggaaagagagacttttcttcctggcaggaacaggaggagagcattccttttgggatatgatgatgggtcagcctgtgggcctggagcttccatggcctgtctcttttaggagtggccatggggtcacagagttctctcgagatagaggctgcataaatgtggccagtgattttcttgggggaaaataggtgttcctgtaaaggtctagttcctggtttatcctgtcctgccaggggctgtattgatgagagtgacttattttttaagtgaacttttaattgaagcataatatacatagataaaaatgcacacattactgtaatcccagcactttgggaggccaaagtgggaggatcgcttaagcctaggagtttgagaccagcctgggcaacataatgagaccttgtctctgcaaaaagtaaaaaaattagccgggcgtggtagcatgcacctgtggtcccggctacttgggaggctaaggcaggaggatcgcttgagcccaggaggtcgaggctgcagtgagccatgatcacaccactgcattccagcatgcgtgacagagcaagaccctatttcaaaaaataaaaattaaaaaaagtgcatattatacatgtacagcttgaagaattttcctaaaatgaacatccctgtgcaaccagcacccagatcagaaatggaaaatttccagcacctcagcagccccgtggggccctccaggtcacttcatcactccctccagcaaaggtcactcctctcctgacctctgctaccatgtattattttttttctgtttttcagttttatagaaatggcatcataaagtagcatgtattcttttgtagctggcatctttgttttagtgttagatctgtgagattcaaccctgttgctctttgcagtgacagctcatttttctcattgccttatagtgttgcactgtataaatattccacaactgacttaatttttttttttttttgagatggagtctcgctcgttgcccaggctggagtgcagtggcgcgatctcggctcactgcaaactccgcctcctgggttcatgccattctcctgcctcagcctcccgggtagctgggactacaggtgcccgccaccacgcccggctaatttttttttttgtatttttagtggagatggggtttcaccatgttagccaggatggtctcgatctcctgaccttgtgatccgcccgcctcagcctcccaaagtgctgggattacaggcatgagccactgcgcccggccaactgacttattttgtaagtcacatcaattccacaatcgatggacatttggttgtttccgttgtttttggctatcacagagttactgtgaacattttagtacacaccttttggtgcacatatgtgcacatttctattgagtgtatatccagtaataggcttgctgggtcatagagtacacatagactcagcctaggggtacttccaaacagttttttgaagtggttataccagtatatactcccactagcagcatgtaagcattttgcctgctccacatcctcgtcagctctggtggtgtttgccttttcgttcaaaccgtgcctgggattgtgacttcagtttgcatttccctaatgactaatgcagctgggcatgttagtcatatgtttatggttcatttgtttcttggccttttgaatatcctctgaatcattgaactatttctagtttccctaatttcccttctaatttaatattattctgggctccttagggctagtaagaagaaattaaggggcctccttgcaggggctcgtgggcaagaatccatcttttgggtttcctatgccgggatgtgtggctgtaggaatggcaatgtgagaagctgtggcctgggacaggcatgggcgtgcattgcatctgagcgtctcggtgggcacgtggtgccttggccccctctgcccacagcctgaccgcccacagctctccctcgctccttggcctgccctgacatcgtgtttgaatcgttcagctccattgcccagtgtccatcccaaggcccggcatgggagaatgggagcgagggctttgctcacgagaagcctctgctgtggtgtggacttagattctcccaatacgggactggagggtgttcccagggcagagtggagtgttgtacacaagggcatgttgcaggctgagggactgagcagtaaggtcagcccttaggggatgctgcttggagaaggtggtcagtgtgggcttgaggtagcagaggagctgaggttggagtttgtgaaggagatggaagagcttgggggaggtctctgggcagctccccaggaggacaatgtgtccttactataagggactggagagagctggctgggggagctggggaccggggaaaggccagggaaggcggtcgtgagcagggcaggctgtgcccagctgcctccgggatgctaggctaagcctgccgctgctcattccacctcgcgtccattgcctgcagtacatgtactggacgatgctgcagcagctcactcaccactctgtcaacggctgcaacctgcggccgggggacctcctggcttctgggaccatcagcgggccggtgagtatctggctgcactgagggctgcccacgcagagcatccctgctccccacacagccccaagggccctcagctcagcctcgagaagagatttcaggcccgaggtgggtgtatctcacaactctgtcttcctcgtagcctttctctctgggtgcaggagggacttctcatccaaattcaaacctaaagagactggtgtgagaacggaagcctgggtctctgcctctgtaggggagcagcgcagtgacacgtggggaggagtcaggagacagtgatagtgtcttggttgtcaccatctcacactacaccctcccaggatgaggtggccatgctgctgtgccccttcccacccgcttgtccccctgtaagcctgcgggagtcacagaaccttcagagatgatgaccttggggtggtgcatgtgtcactcacttcctgcagggggctggccgagccctcttgttccttgagctgtcgacaggagggtgttaagcatcacgatatctgggcaaactgcagcctccagagcagggaggggatgctgcagggggcactgggcactctggtcagggattcactgattcctaaacaagcgatgtccttagtggaaccattgctgtccccacaggaagaaggggcagagttccatgtctcaaaggcatctctgcagtgatcccaccaaggccgaggcagggtctctgaggggcatgagggccccctgccacttctcgggactcccaggtcttgctgagcatggtccatgccagagccaaggcataaattcatgttattctttcttccctttcctgtgatgaaggagccagaaaacttcggctccatgttggaactgtcgtggaagggaacgaagcccatagacctggggaatggtcagaccaggaagtttctgctggacggggatgaagtcatcataacaggtgagggctgccaaacccagcagctcgtcttcctccttgcccgccatgcactgttctagctgcggggcgctcctacctggccatgaagccatctgttctcacgcatcctgactctgcctcccagagtctctgcctgcttgttctgtccttccccacagctatggctacccgggacttcaagtgtgagtctccctaggccagaaagactgtagacattctgcttggtctcccttctccctgagcatagttataaaatactggcaggttcctcaaggtctagactttgcagcaaacgccctgtgcagacacttggtgacctatgactaggatcaaggaaggttcagctgagttagtgactgaggcttcgcagcagcctgttccaaggaggtgagggtgcctcttaattcttctgggggtgccattctgcctaccacattttactaatagagggaaagggcaccataatggttagcagcacactctttagagctggaaaggttcaagttgaactcccaggtcccccaccagctgtgtgaccttcattaagttatttagcctttctgagactcagtttacctcatctttaattattttttttgtttttgagtcggagtcttgctctctcatccaatctggagtgcagtggcacaatctcagctcactgcaacctccatctcccaggttcaagcgattctcctgtgccttagcctcccgagtagctgggattacaggcgcgctaattgtgtatgtgtcagtttccgtgcttaactaaaagcttgtgttagtttcctgtggctgcagtaacatagtaccgcaaactttgtggcttaaaacaactgaaatgtattctctcacagctctataaggtacaagttcaaaatcctcgtgttggcagtgccatgttcctggaaactctggggagcgtctgtccctggcctcttccagcttctggtggaagcctctttgtcttgtggccacatcacactgatctctgcctccacggtcacattgtcgcctcgtcttctgtctcatctcctttacctctctcttataacacacatgtgatagcatttagagcccacctagacaatctcctcattctaagatcccaacttaatcacatctccagaaaatttactatataaggtaacattcacaggtcctagggatttggccgtaatttagtccactccagagctcttggagagcaaagtttagtccaagtagcagccacatagtgcatgcccagtgtggctgttggttagttctttgaataaagtggatttggtagagaagatgcaggcagagctcaaaacagcagatgatacccattattaatcaataaatacccattttgctcccatttctgcagcctaattatacctctctaatttgaatttgactatttactgaacatctgctaggagccaaccatattgcaggcatgtccaccttccttatttcattttctactcacaatagccctttgatgatataatatcattgcccccattttgcagagtcgaaaacttaggctgatagaaggcaggttacttgacaaaagtcccacaactggggaagccagtctgcaactgaggtcttctgattcccctgccaagtttgtttctagtctttctgcaatgcttgccagacctaccgcaggcctttggtcacggttctgtggattgagtgaaagcattttctgaagttttgatttggggaaaggaaggaaagagatggtggcagaagagaaaatgatggctttaactctctgttgtcagtgtgataagggcccctgactaagccatgctagaccaggcagctgtccagggcctgggagaaaggaggctggtatctagcagttggaatgcacatgtgttcttgacatttgagccagagaaggaaggagaaaggagccaagatgccatgagagtcatttccatgtttgtttgtgtatacaacgccttactccggaaggatttttggaggccagcagaggaattcagggaaaggcagttccttggatctgaagaagcacatgttggcaagtgaagagggaaatgggaacagatgggcaaaatcccctggaaccaagaaagaagaattataatttgctaagaggagaggcatacattatgtgttcataaaaagaaaaaagagaatttcatacagaaggggaccactgaaaaactcaaaagaatgcatattgctagaatttgggctaagcagggggtaagcagaggagcgggcaggtggaggtggtgtgtcagctgtgttaccttgtgcaaaggttccccgcattggcggacggctctgccctcaccttctacgacttcactggtcacgtggccctgctgagctgctttcttgcttgaaagccacacatggtttcttcagctcttcccggctttcctcctccttctctgcacctgctcagatgcctttatggctgcctctcatttccctgcttgctcttcacggatgctccttccccaaatcaatttctaaccattggaaacgcgatagaacattcagaagtgctggcatcagccaacgccgcagcacttactgcaggccagacactgtgccaagtgctttacctgcaatacattttctattccaaacaaggcagctactcttactgtctctatttttcagatgtggaaactgaggcccagaaagatgcatacttacccaggatcacacaggcgataaagggtagagccagggtttgaacacaggcagttgggctccaggagctgtgctctgaacccttgtgtcctgttgcctctttaaatggcgcgatgaaattctcatttctgagagagtccaaaaaccacaaaatgttcagcaagagaacaggtgaagtaaacaaaccaaaaatatcaacaaaaatctctgatcgtcttggtttaactcatccatcccctagtctcgctcacaaaccccatctggtgttgagcttgcaacttgcaaggatgtgttctcgcaggcatttgcacggatggctctgcactgctggacacatgcatttctcactctccttcagatctttgatttgttgatagttatgatttgttgtggattctttcttggtatctgacattatttggaaacaatatctgagcaaaagtctttcgtttcttgccctgcgtctctcagtggtggcgtctttcacctggtgttcctgtgtctctgtttattccagtttctctccccagcattattgcttgccttgcctggcacagaattcctgcgcaaggctgaccaggggtcccagggtgtagaagcagtgacccttctccttcaggaccatggttgggagagactctttaaaaatgctgcagttccgagttagttgttttgatagatgtttaataaatttctgctgggagccagttttactttaataggctttttttttcaccccagtggtgtggatatttctgagcattgaggtggaaaagagactgacagaaaataatgaaaatgagcaacagaataggtgaggtcgttgctctcgacaaagggcatccctgcatgttgtcagcatgtgggtcacggggcttcttagggccccccaaaggacagcctcactgaacagatgtgacaaatgcatctcgtgcctgagtgtctgagcctttgcacgtgttcttccctctgtctggaatggcattttcatgtgtcttccctaatgaactcctagctacccgtcaaggcccagctaagatatccccccttcctgctccctttccctccatgctgctcgctcagcaccttgtaagcatttctctgtatctctcgtctggacctcccactccctctaagtggacccctctcaagggcagagatgggcttctctctgcttttccatcatccttgttgaaatggaattaaatgaaggaaactaatatttattagtttctgagatgtgctgggaatttcactgaaatatttagtctaatccttacaaccttgagagataagcgttgtttttcttgtttgcagatgagggaggtgagttctgaagtcaaacagcttgttcccagccacccagctcataatggttgtaatgactgacacttacagggaatttcaaatagggactggaggctgttctcagagttttctatgcatttgctcccatcatccttgcagcagtcctgtgcggtgggcactatcataagatccattgcacagatgaagaaactgaggtctagagggacccaaggttacagagccaataagtagaggagccaggctttgacctcaggcattctggcttcaggctaattggcagagcgaggatttgaacccaaacccatgtggggagagttgaccactgtattagtctgttttcacactgctgataaagacattcctgagactgggtaattcataaagaaagagaggtttaatggactcacagttccacatggctggggaggcctcacaatcatagtggaaggcaaaaggcatgtcttacatggtggcaggcaagagagaatgagagccaagtgaaaggagaaaccgcttataaaaacatcagatctcatgagacttcttcactaccatgagaacagtatggaggaaaccgctccatgattcaattatctcccactgtgtacctcccacaacacatgggaattatgggagctataattcaaaatgaggtttggcgggggacagagccaaaccatattagccacaggaaagctgttgagccttgcagtgcctctgaggatccctggctgtggggtgggcccgggttctagtccaagggctcctgcgtgcaactctgcccagcttccgtggagggttattcttgtgtttaagatatgtgtgtgtgattctgatggcaccttcctgcctcgggccagctgtgtgctgacgggcactgccgctgcctaggtgttggttccggtgagcccagcaactttgtgactgatccttgtcctcctctgttccagggtactgccagggggatggttaccgcatcggctttggccagtgtgctggaaaagtgctgcctgctctcctgccatcatgagattttctctgctcttctggaaacaaagggctcaagcacccctttcaaccctgtgactggggtcctccctcgggctgtaggcctggtccgccattcagtgacaaataaagccattgtgctctgaggcctgcactgccgcagatgcagctgtgtccacttatgatcgtgatttgatccagtgggtcaaggtgtgtaaagcctccctgccagatattcattaatatgttttctcactcttattagtgaggtcaggggtctttgtgggattttcttattagacatcccaggcctcctggtattccatggaatttgaaaagagactggcacctgtagtagtcagggctctccagagaaatagaaccaaggagaaaga

SEQ ID NO: 61526 - DNA, 15827 bp, Homo sapiens
tttccgcagttaggggctgctatttcaacgcagggagataaaaagaaaaaaacacttgctcttctaccccgctaaaaacactcatcctagggagcacgccagcatttgcagcgttcggggcagggccactcggcctgcggccgttgcactggctggaagctggcaggcgatcacggttgattggctcgggtgcggtccaagggcagcaacgccttcggcgggccgcctagggtgattggctgctgcagcccaccccctagccggtttggtgggcggcgaagcctggattggtggagctaagagctggctcagtttcagcgctggctcttcgtgcatggcagagatggcgactgcgactcggctgctggggtggcgtgtggcgagctggaggctgcggccgccgcttgccggcttcgtttcccagcgggcccactcgcttttgcccgtggacgatgcaatcaatgggctaagcgaggagcagaggcaggtgaggagactgacccccttcctggccccaaggcctccttcctgcctggtccccaaggcctccttcctgcctggtccccatcggcccagcgcccacccagccttggcttttgcccgtgggccgttgggagcgccagcgcgggggcgggacgcggggcctccgacctcgggtccagtcctctgacctcggcctcacgtctgtggagtgaagatttgagaccgtgggacagtactgctggaagtagagaggaggagtcgaggctgggagagctcctgagagactgatggtgttttggtggaggattggccaggctacctaccgcttgtggcacaagggccctcaatctgtatgtagttcacttacacctgaacaggctgaggtatgcttctcacacctgggtggtcatcgtaatcaccagggagtcttttttgtataaacagtttgggggttttaaaaagccacagtgagctctcctgtcgctcttcagcccattgggtcaaaacacaaaagttgaacaagtacttgaaagaagtagttggaggccaggcgccgtggctcacacctgtaatcctagcactttgggaggccgaggtgggaggattgtttgagctcaggggtttgagatcagcctaagcaacatagccagacccccatctcataaaaaatagaaaagaagacgaagtagtatttacaaatggagcagaaccagagtccttcctgaggtttcacttggaggctggatggagttggcggaggtatgagcctcccagcaactccgtagtttatgtttatagccagcgagcgctcagagcttccgtgaaccacctcaagtggaaagggttcaatccctattctcaagctttcctggcaagaggagtttcttttcttttttcttttttttttttttttgagacggagtttcactcttgttgcccaggctggagtgtaatggcgcgatctccgctcaccacaacgtccgcctcccgggttcaagtgattctcctgcctcagcctcccaggtagctgggattacaggcatgcaccaccacgcccggctaattttgtgtttttagtagagacggagtttctccatgttggtcaggctggtctcaaactcccaacctcaggtgatcctcctgcctcggcctcccaaagtgctgggattacaggcatgagccaccatgcccagccgccaagaggcgtttctaatctctttgggtaatcagacccttttagccaaaggttcgggggcttaaaagagcctgacaactattgagatctggcagctgcctggaatgcagctggagcacagagggtgggaggtgggaaggtgctggggaagctaggagagtcagctggggtcagctcctgcagggcctagtaggcctgggtgagaagcttgtgttttattctaagtacagtggaaaccaatggaatgatttttatgtaaagtgtgacgttttaaaaattaccatcaagctgtctaggctgaagaccttaagaaagaggggtgaagatcatctctgaggaggcataaactactgaggcctctcagtttcagtctgatgctgtttggggaagttacttgtggccttttctcttgaatgtgtctgggtagtggagatgctgtctgcagtggcatctgtttacctctctcctattagcttcgtcagaccatggctaagttccttcaggagcacctggcccccaaggcccaggagatcgatcgcagcaatgagttcaagaacctgcgagtgagttgggaggtccgggcagtcgggggcagtcagggagtggggctgagctgcactgctgcctggaagagctcacacagttctggtaaatgaagcctctctaagaatgcagcccctctctctgaagtgtttgggtctcattgttccagccacatgtgactggctgccttcccctcaacacttattccactctgctccattctgttggcaggaattttggaagcagctggggaacctgggcgtattgggcatcacagcccctggtgagtatagtgtctttccctaaaaagaacttttcttatgtgccctttaagacagttcccaaaagaagcaggaagggaagggaaagattgtgcttaaagaaacccagaactgcatcttttggacctgtgaaagcacccattgattgtcagcccagagaacaggacactcttctattttattagacagtgatgtagagaaggcagagggattaattaggtcattgtggctcacttggatcaggatcagtccaactcttgaactctgcatacttaataggctcacccaggtgatttgggaagtttagaaaactctggatcaagtggttgtcttcatagtacctcagtcttactgcctcccctaatccctataagctttgtcctaccagtggcctctcggcaggaacactctgggcaggtgtgtccctgcagggactgcctgtgtcctcttctgcttaaaccttggagctcatttgggagcagatagcggggggagtagggtaggggctgggcaggggagagagatgtctatctgggcttccaggtgaggtggccagatgatgtgtttaataggctgtccggagggagaaggcagggagctagcaggctctggtttggatgatattaacgtctgaaagaggcccagactggcttgcagtgcccggtaaagagatgagcctaggccaggcgtggttgctcacacctgtaatcccagcactttgggaggccgaggcaggtggatcacctgcggtcgtgagttcgagaccagcctgaccaacatggagaaactctgtctctactaaaaatacaaaattagctggtcatggtggtacatccctgtaatcccagctactcgggaggctgaggcaggagaattgcttgaacctgggaggcggaggttgcagtgagctgagattgtgccactgcactccagcctgggcaacggagcgaaactccgtttcaaaaaaaaaagcccagcctgcttgggcctgtattcactctgggcatgagagtatgagtggaacccaatatacttctccttacatcctagaaagttatatcacctttcataaaatgaaaccacttgaagattaattgaaaccatcttaatgtaaaagcattaggggaaaggctgctgggtactcctaagcaagactctcctactgtgttttgggggtttatgtaccccactccctgcagacaatatgcttctgaatcagattgtattttacggaagaaagaggcagttagaaatcagatgaaaatggccaggtgtggtagtgggctcctataatccgagtgactcgggaggccaaggcaggaggatcgcttgagcccaggagttcaaggctgcaatgagccatggttacaccattgcaccccagcctggataagagagtgagagcccgcctcttgaaaaaaaaaaagaaaagaaatcagatgaaaactctttcaagggaacctgaaaaagaaagctggttacaagttctggtttctgcatgatgtcatggtggctgtttctaatgtcacctgccttcaggctttccttcctgcagttgtaggggcaggtcaaggtttccttagagcctagaacgagcctgacttattggtcagagtgaacatgtgtataggaccttgctaggcttgacccaatcagcagggctgggggtggtatcaggtgtctcagccacttggagtttggatctgctgccaaggaaaaaccgtatattttatgaggagttctgaaattctctgccagcatctcatctgccctctgctgtacagctcacctcaagattttccctgaggctgtggctctcctgtcctgtcaccagtcctgcttctttctttttttttttttttttttgagacagaatctcactctgtcgcccaggctggagtgcagtggcgcgatctcggctctctgcaagctccacctgccaggttcacaccattctcctgcttcagcctcccgagtagctgggactacaggcgcccgccaccatgcccggctaattttttgtatttttagtagagacggggtttcaccgtgttagccaggatggtcttgatctcctgacctcgtgatctgcccacctcagcctcccaaagtgctgggattacaggcgtgagccccatgcctggcctccagtcctgcttctttgggttcagccctatgctataaaatctcaccttcctcaggccttttgcagacacatcagatcctctggctttgtatctgttcttggtgctttggacaccacctccaccccaatgcctttgtttttctccaggccctctttcttcatttattcatctgcctctgcatttctgtaactttctgagtagtgggtgctcaggttgttcacgtatcttcatcaagaagtctgtctgggataaagcagaagttgcaatgattgccttctgaatcacccctcagctgaggagcaccagcaggcaaaaccagtccactgagcttgtaagcaggtctgtggcatcagcttattcttgttgctagagagaatttggagtaggtgctacaaggtgcttcccttctgccgtcaaatgtaagattcttaatgaatgtcccgatttaatctgggctgcgttttccactcccttgtaccacaccactcacagttcagtatggcggctccggcctgggctacctggagcatgtgctggtgatggaggagatatcccgagcttccggagcagtggggctcagttacggtgcccactccaacctctgcatcaaccagcttgtacgcaatgggaatgaggcccagaaagagaagtatctcccgaaggtgaggaaatggaaatgtaatacacgctaatctcacagtgcaaccaccaactaaaagataccctctccccttgggggccagtcagacctgctttctgtagcatgctgccatgaaccaaatgtggttaggaaggggccatggattgctttaaaatacttgagccaaaaataataaaaataggaccagaactcttgcattgaacaacagacagacaacatttgaagagaactctaagaaatggaagagtaggactagcttcctttgcaaagggaatggaaaaaggagaggcattttcagccttgtagccattgggcttagaagagacttctaggactttaccgacaccctggtctgagagcgaagtttgaaggggtttaatgtggacaggaagaggcagtaccagtgagctgctctagggtactctgaggttgtaacaaggcctgttgggggttttccttgcagctgatcagtggtgagtacatcggagccctggccatgagtgagcccaatgcaggctctgatgttgtctctatgaagctcaaagcggaaaagaaaggtgaggccactctcaacttgggagccaaaatgggcagaggtacagacattatcaggataatggagcaacaattgtgggtggcccctgctgggtttccagaactttctcaaaggtggacagcttcttgctcagcagaaggtctatggcctggctgagacaggccaagatggcttgagcaaatagccaacatcctgcccttaggaaatcactacatcctgaatggcaacaagttctggatcactaatggccctgatgctgacgtcctgattgtctatgccaagacagatctggctgctgtgccagcttctcggggcatcacagccttcattgtggagaaggtgagtataggtgggtgcagggccaggaggcttctgcctcctgacagtggtaccagagatagcccgttcactgatctcaaatggaatcagtgttgtgtgctctgcaaggcccccagaggtgggggtgaggcagagagcagactgcaaggagggtgaccaaaagtccaggaagtccagggcagatgggtcacttctgaagacggtggagccgtcctcagcgccaggccacacaaagaggtctagaaaggggaggactaaaaggaggtcaggacatgacggtcagggtaccattggtggatctgatgaatgtggccatgggagactgaggtgtgggtgggatgcaagtggagactgcccctgcaacagccttgacaacagaagcaagaaggaagcagagcaggagttccaatgaaaagttaggagtttgggtttgtttttagaaatgagagaactgagcagattttttggtcagaaggaaaaaaaagggaagaaaaaagaaaatagagggagaaattgaaaagtgtgggaatgagtgggcagaacacaatggtgagctggggcagaagagagaaggatgggttacaggtgatggtgcaggaaccacttgcctaacgatcatgaggaggaagccaggggccctgtgaaggctggggccacgagtgggggagttggcaagagtttcatgagcgagtattgtaaaggtttgcggtaccctccatagagagggggaaagtagctgtctagggttggagcagtagggacctggctgagattggaaatctcaaggttgcgtgatgccaccctcattacaggctgaaggcagcatgtgccagcactttgctggtcacttgccaaaacatgctgcaacccagtagtccaggtcaaagtacagagggctcagttcagccctagtgggatccctttgggtacagacaggagaacaacagaggataagggaattgaccgggctggtgacagtgtcttggaagtaatgtcccctgggggagggaaataaggccaggggggtcgggagggctcagggaactgagcatatcattgagaaagaagtgtccccatgagaactggggagaacacaagctagtggcagaggaggctgggatcaatctggggcgttagcaccggaaggtcccggggggagcatgggactaggatgctgccatgctgtgcaggtacagggactcaataggaaggtgagtgccttcttcccagaggcctttcctttaccaggcccccttggggctaatctgtaaccaggaccaccttttgtttcctgtaaagggtatgcctggctttagcacctctaagaagctggacaagctggggatgaggggctctaacacctgtgagctaatctttgaagactgcaagattcctggtaagtagcaccgggaatcggggagcccctctcctgacccccttccaggctgatctggctgttctcaagttgagaaagcctctgggttagagaggcttggcattgttagcgcttcagtgacatgtggctaggctgtgagctggggctgctggacagcgctccttcctggccagggccctgcagcggcatgcctaactggcatcacacactccgcatagggtctgtactcagtagccggaggagaagggtcagacctaccctttcccattgatgtccttcagtcttcctgtactttcgcccatccactgcatgtgagtaactcattaactcacgtttttgtaaaatattttaaaaatgagttattcatttttagcattaatgatgctaagaaaaaaaaacaaaacatctgaatccactgatggaatcccgactcagtagagagaaggcagttctgcttgagtatgagtattttctcccctgaggtgtaactgaaatctgacatggtggagcactgtgggagagccagcacagccatcatgtactaaccagaccaggggcatggatttgttgtttggggtttttttttgttttttttgtttgtttgtttgtttgtttgttttgagaaggagtcttggctctgtcacccaggctagagtgcagtggcgtgatctcagctcacggcagcctccacctcctgggttccagtgattctcctgcctcagcctcccgagtagctgggattacaggcatgcgccaccctgcccagctaaattttttgtttgtttttttgagatggagtgtcgctcttgttgcccagggctggagtgcaatggcgcgatcttggcttactgcaacctccgccccctgggttcaagtgattctcctgtctcagccttctgagtagctgggatgacaggcacacaccgcccagctaattttgtatttttagtagagacagatggggtttcaccatgttggccaggctgctctcgaactcctgacctcaggtgatccacctgtctcagcctcccaaagtgccaggattataggcctgagccaccttgcctggccaggggcatggatttgatcaacagttaggtttgctgtctgcctcagccatataccacgcctatcactgacagcccaaaaaagtgtactttaattacagggagcatccagggagggggagctgtgcagctccttctttgttgacaggaaaaaattcagctagcattaaaggcaggtcagtagtgtcaacctgttttcctgcccacacctcccaaggccatccagtctcctggctttactgggtggagaggtgctcagcagcttctgtcactagctctgaatggcctgtctcctggacaaagaagctttcacggactactctgcagggaggtgacattggaccagagctgactccacctgggggaaagagtaattctctggtttctttataggtgcctgtgtagaaagagtcagggagggattgggtgacttctagaccaattaacttttcttctttcccatccaagggagtccagagagggaagggaaagatctaacaactctagcctttgtggttggcctcgtggatggggtgggagtcctggcagctccacttctgactggaaggggttcacttgatccttttctttcacctggaaccttagttgaataaaggtcaagtgacatattttagtgccttacttgagagccatgtttccaaatctagtacctttgataaaagtgaggaggctgtggacagctctctccctctgaccagcacttatcctggcagctgccaacatcctgggccatgagaataagggtgtctacgtgctgatgagtgggctggacctggagcggctggtgctggccggggggcctcttgggtaagtgtgagaggcttgagggaagctgggctctgtcggcctcctcggcaggtgacccaccatgagcagcagcagccttccccttgcggggccaaagggagctgcctcttggccctgctctctcctgggagatgaaaggaacctcctcttcccatgttgaatttcttcccacagtggggaaatatcattaagtaacagacaaaaggcctgaggagcagggtggcttactcggctgtgaaacgacacctgggctgtcacgcccctgcacctctggccagtcagtgccgtaactgtggcaagactttctgaagttgcttttctcctccctgggattctggccttcccacgctagcattttgccaccacacccggtggtgggatgaggaggtgcccacggggcctttctcctttctgacaggctcatgcaagcggtcctggaccacaccattccctacctgcacgtgagggaagcctttggccagaagatcggccacttccaggtgagccgagtgcttttgctgacatgtactcttcaactgggctaaagttttctttgaaaagagaggaagtgaggtgggcaccgtggatggttactgtctcctctagcaaattgagcttgactgcttggaatgcagtcttcctcagcatgcagcctgactctggaagtcatcaggaagttcaccacattgccacctcgattcctgtgtgaggtggatgaactagacattgtaaggttggagagcaaagcgtgcaagttgtgggggcagaagggaaagaggttgctatttgtagttagaccttctggtccgaagaagctgctggaaggtaataagcattggagtaaatggtgccttgggagccatgcctttcggaggcagtgatggccacttcggggtgtcatgcgggctgtggaacagccactctgtggccctaactcccacacctgcccccatctccatcatcctgagtaaatcccatctcctctccatgcccctgcttcctcatccttggctgtcttgttgccattgctgacctgcttttggtaactgagagagtgttccagcatgttgacctgtgacatccctttgtgcccagttgatgcaggggaagatggctgacatgtacacccgcctcatggcgtgtcggcagtatgtctacaatgtcgccaaggcctgcgatgagggccattgcactgctaaggtgagggccagcctcagtcggggagaggcgggggcagtggaccagctgctgagacttgctgtctgcgtgcctcgcagggccctgctgaccccagcttcctcccgtaggactgtgcaggtgtgattctttactcagctgagtgtgccacacaggtagccctggacggcattcagtgttttggtgagtgatccccacttcccagtcccggggctccctcactcctggggcctgtggctgcttcagaaagcagtttcagggcgggcgtggtggctcacacctataatcccagcactttgggaggccgaggtaggcagatcacctgaggtcaggagttcaagaccagcctggccaacatggtgaaaccgcatgccgggcatgatggtgcatgcctgtaatcccagctacttgggaggctgaggcaggagaatcgcttgaacccgggaggcagaggttgcagtgaacaaagattgcaccattgcactccagcctaggtgacagagcgagaggctgtctcaaaaaaaagcaatttcctctccacttctccactcctcactatgtgcttatgctaggcccagctgagctgggaccttcgggctctttctgtcccagttacaaggaggaaatggaaagcaaatgagaaaactgctagatgccaggagttgctgctgccttcggcaacacccccctctcatcctccccgcctcatagatgctaggaaatgggaaagggagatgtggctgggcacagtggctcacacctgtaattccaacactttaggagactgaggccagtgaatcacctgagatcaggagtttgagaccagcctggccaacatggtgaaaccctgtttctactaaaaatacaaaaaaaaattagccaagtgtggtggcaggagcctgtaatcccagctatttggaaggctgaggctggagaatctcttgaacccaggaggcggaggttgcagtgaccggagatcgcgccattgcactccagcctgagtgacaagagtgaaactccgtctcggaaaaaaaaaaaaaaaaaaaggccgggcacggtggctcacacctgtaatcccagcactttgggaggccgaggcaggtggatcacctgaggtcaggagttcgagaccagcctgaccaacgtggtgaaaccccatctctactaaaaatacaaaaattagctgggtgcagtggtgcgcgcctgtaatcccagctactcaggaggctgaggcaggagaatcacttgaaccttggatgcggaggttgcagagagccaatatcatgccactgcactccagcctaggccacagagcatgactccaaaaaaaaaaaaaaaaaagctaaatggaaatttctagaaatagttcataagtttcaaatccacaccatcctgaatagcttgaagtgttgtgccatgctgctctgtcatgtttggtacgtgaatcgtccctttgtgcagcctatctatgctatgtgggctacctgcccgttagtagtcacctagggtatccaatcagctgtcctgatatcagagtgcctgtgttcaagtaactcttattttgctcagtggccccagattgcaagagtagtgatgctggcatgtcataatagttctattttagtatttgttattattgttgatctgttactatgcctagctcataaattaaactttctcataagtatgtatgtatagggaaaaaaacaacatatatatggggttcggtactatctacggtttcaggcatccactggggtcttggaatgtatcctccaaggataaggaaggactagtgtattccccacacccctccctcttgctaccttttgctgcttttctttaatcaccctctcctcctgtggcctgtttctatatacttggcattctgtttgctttctttgttttgtcaatcacttcctttcttctctgcccaaaccctggttgcaggtggcaatggctacatcaatgactttcccatgggccgctttcttcgagatgccaagctgtatgagataggggctgggaccagcgaggtgaggcggctggtcatcggcagagccttcaatgcagactttcactagtcctgagacccttcgcccccttttcctgcacctagtggcctttcttgggaagtagagatgtggcggctttcccaccctgcccacagcaggccctcctgcccagctgctcttgtcagccctctggcctctggatgaggttgagttctccacaacagctcccaagcatcatgggcctcgcagccgggcctgtgccacggctagtgttgtgtgatttaaaatggactcagcaggaagcatattgtctggggattgttgggacaggttttggtgactctgtgcccttgctctctaacttctgagcccacctcccagggtaggcacctgggggcatgcaggtgcccacctcccagggtaggcacctgggggcatgcaggtacccacctctttctcttgggtgaggctctggcaaggagatctctctgctcaagcacagcagaatcatggcccctctccatgaattggaacttggtacaggttaagtatccctaatcctgaaatctgaaacacttgtggttccaagcattttggataaggcaaattcaactttcagtctcttttctgggggaaaaaaataataaacctagcctagccaggcgtggtggctcatgcttgtaatcccagcacttcaggaggctgagatgggtggatcacctgaggtcaggagttcaagaccagcctggccaacatgtggaaacctcgcctcaactaaaaatagaaaaaaattagttgggcatggtggtgggcacctgtaatcccagctacttcaggaggctgaggcaggagaattacttgaacccaggaggcggacgttgcagtgagccgagcttgtgccattgcactccagcctgggcgacaagagcaaaactcttcaaaaaacaaaacaaaacaaaaaaaccctggcccttgtttcttccagtttctagaggtatcagctcctagcagcttatgaacacatatgcttgcttggccaggcaaggtggtgtgtgcctgtaatcccagcactttgggaggccaaggcaggtggatcacttgcagtcaggagttcaagaccagcctgtccaacgtggtgaaaccccatctctactaaaaatacaaaaattagccaggggtggtggtgcacgtctgtaatcccagctactcaggaggctgaggcaggagaatcacttgaacccgggaggtggaggttgcaatgagccaatatgacaccgctgcagtccagcctgggccatagagtgagactctgtctcaaaaaaggaaagaaaaataggctgggcacagtgactcatgcctgtaatcccaacactttgggaggccgaggcaggtggatcacgaggtcaggagttcaagaccagcctggccaagatggtaaaacctcgtctctactaaaaatacaaaaattagccaggtgtggtggcaggctcctgtaatcccagctactcaggaggctgaggcagagaattgcttgaacccgggaggcagagtttgcagtgagccaagatcacaccactgcactccagcttggacgacagagcgagactctgtctcaaaaaataataggccaggcatggtggctcaacgtctgtaatcccagcactttgggaggccgaggcgggcagatcacaaggtcaggagttcgagaccagcctgacgaccaacatggtgaaacctcgtctctactaaaaatacaaaaattagccaggcctggtggcacgcgcctgtaatcccagttacacagaagactgaggcaggagaatcgcttgaacgcaggaggcagaggttgcaggagctgagatcgcgccattgcactccagcctgggcaacagagtgagactctgtctcaaaaaataataataaaataaatgaacacacatgctgctgagtccgcagggggggcagagcagaggacagcgtgcttttgtgtactgttggaagactggctcctcctgtacagcacctctgagcccttgtgcaccgccctgccacgggcaccatccagtcctggccgtgtgaccacccacagctgactgggcagcaggcacaggccctacccgagcaggccggagttggctcgcatgactccagctgaggctgcctgtgtacatttctccagataccctatggctaattttgttataactgcacagtggctgctgccattttgtattaaatatattgtgaaacaaacctatctggggagaagcaatctacttgccgctgcttcctgtctggatccagcttgtgtccttggagagtggctggcccaggtcctattcctgtcctccagcccgttctttcatgagggacaggaaggtaaaatcagcccttaggagagaggtctcagcctccctttcccagatctcccagtgagttttaaaggaagcagggagcccagagtgctaagttcttacagccagaaggaagcttatagatttctgaaaaccgcccctttgtttttaaaaagatcaacacaatttgactttctcaaggtcaaaacgaactagaatccagatctgctcatggcaaaaatgggggtgttctgagaattccagctttgggccgcactgtacagcagtctggatagagtgtgatctgagaagggaatgggtctgggttgttccaccccttccgagttccaaaaagagggaactggttttcttggttctcagcccagcagcacctatcctggctcttggtcctggcctgcagccaagtgctgttcctagcctgaggcttgagacaggtggggttggctcctcaccaaccccagttccgtcccatcctgagggcaagatcctgggctcataggcagtccctttcacttccttgtcttgctccctgctatgttggagatgaatgtgactaaaagggccatcttgctggcttaatgtgtggctggagagaccagcctggagacaatgtggcaaaatggggcgcttcatccagtctgtctaagccctgtcgacttggggaggtgatttctttcctggttctatatgtgaagcaaaataaatgttttaaaattaaaagcaaaaaaaacaaaatgaaccatg

SEQ ID NO: 61527 - DNA, 3955 bp, Homo sapiens
ggaggagccagcggaaggacggtgtgcgggccggccagccctggacgaaagaagagggcccctccaggccagtctgggcaccctgggatagcggctgcaggtaggcagaggcgctgccagtgcccaggtggcctttccctccatccggcccttcccaccttcctataaccttccctccacctccctcaactcctggcctccccacccttttactgccttcaaatctctctccctaaaccctgaccccttcctgcaccccaagcccgcccctctctccgtaactcagccatcagcaggggcagacggcaggtggcctggttgctgcagctcccaggatcagctctgccctccccgcaaacgccagcctcgtcaccgctccagggcacctccagcagtaacaggtggttgcagcaggtggcagccagcccctggatgagccaaggtctcttccccagccaggcatggccgactctgcacaggcccagaagctggtgtacctggtcacagggggctgtggcttcctgggagagcacgtggtgcgaatgctgctgcagcgggagccccggctcggggagctgcgggtctttgaccaacacctgggtccctggctggaggagctgaagacaggttcttgttgggggagcttgtggtggagagggtgtggacgcttccccaacccttcccaagctgggatccccacccctgcagtggaacagatgatgctggtttctgtccacatggatgggtcgagtgagtcacattgggaacgtgactccagggtggaagatgaacccagcctctggcctctggccccagctctgacatggcctgtgtcctccaaccccggccagggcctgtgagggtgactgccatccagggggacgtgacccaggcccatgaggtggcagcagctgtggccggagcccatgtggtcatccacacggctgggctggtagacgtgtttggcagggccagtcccaagaccatccatgaggtcaacgtgcagggtgaggagctctggacactcctggccatcttgcctgtttgttccccactctgtctttggccttgacctccggtgactcccctgggacaagttgtcctattgacagccctgcccccgcctcccctgacctgtcatggttttccctggacctgggatggggaggaggaagatgcagagagggaagaagctgcagcttggatacgcctcctcctctgccaggtacccggaacgtgatcgaggcttgtgtgcagaccggaacacggttcctggtctacaccagcagcatggaagttgtggggcctaacaccaaaggtcaccccttctacaggtgagtggcaggccctcttgtcctctaagagcccatttccctcagcattgagtcttccttctcctcccaccaggggcaacgaagacaccccatacgaagcagtgcacaggcacccctatccttgcagcaaggccctggccgagtggctggtcctggaggccaacgggaggaaggtgagcccagaaaaaggaggcgcagagatggggctcctgccctgcacacccccttaccctgccagcccaaggaggccggggccgagagcaagctgtcgggtcccaggtctcagcagtacctgcctttgccaccaggtccgtggggggctgcccctggtgacgtgtgcccttcgtcccacgggcatctacggtgaaggccaccagatcatgagggacttctaccgccagggcctgcgcctgggaggttggctcttccgggccatcccggcctctgtggagcatggccgggtctatgtgggtgaggactgggctaggcagggggaggctgagaatatggcaggaggacttgctctagaagggggcaggacccacatggccctgggagagaagtgtggactctggctagaaaaatatggtctatacatgggccaaggtagactgtgattatgtctccacagcctgcagagaatacaggatccatgcaagttgggacattaaaaagtgtatcataggctacagagaagattgcagctatgggagcagccattccccaggagaggagaggagagggacagtgtgtacacagcactaaaagggctgggttcagtggctcgcatctataatcccagcactttaggaggctgaggcgggaggatggcctgagcccaggagttggaggctgcagtgagctatgaccgcaccactgcactccagcctggatgacagagacagaccctgtctctaaaactttttttaaaggaagtagcatctacacagggaataaggtcacctgccactccatcctgcagtccccaagcctctcagggcccaccacgcaggtcctggtttctctatcctctccccaggttctttgcagatgcaggctggcccaggagagcaagtgactaccagggcgagggagaaggcagcctttcccaggctgctgtggggatgtgggcggcaactacctgggcccaaagagggggtggcccaggagagcagcctcgatgtggtgttgcaagggcactcaggggtgtgtccgcctctcttccgccaccggcaggcaatgttgcctggatgcacgtgctggcagcccgggagctggagcagcgggcaaccctgatgggcggccaggtatacttctgctacgatggatcaccctacaggagctacgaggatttcaacatggagttcctgggcccctgcggactgcggctggtgggcgcccgcccattgctgccctactggctgctggtgttcctggctgccctcaatgccctgctgcagtggctgctgcggccactggtgctctacgcacccctgctgaacccctacacgctggccgtggccaacaccaccttcaccgtcagcaccgacaaggctcagcgccatttcggctatgagcccctgttctcgtgggaggatagccggacccgtaccattctctgggtacaggccgctacgggttcagcccagtgacggtggggctggggcctggaggcccagatacagcacatccacccaggtcccgagccctcacaccctggacgggaagggacagctgcattccagagcaggaggcagggctctggggccagaatggctgtccttgtcgtagagccctccacattttctttttcttttttgagacagggtcttgctctgtcacccagactggagtgcagtggtgtgatcatagctcactgcaccctcaacctcctgggttcaagcaatcctcctgcctcagcctcctgaacagctgggaccacaggtgcacgccaccacacctggcttttttttgttgtttttagagacagggtctcactatattgctcaggctggtcttgaactcctgggctcaagtgatcttcccacgtgggcctcccaaaacgctggaactacaagtgtgagccaccgcgcctggcccaagccctccacattttcaatccaggagccttgagtctgtgttgtgtcctgacacctccaagttctagggccgtcaggacacgggagggtttggggacagagtgtccttcctctgtcctctcatcccagtcctgatggccgcttggtgagtgtctggtgccctggtggcctgccccagctctcttctggctttctgagcaggaagcgagcagaggctccacaggcttacgctgctctcctgacagccacacgcgaccctcggtgcagagtgcagaggcggctctggttcctccagccacctcagtccctctttgggaggtgatgttcccattgtttttcaaaggcctcaccttcaactgtctgtcttagaattcccctctggagggctatggcctccctatgctttcacttcccacctctctacctaagttccttcccagcacatcgccagccctgggcctggggatgtccccaatgctgtacctggctgaccccggattaaaagcctcatccacgaccgtg

SEQ ID NO: 61528 - DNA, 5437 bp, Homo sapiens
aactacagctcccagcatgccccggggcccgcaaccgtccgccgcccggtgcactgtggacgatgagtcagggttaggggcgccaggacgtgggcgtgcaggacgccagagctgggtcagagctcgagccagcggcgcccggagagattcggagatgcaggcggctcggatggccgcgagcttggggcggcagctgctgaggctcgggggcggaaggtctgtgtgtgacaagagggacggtgggcagcggccctgggcaccgggccggcactgaacccccactccccacagctcgcggctcacggcgctcctggggcagccccggcccggccctgcccggcggccctatgccgggggtgccgctcaggtaagtcaccgcagccttggcaagggggtgtgggagcggcggtccgcttcggcgcccgccatcggcagggatctccctcttggtgccaggtacctgcctactgctcagtcgccgaaagtaggggaaagggcaagccagggtgccctagggcgaaactaggggaaaggtcaccgcttcgcgccgcctccccgcgcggctctcgcctgttctccccttgacacagcggaagtcccttccctgaacttgctaaccgtctcttttcccagctggctctggacaagtcagattcccacccctctgacgctctgaccaggaaaaaaccggccaaggcggtaggtagccccgaggccaggtggaccttagccagacccaaccagagccctgaaatttgcctctctctgcccaggaatctaagtcctttgctgtgggaatgttcaaaggccagctcaccacagatcaggtgttcccatacccgtccggtaagggaagggataatcagagctgggtggggccagggtggtttcccctgccagcctggcctgaccagcctgtcccccaccctctgcagtgctcaacgaagagcagacacagtttcttaaagagctggtggagcctgtgtcccgtttcttcgaggtaaggaatgactcggggcttggtccctggtgaggtgtttggagatgttaagctcaaaaggagcctggatgtgggatcctgtgccttccccaggaagtgaacgatcccgccaagaatgacgctctggagatggtggaggagaccacttggcagggcctcaaggagctgggggcctttggtctgcaagtgcccagtgagctgggtggtgtgggcctttgcaacacccaggtgagggcgccctatcgccacatcccagtatgccataccccagcttggcagactcagctcttttgccatagacctagagactagggctaaggtctcttctaagcacctgccctgggtgcctgtgggatggatgttaactgtccaaacataacacaatttacatgcagtcccctaggcctgagccatgggcctcaccctggttcccaagtccttacaaatctctaagttggggattgcctaacaatagactgactagtagcaagtcaccctcctacctagacctaagacagaccagcattctctgctgtgccctttgcacaccccacttcttttctacacactggggatggcccaggtcaggcactgccctaggtcaggaactgccctaggtcaggaactgccctgttgcccacactctcctgttaaggtcaggtccccctgcagccagtgacaaccccagattcctgcttcccctccagtacgcccgtttggtggagatcgtgggcatgcatgaccttggcgtgggcattaccctgggggcccatcagagcatcggtttcaaaggcatcctgctctttggcacaaaggcccagaaagaaaaatacctccccaagctggcatctggtgaggcaaccctaggagagccagggattggggggcacactgggcttggcacagattaggccagttggcacttagattatcagatggctgagcatttcagttgggggaaggttttggggaggcatcacagtgtgctggttgggacatgcaaaagaactggatactcccaggtgttaagggggaactgcctgctggagggatggggaagtgggccgaggggactttgaagctcatcagaacttggggtaaagtagctctctccccaacaggggagactgtggccgctttctgtctaaccgagccctcaagcgggtcagatgcagcctccatccgaacctctgctgtgcccagcccctgtggaaaatactataccctcaatggaagcaagctttggatcaggcaacctgcctcccatttctccccttctcctccgcccaattccaggccccactgctccccgtcctccacgccctgaatatcccattcttccacagtaatgggggcctagcagacatcttcacggtctttgccaagacaccagttacagatccagccacaggagccgtgaaggagaagatcacagcttttgtggtggagaggggcttcgggggcattacccagtgagtgaatttgggttgggggagcttaggactgaggggcaggactgggctcctgggcagatggctgttgcaagtcaccctggggacgtgtgcaaaagccaaagcaggtggactgaatgtggcctttgggactaatatgtatgcaactgagctaaagttttggctccagcaaccaagtccaacacaaaataggacatagccaggcctccttagccctcagggcctgaggggaagtggtggctgtagcctctaatagtctagtggtcgtcattcctccctggtgcataaggagcgaaggagcagtttttcccccagtgacaacctgttgaacacacctctgctttcccacactgccctgacacagtgggccccctgagaagaagatgggcatcaaggcttcaaacacagcagaggtgttctttgatggagtacgggtgccatcggagaacgtgctgggtgaggttgggagtggcttcaaggttgccatgcacatcctcaacaatggaaggtttggcatggctgcggccctggcaggtaccatgagaggcatcattgctaaggcggtgagtaccctgcccgagtccctaggtaacccaaacagaagtctcactgtcccccttgccatgtgtccctgatcacttgcaggcactccctacactagaaactcctcccctaccagcagcccgacttgctagcttaggtctccatccagcgtagactgaactctggttgtatgcaaaacccatccctctggcgcaagcccagcccctctcctagggagactgcagaaccacactgaaccacagcgggatgtgtggaccctcttccaggtagatcatgccactaatcgtacccagtttggggagaaaattcacaactttgggctgatccaggagaagctggcacggatggttatgctgcagtatgtaactgaggtgagggcctcccaagcccctctccctggagccctggggctttcttcccagtcgggtcagactacaacccccagcagcacctggggcagtgggtctccagctttacaccaatgccctaggggatgcggggaggcatagtcagctcagcttctgcgaagagagacagcaatgatgttctgctcaggtgcctgccagcagtaccagaagttaattctacctcatcccttacatccaccccttttaagaaaacaaatacctggaagcacctgatgaactgacccagaacaagtatctgcctgacctgacaagctaggtcagcccttatcttggagatctgggtgatgaggccaagtctgacaaagccctttgcaattttccttcccatgtcccaactatgcaacctcagtccatggcttacatggtgagtgctaacatggaccagggagccacggacttccagatagaggccgccatcagcaaaatctttggctcggtgaggtcccaggcatgctgggagggagtccagtttgggtgctcagctcccaaaaccagtctcatctgttctttgtccctaggaggcagcctggaaggtgacagatgaatgcatccaaatcatggggggtatgggcttcatgaaggtacaggacggtcttctgcagagcctcggctgggccaggggtgggtaggcacatctcagcacgggcatataatttgtgtggccctgtgctaggaacctggagtagagcgtgtgctccgagatcttcgcatcttccggatctttgaggggacaaatgacattcttcggctgtttgtggctctgcagggctgtatggtaagacagagaattgggtgggggtagaggtggggaggacagtgagtcctgactgctggaccctcttcccccataggacaaaggaaaggagctctctgggcttggcagtgctctaaagaatccctttgggaatgctggcctcctgctaggagaggcaggcaaacagctgaggcggtaggcttagggccagagccaggggagggcagggtggtgtatggcaactaaccagtcattctccctcttcctctcaggcgggcagggctgggcagcggcctgagtctcagcggacttgtccacccggagttgagtcggagtggcgagctggtaagtggccaggggtccaggagagcctgcatcagggactgcagccgatggcccctctgagccccgcactgtccccatctcttaaggcagtacgggctctggagcagtttgccactgtggtggaggccaagctgataaaacacaagaaggggattgtcagtaagtgagctctacaccattccgcccctccctttcctctccttgagactaatgcccccacccccacccccaccccacctaccggacagatgaacagtttctgctgcagcggctggcagacggggccatcgacctctatgccatggtggtggttctctcgaggtgaggaggcaggcagggaatgcctgagccgcagggggcctgggcctggatcccagccggcccagatttattttcatctcctgcttcctgccagggcctcaagatccctgagtgagggccaccccacggcccagcatgagaaaatgctctgtgacacctggtgtatcgaggtgagactcggggctgccaagctcaggtgagggctggaggtgcaggcccaacccctccttccctctccccaggctgcagctcggatccgagagggcatggccgccctgcagtctgacccctggcagcaagagctctaccgcaacttcaaaagcatctccaaggccttggtggagcggggtggtgtggtcaccagcaacccacttggcttctgaatactcccggccagggcctgtcccagttatgtgccttccctcaagccaaagccgaagcccctttccttaaggccctggtttgtcccgaaggggcctagtgttcccagcactgtgcctgctctcaagagcacttactgcctcgcaaataataaaaatttctagccagtcat

SEQ ID NO: 61529 - DNA, 2797 bp, Homo sapiens
aacacacctctgccggctgagggtgacacaaccctgttccctgtcgctctgttcccgcttatctctcccgccttttcggcgccaccaccttcttggaaatgagacagagcaaaggggagggggctcagaccaccgcctcccctggcaggccccataaaagcgactgtcactcggtcccagacaccagagcaagctcaagacccagcagtgggacagccagacagacggcacgatggcactgagctcccagatctgggccgcttgcctcctgctcctcctcctcctcgccagcctgaccagtggctctgttttcccacaacaggtgagagcccagtggcctgggtccttagcagggcagcagggatgggagagccaggcctcagcctagggcactggagacacccgagcactgagcagagctcaggacgtctcaggagtactggcagctgaacaggaaccaggacaggcacggtggctcatgcctgtaatcccagcactttgggaggttgaggcaggcagcccacttgaggtcagtttgagaccagcctggccaacatggtaaaaccccgtctctactaaaaatacaaaagttagccaggcttggtggcaggtgcctgtaatcccagctactcgggagactgaggcaggagaattgcttgaacccgcaaggtggaggttgcacagtgagctgagattgcaccactgcactccagcctggcaacagagcaagactccatctccaaaaaagaacagaaatcaatgaagcaccgagtgacagggactggaaggtcctaattccatgggtatttacggaacccctacgccgtgtggagtcttattctagacagtggggacgaggccatgaacaaggtagatgagagaggagatttctccatcctggtcagggaatttgttaaagactgatgaaaacatgaataaataattgtgtctagtacattctattcgtgaatctcataacagacagtggtagagtgaccgtgacccattcgccacacagtagagtcacttttttggtttgttttttagagacagggtcttcctctgttgctgaggctggagtgcagtggtgcagtcatagttcactgcagcctcaacctcctgtgctcaagcaatcctcccacctcagcgtcccaagtagctgggacagcaggcacatgccacgggttgggggaccacaggcatggtcaaggggctggcagtcaagcaagtgtttcatgagaaagtgacagttgaccttcgtcttggagggtgagagatggaggcagcaaagacctaaggagaggacaagccagcatagcccagggtcaggctgaacaagaggagatggtgggacttggggataaggctgaggggtgggcagtccctaagtcttgtgggcaaccatgcagacactgatttttccttggaataaagaggaagcccccataagcttttttttttttttctgagatagggtctcgctctgtcgttcaggctggtgtgcagtggcatcatctgggctcactgcaacctccgcctcccgggttcaagcaattctcctgcctcagcttcccgagcagctgggattacaggcggctgccaccacgcccggctaatttttgtttttttagtagagacagggtttcaccatgttggccagactggtcttgaactcctgacctcaggtgattctcccacctcggcttcccaaagtgctgggattacaggcgtgagccactgcgcccagcctcctgtaggtttttaaaatggagaaaaccacaatctcactggccatgttttaaaaaacttaatctgccagtcaggcaccatggctcacacctgtaatcccagagttttgggaggccaaggtaggaagatcagttgagcccaggagttcaagaccagcttgggcaacacaaccagaccccacctctacaaaaaattaaaaaattagccgggtgtggtggcgtgcacctgctgtcccagctactcgggaagctgaggcgggagcatcgcttgagcacaggaggtcaaggctgcagggagctatgactgtgccactgcactctggcctgggcaacagaggaagactctgtctaaaaaacaaacaaaaaaagtgactctgctgtgtggcaaatggattgaggggcaagaatgcagggaggtgtgttaggaggctggcactggcatccaggcaggggaaggtgatatcccaaagaagagtagcagctgtggaaagaggaggaggcggatctgggaggtttttttttttaggaaaagccgcccatgggaaggtgagcagaagcaagaaagcaaggcccctcctaagagtccatttgagctctgggtttaaaccacttggagaggagcaggttgccgggagccagtctcagaggtccactgggccccctgccatcctctgcacccccttctgctttcacagacgggacaacttgcagagctgcaaccccaggacagagctggagccagggccagctggatggtgagcgcaacagtgatgcctttcctagccccctgctccctccccatgctaaggccggttccctgctcacattcccttccttcccacagcccatgttccagaggcgaaggaggcgagacacccacttccccatctgcattttctgctgcggctgctgtcatcgatcaaagtgtgggatgtgctgcaagacgtagaacctacctgccctgcccccgtcccctcccttccttatttattcctgctgccccagaacataggtcttggaataaaatggctggttcttttgttttccaa

SEQ ID NO: 61530 - DNA, 23561 bp, Homo sapiens
acctccctccgcggagcagccagacagcgagggccccggccgggggcaggggggacgccccgtccggggcacccccccggctctgagccgcccgcggggccggcctcggcccggagcggaggaaggagtcgccgaggagcagcctgaggccccagagtctgagacgagccgccgccgcccccgccactgcggggaggagggggaggaggagcgggaggagggacgagctggtcgggagaagaggaaaaaaacttttgagacttttccgttgccgctgggagccggaggcgcggggacctcttggcgcgacgctgccccgcgaggaggcaggacttggggaccccagaccgcctccctttgccgccggggacgcttgctccctccctgccccctacacggcgtccctcaggcgcccccattccggaccagccctcgggagtcgccgacccggcctcccgcaaagacttttccccagacctcgggcgcaccccctgcacgccgccttcatccccggcctgtctcctgagcccccgcgcatcctagaccctttctcctccaggagacggatctctctccgacctgccacagatcccctattcaagaccacccaccttctggtaccagatcgcgcccatctaggttatttccgtgggatactgagacacccccggtccaagcctcccctccaccactgcgcccttctccctgaggacctcagctttccctcgaggccctcctaccttttgccgggagacccccagcccctgcaggggcggggcctccccaccacaccagccctgttcgcgctctcggcagtgccggggggcgccgcctcccccatgccgccctccgggctgcggctgctgccgctgctgctaccgctgctgtggctactggtgctgacgcctggccggccggccgcgggactatccacctgcaagactatcgacatggagctggtgaagcggaagcgcatcgaggccatccgcggccagatcctgtccaagctgcggctcgccagccccccgagccagggggaggtgccgcccggcccgctgcccgaggccgtgctcgccctgtacaacagcacccgcgaccgggtggccggggagagtgcagaaccggagcccgagcctgaggccgactactacgccaaggaggtcacccgcgtgctaatggtggaaacccacaacggtgagctcggaggggcaggggagccgggaggggggcccccagggggcgccggagtgccggggccacgggtaggaagtgactggcagaagaaactggctggaggaagaggacaccccggggcaaagggaacgtgtgatggtgggaggggggtgtccgaaagaggatggcactgagccccctaccacccaggtgtctggtcttggagaggaggagatagcgaagtggaccgcttctagagtgcgacagaaacatgcggggtcgtgggggcagtcccctagagggagacaagcaatagggggagggtagaaggctccctcttccaggacgcgttgaatgggggggggggtcgtggggtgccaggtgcagagaagggagcctggtgtgggagaagcgaagaccccagcatttgggaaaggagaggcgctggagaaagttgacccagagcttgggggtcctgaggtggaaagattcaagaaggacagaaaagctagatgaaggcaaccccagagggtgccaggaaagtgagagcggacccacttccagaggctgccaggaacacgcgggatgcgggggtgggggagagtcgtagaaagagaaacagaggtgcgtgtgataaatgtggggagaaagggacgggaggttattggaaggaggaggcaagcgggagaggagcggagactcgggagggcgcccgggatgcagaggtgtcctcggtgtttcacacagggacgtgagggacagagtggggagcccagcggaggaatcgagcttccagaagacctagagtcctgggtcatgggaagggctttaccgagaggggagacaggcgtgggaaaggtggtgtgagcggggaggaggagagatacccagcgccatccacgctgcattccccgcaggatgcaggggaatgggctgagcggagtccagccgcaggggaagtgctgggtggggggtgactctacaagaccgaggtgagaaaaccaagctgggaggagtgagaaagccccacgtgggtgccacgcgcggggggaggagcctgcgcttccaccaaggggcaggaggaccccgctgcgctaaacgctggcagtctggaccccaaagtcccagttcctctcagggtggctggggaaaccccagcgtccggcggcctcatccccctcccttccctttccttcccatgcccccggcggaggcggggatcgctcgcggagcccggggcgagacggggcaggtctggtccccgccctcctggctgcggcgcctcccgccctcctcaccccagctacgggcggggctcccactcagccggccccgtcggcatccatgcgaggacccaggcgtcccgcgtggttcagagccttggggaagatccctcaggtttcactgactcttgggcggtgtgggcttgcgggttccctgcccatttctgcgccagtttacagctccagcccaatgacgcgcactccgcacccaagtctcagccttaccttatcttccgtggcttcaccttcgttgtagaggttcctttaacactgacacctccaatcctcttctccccaacaaatgcacatgtgtctcgtctcgcacgtgtctccccatctgcctctttcttttcgtctccgttagtctttctgtccacgcatgggtctcctggtttttgtctctccgactattttctctccctttctatttttctcctccacggtcctgttgcctcgtctccgtctctgacatctccccgcctctccctctctgcatcaccctccaacccttcctctccctcctctctgtcttcctccctatctgtcttccccagccaaggctctgcctttcctttggggtttgctgagtaacctccgggccaagaatagggcttactggggctgggtggggagggagactggggaggaggaggaggatcgaagggggccgtaggggaggggtttcctctgcctttctcaccagtctcttttcacacccccactatgggaggctggaagcagttgccccagttgatccagcagttcatggcctgttccctcatccccatccccaaacttttcctaaactagaaaataccttggctgggcgcggtggctcacgcctgtaatcccagcactttgggaggccaaggtgggtggaccacctgaggtcaggagttggagaccagcctggccaacatggtgaaacccggtctctactaaaaatacaaaaattagctgggcggggtggcgggcggcgcctgtaatcccagctacttgggaggctgaggcaggagaatcgcttgaacctgggaggcagaggttgctatgagccaagatcgcgccactgcactccagcctgggcgacagaaactccatctcaaaaaaaaaaaaaaaaaaagaaaagaaaacaccttaattccttttctccccactacagccattcctacccagaatgaacttcactttccctaaccagctggggaagggagttaagggtggaaaactaataataaaaataagtagaagaatcacttaggggttaagagcacagtctctagctgggtgggtgtggtggctcatgcctgtgatctcaacatattgggaggctgaggcgtgaggatcccttgagcccaggagttccagcctgccgtgagccatggttgtgctactgcacttccgtctgggggacagagtgagaccctgtctcttgggggaagaaaaaaaaaaagcacagtctctggaatgagacagcttgagtttgaatcccagtctgcagctatgtgaccttggggcaaattacttaatctcggtgcctcagtttctcatctattaaacgggtataataatagtataaggttgtgaggtttaaatgtcttcatctttgtaaagtgctttagatagcatctggtaaatagcgctgttttgtggttttttgttgttgttgtttttgagacagagtcttactctgtcacccaggctggagtgcagtggcgcaatctcggcacactataacctctgcctctcaggttcaagcgattctcatgcctcaacctcccaagtagctgggattagagccgtccggcaccatgcctggccaatttttgtatttttagtagaaacggggtttcaccatgttggccaggctggtctcgaactcccgacctcaagtaatcaatccacctcggcctcccaaagtgctgggattacaggcgtgagccactgcgcccagccagcactcttagacgtatacatgattgagtgaccagtgtatgcagaattggtgccacatggcttgacctgggtcatctaatttcccactataatactggaatgggttctagagtcactctgtcttgtcttacacctggctcagagagaggaattcacttgcccaaggttacacagcgcttaaattaggagagtctgtgtgggaatgcagggagcttaatgttattgctgtttttcaaagaataacaggaaactgacattcagaaagagggtgttaactgcccatggtcacacagccaagaggcagcagaggcactatctgagtccaaagcctgtgcctttgatccttactctgcattttaggggctcttgcatttggggcaaggaaggccagagcaaacagagtggttccccttggtgccagccttagtcgacttgagagatgatgctacatgagagaggaatgtggttaggacctattttacagaggaggaaacaaacctagggggagaaaccacttcctcaaggtcacacagctaaaaagtatcacagtcagggctgggcgtggtggctcacacctgtaatcccagcactttgggaggccgaggcgggtggatcacgaggtcaggagatcgagaccatcctggccaacatggtgaaaccccatctctactaaaaatacaaaaattagctgggcatggtggcatgagcctttagtcccagctgctcgggaggctgaggcaggagaattgcttgaaccctggaggcggaggttgcagtgagcagagattgcgccactgcactccaagcctgggtgacagagcgagtctccgtctcaaaaaaaaaaaaaaattcatttaaataaataaataaataaataaataaataaataaataaataaaaggtatcagagactgactccaccccagagctgtcagctccaaaactcctagagttgggagcaccagctcccctcacctctgccaaacccctgatcgcctcccttcatttctccctgctagaaatctatgacaagttcaagcagagtacacacagcatatatatgttcttcaacacatcagagctccgagaagcggtacctgaacccgtgttgctctcccgggcagagctgcgtctgctgaggctcaagttaaaagtggagcagcacgtggagctgtaccaggtgaggacatgagccagaaggaaggtcagggcatgggctggagagggtgagctgtgaccaagggggtggctgtgggtcggctggttacaaggtccacctagatggtccctgaaggatagaagaacacaaaccatacaatcctagaacgctttttttttttttttgagacagtgtctcactctgttgccaagctggagtgcagtggtatgacctcagctcactgcaatctccgcctcctgggttccagtgattctcctgcctcagcctcccaagtagctgggattacaggtgtgcgccaccacgcccagctaatttttgtatttttggtagagatggggttttaccatgttggccaggatggtctcgatctcctgacctcgtgatccacctgcctcggtctcccaaagtgctcagattacaggcgtgagccactgcgcctggcctcttttttttttttttttttttttgagatggagtcttgctctgtcgcccaggctggagtacaatggggtgatctcggctcactgcaacctccgcctcctgggttcaagtgattctcctgcctcagccacccgagtagctgggattacaggcatgtgccaacacgctgggctaatttttgtatttttagtagagacagagttttatcatgttggccaggcttgtctcaaactcctgccctcaagtgattctcctacctgagcctcccagagtgctgggattacaggtgtgagccactgcacccggaacctagagcacttttaaatgttcagactctttgcatcctaggatgttaaacacttagaaggctggaatcttaggagttggactctttaaggacacaggattcttgaaagttggaatctctgaaaaggttgggggctctagaatcattctgtccaatatgacagccactagtcacatttagcttgattaaaatttaaattgtttaaaattaaattaaaaatttagggccaggcatagtggctcacacctctaatcccagaactttgggaagccgaggcaggcagattgcttgagcccaggagtccgagaccagtctgggcaacatgttgaaacttcgtctctacaaaaaatactaaaattagcctgttatggtgatgcgtgcctctagtcccagctactcagtagtctgaggtgggaggattgattgagcccaggaggtcgaggctgtagtgaactgtgattgcaccactgcattccagcctgggtgatggagcgagaccgtctcaaaaatatatatatataggccaggcgtggtggctcatgcctgcaatcccagcactttgggaggccagggtgggtggatcacttgaggtcaggagttcaagaccagcctggccaacatgacgaaactccatctctactaaaaatacaaaaattagccaggtgtggtggcaggcacctgtaatcccagctacttgggaggctgaggtgggagaatcgcttgaccccaggaggtggagactgcagtgagcggagatcataccactgcactccagcctgggcaacagagcgagactctgtctcaaaaaaataaaaatgaaaaagaaatcctcattctcactggccatatttctagtactctatagtcacatgtggttagcagctactattttggatgttgcagataaagcacatttccagaaagttctttaggacagcactgctctagaagatagggagcttccaagaggactggggcatctggaagggctggaggctctagcagtttctatgagctagaatccatatcagagggaatgttaactcataggatggtagatttcagactttcacagtgagagaactttgtcctatgttagcttggcttcttggagtctggggaattcagctttattctgcagtccctggagtggactatccagccccagaaaattcttcttttttttgtgtgtgtgtgtgatggagttttgctcctgttgcccaggctggagtgcaatggcaccatcttggctcaccacaacctttgcttcctgggttcaagcgattctcctgcctcagccacccgagcagctgggattacaggcatgcaccaccacacctagctaattttgtatttttagtagagacggtgtttctccatattggtcaggctggtctcgaacttctgacctctggtgatccaccctcctcggcctcccaaagtgctgggattacaagcgtgagcgactgtgcctggcccagaaaattattctacacagatgttgggtacctgcagcatctaggtgcggcatggcagactcttgggtttatagaacattagtcttctaaagcttctcaggctctagaagtggaaatcttgggatattatcaaacatttgaatcacaaaatgactttttttttttttgagacagagtctcactctgtcaccctggctagagtgcagtggtgcaatctcggctcactgcaacctctgtgtcttgggttcaagtgattctcctgcctcagcctcctgagtagctgggattacaggcgtgtgccaccacgcctggctaatttttgtatttttagtagagacgaggtttcactttgttggccaggctggtcttgaactcctgacctcaggagatccacccgccttggcctcccaaagtgctgggataacaggcgtgagccaccgtgcccagccggaatcattagaaatgacttctaagttactgagaattcagggtgtcaaatttgcagaaccgtatgctcagtaaaccccagaatgtttgcagcagaattttattttatttattattattattttgagacgaagtctcgtcctgtcgcccaggctggagtgcagtggcgtgatcttggctcactgcagtctgtgtctcccgggctcaagcaattctcctgcctcagcctcccaaatagtggcgactacaggcgtgtgccaccatgcctggctaatttttgtatttttagtagagatggggtttcactatgttggccaggctggtcttgaactcctgacctcaagtgatccacccaccttgggctcccaaagtgctgggattacaggcgtgagccactgcgcccggcccagaatgttagcagcagaattttagcattgtgggctgtccacgctgagtggggcttagcatttcaccaatgaggaaacaggcctcgagaaggcaagaaaacaccttcggctgagctgtgtgaaggtgacttgaccgcagcctgagctttttctccacccctcctctcatgggtactgttggggaggatgggtgccacaggaccacacaggtggctgtctgagagggtagtgcctgggaactttctggaagcctgtttggggaagcagatggggtgaaggattcagttagtgtatgtggggtcgtgacaccatctacccactgtctctctcctgccttcatcatcctctagaaatacagcaacaattcctggcgatacctcagcaaccggctgctggcacccagcgactcgccagagtggttatcttttgatgtcaccggagttgtgcggcagtggttgagccgtggaggtgaggattacttgtgtgtcccacccctgtttctccctggggtccaccccattgtttgtcctggggtcactttgcctaggacccctctccgccccatactggtgtgaaagtgctgagacctggctcccctctgtggcatggaaacctgagtgattggctaatctgtttcctgagcacctctctgccctgccctgtgatgggtgatgccaaggacacagcaatgaccaaaacagccccatccttgccctcacagagctcatatagtccattggctaggtagctggggaacagacctgtaaggcagtgatgacccagagtgggtgggactgggatggggagcccaaaggaggtacctgacccagcccagaatcagggagggcttcctggaggaggggcaccatagctgatgttgaagggatgagtagaatggtcaggaaaaggagaggtgtaagagtattctggggctgggcatggtggcttatgcctataatcccagcacttttgaaggccaaggaggatggatcactggagctcaggagttttgagagcagcctgggcaacatggcgaaacccggtctctacacaaaaatacaaaaattagccatgcatgctgttacgtgcctgtagttccagctgcttgggagactgaggtgggagaatcacctgagcctgggaggtcgaggctgcagtgagtcataatcacactactgcaatccagcctacatgaaagagtgagatcccatctcaaaaaaaaaaaaaaaaaaaagattccaggcaaagggaacagcctgtgcaaaggcctggaggccagggagagcctaactaactcatttgatctgtccaggagatgattgtctctgtctggtttctggcagggcccatggtgcccctatctctctccctcacctccctctcatttatgcttttattcaataattgcccacaggttcctgctgtgtgcctggccatgtgctgggtggtgtgggggacatagtgataaccaagacagccctcagttctgccctcatggggcccacagtcacttctggacacctaagagatcttgtcaaggccccaccaggcaggaatgacctagaatgatcaagaatgggatggggaggcaccagcagggaggacaaggctgggacagggaggcatgcaggatgggggaacgccctaagtgctgttgggagcccagagaaggcacctggacccatctggggagtctaggagggcttgctgggtgagggtgattgtgtggagactcacaggataaatagtagtttggccacatgaaaaaaaagggattagggggcctggcatggtggctcacgcctgtaatcccagcactttgagaggccgaggtgggtggatcacctgagatcgggagttcgagaccagcctgaccaacatggagaaaccccgtctctactaaaaatacataattagctcggcgtggtgatgcatgcctgtaatcccagctactcgggaggctgaggcaggagaattgcttgaacccaggaggtggaggtttcagtgagccaagatcgtgccattgcactccagcctgggcaacaacagtgaaactccgtctcaaaaaaaaaaaagaaaagaaaaagaaaaaatagggattagggagcaggtgggcactgggaggagtgtcctgggctgttcgacaaaggcctagaaggagctcatctgtcttggtcaatgctgagtcccaagcacacagcacaggcttcggcacattgtaggagcctagaaaacatcattcactcattcattcaagagattgatgctggctgggtgcagtggctcatgcctgtaatcccagcacttcgggaggccagggcaggaggattgcttgagcccagcctgggcaacatagtgagacctctgtctctacagagaatttaaaaagtagccgtgtaggccggatgcagtggctcaagcctgtaatcccagcactttgggatgccaaggcaggcggatcacctgaggtcaggagtttgagaccagcctggccagcatggtgaaaccccatctctactaaaaatacaaaaaattagccgggtgtggtggcgcatgcctgttatcccagctacttgggaggctgaggcaggagaatcgtttgaacctgggaggtggaggttgcagtgagctgatatcacgccactgaactccagcctgggcaacagagccagactccatctcaaaaaaaaaaaaaaaattagccatgcgtggtagcacgcgcctgtggtcccagctactcgggaggctgagatgggaggattgcttgggccttggagattgaggctgcgagaccttgtctcaaaaaaaaaaaaaaaaaaaaaaagagagagctgcagtgagagggcagagtggggtgggtgggggaggcaggaaggaagcccctggggtttgctccttccttcctcttcctccaggggctgggtgagctgcactctcagactggcttccctctcgccactcctacaggggaaattgagggctttcgccttagcgcccactgctcctgtgacagcagggataacacactgcaagtggacatcaacggtgaggcctgcttccccggccatgcccagttgtgacgtgtgtgcgtgtgtgtgttcccatctgccccacgccccacttatctatccctctgagagtgtgtgtgtatgtcccctatcccctgactcccacaccaaagcagggttcactaccggccgccgaggtgacctggccaccattcatggcatgaaccggcctttcctgcttctcatggccaccccgctggagagggcccagcatctgcaaagctcccggcaccgccgagccctggacaccaactattgcttcaggtgagccttgtagcctggatggaggccttccaggctgggggcatgactgccatctgctgaccaggtgctccaggttggacacctggctgctgctgtgcttgggctgagcatctgtctcctttagcttggagggctcaggggatgaggtctgggtgtaagaaccaggagtcttgtgccaggtgcggtggctcacgcctgtaatcccaacactttgggaggctgaggcaggtggatcacctgaagtgaggagtttgagacctgtctggccaacatggtgaaacccgtctctactaaaaatccaaaaattagccaggcgtggtgggcgcctataatcccagccacaaaaaacaaaaaaagaactgggagtcttgtaatgttgggatcaggttcctttttttttttttttttttttttttgagacagagtctcgctctgtcacctgggctggagtgcagtggcgctatcttgattcactgcaagctccacctcccgggttcacacgattctcctgtctcagcctcccgagtagctaggactacaggcacgtgccaccacgcccagctaatttttttgtatttttagtagagatggggtttcactgtgttagccaggatggtctccatctcctgacctcgtgatacacccacctcagcctcccaaagtgctgggattacaggcgtgagccaacgcgcccggcctaattttttgtatctttagtagagactgggtttcaccatgttagccaggatggtcttgatctcctgacctcgtgatccgcctgcctcagcctcccgaagtgctgggattacaggtgtgagccaccacgcccagccttgctttcttgctggagtgttggaatcacagaatgttagaaagttgaaccctgtgattgttggaattcaaagttggaaggtcaccatcttgaatccctaaattgttggcaggttgaggttctagaatgctgggattctagaatgctagaatttggtgttaattactgaaatggaaaatgtcggactcaaggaaagctgaaacattggaatcctagaatttggggattcaaaatgggaagatggcccatgtggaattcctgcaccactggccaattgtggataccagtgttggcagattggagtccttgaatattgggctcacagtggtagaattctgttttgaaatattcacatccacaaatgttggagttggagaaagcagaatattggtatctcagcatgttggaactcagtgttggaatgttagaatattagaatgctgggattttattaatagaaagtggcagcaggctgggcgcggtggctcacgcctataattccagcactttgggaggctgaggtgggcggatccctgaggtctggagttcaagaccagcctggccaacatggtgaaaccccatctctattaaaaatacaaaaattagccaggtgtggtggctggcacctgtaatcccagctactcggctgggattacggctatccaggtacccaggctggggcaggagaatcactggaacctcgggggtggaggttgcagtgaaccgagatcgcgccactgcactccggcctgggcaatgatgcgagactccatctaaaaaaaaaaaaaaaaaaaaaaaagaaagaaagtgtcagtttgaacctcttgagtgatggctcagaactttggaatgttgggatgcaatactggcatactggaattcaggaatgccaagatcctcaaaggttggaaagggggaatcctagagagttgaagatgctgtcagaatgttagaatcataagatgctggaatgctaatactgcaatctaagaaagctgaaatgttggattcctagaaagttgaaatggagagttagaatgttgtaaatttagagtgatcatctgaccttattcctcccttgcttaaaatattttggtcctgtctctgggctttgttaccggctgtttccctgccagaaaatcagccctgctcccaggctccttcaccaccagatcttagcgccatcagcccagcaacgctgtcaatgaacaaattgaggtcttttttgagacagagtctcgctctgttgcccaggctggagtgcagtggcgtgatctcggctcactgcaacctccgcctcccaggttcaagtgattctcctgcctcagcctcctgagtagctgggattacaggcgtgtgccaccacacccggctaatttttggtttttttagtagacactgggtttcaccatgttggtcaggctggtctcgaactcctgacctcgtgatccacccgcctcggcctcccaaagtgctgggattacaggcatgaaccactgcgcccggccacaaattgaggtcttgagtgccaacagctcctgacattacaaagggagatagccagccatgtcagcctccgtagggagggacccaatgttgcctaggaagtcttggcaaaaaatcaaacctgaaggccaggtgcggtggctcatgcctgtaatcccagcactttgggaggccaaggcaggcagatcgcttgagcttaggagttcaagaccagcttgtgcaacatgttaaaaccctgcctctgtacaagaaatacaaaaaaactagctggctgggtggtgtgtgcctgtagtcccagctacttgggaggctgaggcaggagtgcttgagcctaggaggttgtggctgcagtcagccaggatcacgccactgcatttcaggacagagcaggaccttgtctcaggaaaaaaaaaaaaaaatcaaacctgaatctgatcaggactgtagatcctaacagttttctagaaagacaggaacagaggaaatggtcagcaaaactcagactgcaagaaacctcacccagtttcttcatcaaatacaatgcaaagaaggggaaagcacacacacacacacacgtaccccccatgcaaccaaaaattcacatacaagttttgactccccaaaaacttaactattaatagcctactgtggactggaattctgctttatccacaacataaacagttgattaatacttttttttttttttggagacagagtctctgtcattcaggctggagtgcagtggtgcggtctcggctcactgcagcttctgcctcccgggttcaagtgattctcttgcttcagcctcccgagtagctgggaccacaggtgcccaccgccacgcccagctaattttttgtattttagtagagatggggtttcaccgtattgcccaggctggtcttgaactcctgaggtcaggcaatccgcccacctcagcctcccaaagtgctaggattacaggcatgagccactgctcccggccgaataatacatattttgcatgttttatgtattatgtcctatatcccctttttttttttttgagacggagtttcgctgttgtcactcaggctggagtgtaatggcacaatctcagctcacggcaacctccacctcccgggggttcaagcaattctcctgcttcagcctcctgagtagttgggattataggcacctgccaccatgcccggctaacttttgtatttttagtagaggtggggtttcaccatgttggccaggctggtcttgaactcctgacctcaagtgatctacccgcctcagcctcccaaagtgctgggattgcaggggtgagccacgcacccggccgtattctttgtttttttttttgagacagagtctagctgtgtcacccaggctggagtgcagtgaagtgatctcagctcactgcaacctccgcctcccaggttcaagcaattctcctgcctcagtctcccaaatagctgtgatttcaggcatccgccatcgcacccgggtaatttttgtatttttagtagagacggggtttcaccatgttggccaggctggtcttgaactcctgacctcaggtgatccatcagcctcggcctcccaaagtgctggccttacaggcttgaaccactgctcccggcctatgcctgcattttaaaaataagatagagaaaagaaaatgtccttaagaaaatcataaggaagaggaagtatattttccattcattgagtggaagtggcttatcataaaggtcttcatgttgagtaggctgaggaggaggaagaaaaggtgttggtcttgctgtctcagggcagaggtggaagaaaaattcacctgtaagtggtgaattttgtaagaggacccatgtagttcaaacccatgtccaagggtcagtctatatatagttgaccctgaatatatatacagagagagagagagatgattttgtagattttgaaaaaagtcctaagagaggccaggtatggtagctcacacccgtaatcccagcactttgggaggctgaggcaggtggatcacttgaggtcaggagttggagaccagcctggccaacatggtgaaaccctgtctgtactaaaaatacaaaaatcaggccagctgtcgtggctcacacctgtaatcccagcactttgggaggccaaggtgggtggaccacctgaggtcaggagttcgagaccagtctggccaacgtggtgaaacctcctctctactaaaaattcaaaaatgagccaggcgtggtggcgggccctgtaatcccagctactcttgaggctgaggcaggagaactgcttgaacccaggaagtggaggttgcagtgagccgaggtcgcgccattgcactccagcctgggcaacaagagtgagactcccgtctcaaaaaaataaataaataattaaaaatacaaaaattagcagggtatggtggcaggcgcctgtagtcttagctacttgggagactgaggcaggagaatcacttgaacctgggaggcacaggttgcagtgacccgagattgcaccacttcactgcatcctgggtgacagagtgagactccatctcaaaaattaaaaaaaaaaaaaaatcctaagagacatatcaaccaattgcaatgtgtagaccttacttgaatccttatttacacaggcttaaaaaaaaaagatatttatgagacagttgggtaaatgtgaactctgtctagatattcctctagatatcaaggaattgttaattttcttacatggtattgtgactgtgttttaaagtagtcttaattagagatacatttgaaatatttatggatgaagcaacacggtggattgcatgtgctttgagataaaccattgtcggctggctgcagtggctcacagctataatcccaccactttgggaggccaaggcaggaggattgcttgagcctaagagttggagaccagcctgggcaatatggtgaaaccccatctcccaaaaaaaaaaatatgaaaagtagctgggcctggtggtgtgtaccttttgtcccagctactcaggaggctgaggtgggaggttggcttgagccccaggagctggaggccacagtgagctgtgattgcaccactgcactccagcctgggtgacagagtgagatcctgtctcaaaaaaaaaaaaaaaagagatagtggataggggtagagatgcaatggaaattggccatgagttggtcattgttgaagctgcttttgtgtacatctgaaactttccagctggacgcggtggctcacacctgtaatcccagcactttggaaggctgaggcgggtggatcacatgaggtcaggagttcgagaccagcctgtccaacatggtgaaaccctgtctctactaaaaatacagaaaaattagctgggtatggtggtgtgtgcctgtaatcccagctacttgggaggctgagccaggagaattgcttgaacttgggacatggaggttgcagtgagccaagattgcaccactgcactccagcctggggcaacagagcaagactccatctcaaaaaaaaaaaaaaaaaactttcataggaaaatttgttcttaaggcagctcgaacactacctccttcctaacccctttctccaacatccaagatggatgtgaggcctctgggctcccctggggccctaagtagatctttgactcaacaaacagtctctgttgggtcttttatttataaaaagttttgtagcgacagggtctcactatgctccccaggctggtcttaaactccttgggctcaagcgattcaccggtcttggcttcccaaagtgctgagattacaggcgtgagtcactgcacctggcctaggtcttgagagactggacggaagaggcttggcaagggcaagggctgtgggtatcccaaggcccggtgcagggtaggccccgaatgtgtgctgaaaaaatgagtcagaggatcacctagacggcttgttcaacacggactgttgttcccagtcctgcacacaatttctgatttcagtggcctggggtgccacctgagaatctgcatttcccatagttcccaggtgatgctgccgctggtcctgggagctcacgtggagagctgctgacttggataacagtatcacagattgttcaaatcctaggatctcagaaccccagctagggttgaactgcatattaaagatgattctgagccgggtgcggtggctcatgcctgtaatcccagcactttgggaggccgaggtgggtgggtcacctgaggtcaggagtttgagaccagcctgaccaacatggtgaaacccagcctctactaaaaatacaaaaaattagccaggcatggtggcacatgcctgtaatcccaggtacttgagaggctgaggcaggagaattgcttgaacccgggagacggaggttgcagtgagctgagatcacaccatcgcactccagcctgggcaacaggagggaaactccatctcaaaaaaaaaaaaagattccggacactagttcttccccttttgtgagttcagaacttcctgtgagaaagtgaaagccaggactctttttcccagaaatacatgcatacatacacacatgtgcatatgatctcaggcactcatggccctccctaagcctgcccatgatggccccttggccctcagcttaacaccttattttatctagtagctcctacctctgaacagatgaggaaactgaggtccaaccaaattgggtggtacgggctgagttcacagggatctcagtttcttgacttccttctcaggcttctgtggctcttggaaaggctttatcttgcctctaggttatccggtgccacttgaagttgggttcaagcgattctcctgcctcagactccccagtagctgggattacaggtgcccgccaccaggtccagctaatttttgaatttttagtaaagacagggtcctcaagtctgcctgccctagcctcccaaagtgccgggatgacaggcgtgagccaccgtgcctggctggccccaccaatctatgagcagaggttgcagtgagccaagattgcaccactgcactccagcctgggtgacggagcaagactctgtctcaaaaaaaaaaaaaaaaaaaaaaggcattgtcaactttttcttttcttttctttcttttttcttttcttttcaagacagagtctcaccctgttgccctgggtggagtgcagtggcacgatcttggctcactgcaacctctgcttcttgggttcaagcagattcttgtgcctcagcctcctgagtagctgggattacagacaagcaccgccacacccagctaatttttgtatttttagtagagacggggtttcgccatgttggtcaggctggtctcaatctcctgatctcaggtgatccacccgccttggcctcccaaagtgctgggattacaggcgtgagccactgcacccggcctctttgacagttctaagaagtaaaataaaccagaagaaggcaggcagagagtaatagatattgggaactgttatttttcctattctgatttaaattcctttattatggaaaatttcaaatgtatacaaaagcaatgaagataatgaatgcccgtaaactctcatccagcgtcatcggtaattaagattttgccccatttcaaatgcagacatttttatattttcttgcataactgcaataccgtattgcactaaatggaactaacagtcacttggatattttggaaaggatggctcagaaaggtatctctgaggaggtgatgttcagtcatgtaactgatatttactagtacctactgcattccagacactgctttaggagttaagggtccctgagtgaaggacatttgagctaaggtttaaatgaagtgaaggggccaggtgtggtggctcatgccagtaatcccaatgctttgggaggccgaggcgtgcggatcgtttgagcccaagttcgacaccagcctcagcaacatagtgagaccgtgtctctaaaaagaataacaaattaaaaagaataaataggccagatgcagtggctcaggtctgtaataccagcactttgggaggctgaggtgggcggatcacaaggtcaggagttcgagaccagcctggccaacatggtgaaaccctgtctctactaaaaagacaaaaaaattagccgggcatggtggcacacgcctgtaatcccagctactcggaaggctgaggcaggagaatcgcttgaacctgggaggcggaggttgcagtgagccgagatcatgccactgcactccagcctggcagacagagtgagactctgtctcaaaaaaaaaaaaaaaaaaaaatagaaaaaaaaagaagaaatgaagtgaaggaacaagctggagtgggtatctgtgggactagcaaggcaggcagagggaacagcagatgcaggagccccgaaataagactgtctgaggaacagacaggacgccagtgtggctggagtggagtaggcgtgagagagggagttgagatcagccagatttgatagcaccttgtggctcacggtgaggacttgggcatttgccgtgagatggagccaggttcagagcagaggagtgacaagacaatttatagcatgcccatggagggcagagatttctgtctcttttttaaaaaaattgaaaaaaaattttgtagagacagggtcttgcactttgttgtccaggctggcatgcagtggtgttatcatagttcactgcaacctcgaactcctcgactccagcgatcctcccacttcatcctcccaaagtgctgggattaaaggtgtgagccaccatgcctagcctatttctatctgtttcatttgtcctcagtccacagtagatcccagcccagcacacagtagtagttcaataaacatttgttgcacaaatagagcagatcagtttacatggagctgtgttattttgtatgttccagggtgtggcatgccatgatttatttagcccccccgtggatggtcatctggcttcttacaggcttgtcttaagcattgcgtgaaattaattattacattgctcttagcactggaggaagtgcttaatctgtgttagtgattatcatgactatttgtgttgttattaacacagtgggtgcaagggagacccagatggagatagggctgggggggcaacctagggtgacacacgcacctggggaggaggggcatgtggcttctatggtggtagcccctccctgcccctgacgcgtctctcctgcctgcagctccacggagaagaactgctgcgtgcggcagctgtacattgacttccgcaaggacctcggctggaagtggatccacgagcccaagggctaccatgccaacttctgcctcgggccctgcccctacatttggagcctggacacgcagtacagcaaggtacgtctggcccaccgggctacgagatgcgcttggggggagccaggacggaggaagaggagagagaaagagaagtaaagtcagagaggtgagttggcaggatggggagaaagagagggatggggtggggaggggaatgaataaagagatggggagagaggcaggaagctagagaggggctctgagcaggggccagagggagatgagctatgaagacccacagagtgaagtaacagagggatgggggtgaaggggagaagagagacagggagatggaaggaaaaacgcagaaatggagagacaaaatgagagagacagatacagacacagagttaggccaaggagagacaaagacagatacacaacaaggcaagaggcgaagatgaggagggacagagactgagaaagaaaatcaggcgggcgcggcggctcacgatggtaataccaacactttgggacgctgaagcaggaggatcgcttgagcccaggagttcgagagtagcccaggcagcagactgagatcccatctctaccaaaaaaaaaaaaaaaaaaaaaaaaaaagctaggagtggtggcgcttgcctgtggttggagctactccggaggctgaggcgggaggatggcttgcgctcaggaggttgaggctgcagcgagccatgatcgtgccactatactccagcctgggtggcagagcgagacccagtctcaaaacaaaaagaaaatcagacaggtggggagagacagaataagataggatgttagaagataagagagaccgaattggagatgggaagaggggatgcggggagagacgaagtgagagaggctggcgcggtagcgggtgggggatggggcagtggagggccgttttcctccctccacgagccctgagccctgaccccgcccgccgcccgcaggtcctggccctgtacaaccagcataacccgggcgcctcggcggcgccgtgctgcgtgccgcaggcgctggagccgctgcccatcgtgtactacgtgggccgcaagcccaaggtggagcagctgtccaacatgatcgtgcgctcctgcaagtgcagctgaggtcccgccccgccccgccccgccccggcaggcccggccccaccccgccccgcccccgctgccttgcccatgggggctgtatttaaggacacccgtgccccaagcccacctggggccccattaaagatggagagaggactgcggatctctgtgtcattgggcgcctgcctggggtctccatccctgacgttcccccactcccactccctctctctccctctctgcctcctcctgcctgtctgcactattcctttgcccggcatcaaggcacaggggaccagtggggaacactactgtagttagatctatttattgagcaccttgggcactgttgaagtgccttacattaatgaactcattcagtcaccatagcaacactctgagatgcagggactctgataacacccattttaaaggtgaggaaacaagcccagagaggttaagggaggagttcctgcccaccaggaacctgctttagtgggggatagtgaagaagacaataaaagatagtagttcaggccaggcggggtggctcacgcctgtaatcctagcacttttgggaggcagagatgggaggattacttgaatccaggcatttgagaccagcctgggtaacatagtgagaccctatctctacaaaacacttttaaaaaatgtacacctgtggtcccagctactctggaggctaaggtgggaggatcacttgatcctgggaggtcaaggctgcag

SEQ ID NO: 61531 - DNA, 32240 bp, Homo sapiens
gggcggggcgggaggcggggcccggcccgttaagaagagcgtggccggccgcggccaccgctggccccagggaaagccgagcggccaccgagccggcagagacccaccgagcggcggcggagggagcagcgccggggcgcacgagggcaccatggcccagacgcccgccttcgacaagcccaaagtgagcgcgcgcgggggctccggggacgggggtccggcgcctgggcggcccgaggggcttagcggggcccagcccggggcgtccaaaccctgggaacgaacgggggctcctgcaggcgagttcttccttcggcttaggccgtggcttgcttgcgggctaatcagggacaatggggcagagaaggtccagaacccggaggcctccagagtctgcttctgcccctgacttgacccctctgggtctcagtttcgctgtctgtcaagtgggcatcctagcaccgctgagcgctgtgtgggcctgggcagggacttgaggtctctgaagctcagctgtatgatcaggcccgatgtctacgccggataggcacctagtgctgtgcccggcgcctactgagtgctcagtgaatggaagcagctttgtacgccagcgttatggtggtgagcgccaaggagctcaggtttgtggatgcgccccggggaagaaccgtgagccctgccagaaaggggagggaggggagcagagcaccccccttcccccgcgcgggaagaacaggagctaggtaggccctgggtttggggccctagcagggttcactcgaggccaagccatggccactggccccaggggagaatccccttgtttctccgcccaccagctgtggcgtcttgggactgttggggtcagggagggtctggacccccttggcctgtcgcagagtccgagaggaggggcccaggagtctgccaagcagggtgagtcagccagtagggtgtgagagtggttggggaaggagtcagctgcagtcagcctcaacttacccttctaagaaataggtgtgagtggcccaggaggttggctcacgcctgtaatcccagcactttgtgaggctgaggcgggaggatcatttgagtccaggagtttgagactagcctggacaacaaaactagaccccgtctctccaaaaaataaaaaaagttaggggaagtgtgtgtggtggtgcactcccgtagtcccagctactcaggaggctgaggcgggaggatcgcttgagcccaggaggttgaggctgcagtgaggtgtgatggtgccactgcacttcagcctgggagacagagcgagaccctgtctcaaaaaaaagagaagaaaaagaaaagaaaagaaataggtgtgaatgatgatgacagctatcacaaaagtgccggtgagaatccagtgagtgtgcatgtgtcagtgagggagacaggctgtggagagcccacctaccttctgaggagggtgaggcctggcccccactactgatgcccccagcccagggaaaatgctcagctactccccgtcagaagctggaagcactgaggtgctgtacaagccctcctacccccacccctgcctccttcacgtcttactggagctggggcccatgattggcgcctcccctttgcagtctttttattaaatgctctgggctccctctgcccttgggctggggacccactgtaccctgatgtgaatcctatggcaatagcaaagctctttgattggcggggtgcagtggctcacgcctataatcccagcactttgggaggcaaaggtgggtggatcatgaggccaggagttcgagaccagcctggccaacatggcaaaaccccatttctactaaaaatataaaaaattagctgggcatggtggcgggcgcctgtagtcccagctacgcagaaggctgaggcaggagaatggcataaacccaggaggtggagcttgcagtgagccgagatctcgccattgcactccagcctgggtgacagagtgagacgctgtctcaaaaaaaaaaaaaaaaaaaaaaaggctccttgattgcgaacatgttgggagttatggagagaacagcagggcccacttctagagcacttgttgcagacacccattggatccttgcagttcttctgtaacagcccatcaagggaggggctcatattattatccccattttttggccttgctcagtcctcccatctgattcaagctggcagatcattttccctattgggacctcagtgtccacacctggaggatggaacatcagctgcttatgtgggtgtcccgtgtcctgagtcccaaggccacaaggtgatgcttgagagtgaaggtagaatgttacctgccatgtgtttgaggcgtgacaaatcttgtatgattgtgaggaggaacttgtgtgagctggcaggagaagtgggaaggagtgtgaatctcagagccactgtgaccagagccagctccctgccctcttgtgggagggacagatgacagttataattattagcattactagctgcagctaatggagtgttgatgtttctgtgccaggcaccgttctaaacacattatctgcattttttatttaatccaggcacagagaggttaactaggcccaagatcacacagctaggaaatgtccaatctggggtttgagtccaagggaggctggcttcgaaatcccatgcctctaaccatctttcctaaactacctctgcagaagcctttggggatagaggtgccagtgccccaggtgcaaacctcctgagacaggagcctttgctgtgtccttcagcttctcatacctgccaccagctgaggcctgggacctggtcagctagaagaaagcagagcagggcagcgcttttcaaactgcactcaagtggcctgacttttaatgttcacactgtgattctgtgtgggtcgggttggggcctgcgatgctgcactgctgaccagctcccaggaaatgctaatgtcaacgatccaggaacacactttgcttagcaaggccctaggcagctgccttctgttgtgcgggacccctattgactccaatggatatagcaccaggttcaagaggctaccttctttggaagaggtagcaaacaagatacggggttttactgggggcttagacacagggaagagagtccagtggcggcagactgagcagaagaaccgcaaccacttgcaaatcatgcagtttatgtagcattttcatttaacaccttctcccaaccatctccacctagtaaccttcatttaacccaaaacaaagggcctcggtccctatacccctgtatggtcagtgtcccgtgggaatggggtggggctcagatgttcctcatagataacgactggatctccaggttggccactcttggattccttcgctcagaactctgaacacccattcaagtgtgcctgccatgcagggtcatcgtcaggggatgcccaagtcaagtttgccctgtcgggtgtgcctcccatacccccacctggtttgacttagcacctgctgggcactggaagaagtggaaaggggggttgcaggggtggcccttatcagcctatgttcacaggtggcaccaggcactcaggcattctgcatcctggaggccagtgctgatcacatgcctgttacaataatcataacaatagctgtccttgaagtagtcctgggtaccaggtgccttcagtgactttttcttttttgccagaatctcactctgtcgcccaagctggagtgcagtggcaagattttgggtccctgcaacctctgcctcctgggttcatgcgatcctcctgcctcagcctcccaagtagctgggactacaggcgtgtgccgcagtctcactctgttgcccaggctggagtgcagtggtgtgatcctggctcactacaacctccacctcccgagttcaagccattcttctgcctcagcctccggagtagctgggattacaggcgtccaccaccacgcccggctaatttttgtatttttagtagagacagggtttcaccacgttagccagctggtctcgaactcctgatctcaggtgatcctcccaccttggcttcccaaagcgctgggattacaggtgtgagccactgtgcccggctagtaacttttatctcacggaatcctctggacgacttgacaaggcatgggtcttcatccccatttacagatgaagaaactgaagcttagggagtggagggacttgccagggctacacaaaatctgagagccttgaagctgtagactggcaagtgaacaggtacaggctgggacagcagtttctttctttttttctttttttagacagagtttcgctcttgttgcccaggctggagtgcaatggcacgacctcggctcactgcaaccttcgcctcccaggttcaagtgattcttctgcctcagcctcccaagtagctggaattacaggcatgcaccaccatgcccggctaattttttgtatttttagtagagacggggtttctccttgttggccaggctggtctcgaactcccgacttcaggtgatccgcccacctcagcctcccaaagtgccgggattacaggcatgagccaccgcacccggccaagggacagcagtttctaaactgtccctctctgatgcagaggggaattggggctaaatcagcaatgtgccttttctgtctcatatttgaatgtctactctgcacgaggcgctgtcctgctttgcatacagtgactcatttaatgtttatgtcagccctctgaggaaggtcctgtcctattattaacttcacttattatgaggaaactgagactcagagaggggagggaacttgccaaagtcacacagctggcaagcagcagagctagacttgaacccagatctgcctgcactcaagtagaagctgttcattgctttgctcatttgccaattccactttatgcaaaaaagagggggcagtgtggggggaagagttagaatcagggtggcagggtgggccagtgcattagccctgggcttcagatgtactggggttgaattcctgcctgccgcttagcagctagggtacctcaggtagacaactcctgaaactcagcttccccctctgtaaaatggggtgacaaaaccaagatcttggggttcttggggaaactgacatgctgattggtttttgtacagtgcctggctggtaacagcaggccctcaggggtgcgtttccttcctggggactggagtgggggttgcagtagactctgggaggcctctccagctgcagaatctccctcctccctcctcctttttgtcttcctgacacaaaacccaccagctgcacttctttgggcttgcagtggctttcagttaccagagccacctgttaaaacaaaaatgtgcctaggaagagcctgccttacccattttgactcacatggcagttggtggtggaggggaacaaaggagactgagtttcatcgaagccttttgcttcggaggaggaagggaggatcagagagaggaagtggtctgtgttcacacagggaggcaggggaggccaggcagcttcccaatcctgcattcaacctcagggtgggcttgacctgggtggctgggggccctgtgatccaggagagacttgtccacctgctcaggtgtcttgaaggggtccctgtggtaccccctggggcggggcaaggtagtaggaccatggtctggctggggaggtggagaggagcaggctgtgggcgcagagtgaggttggaatctgtatttacccaaggtgttgggggtaggcttgccctcagcccttaatgttctcaggcccctgagcagttgtgggggataacctctgcactcctagtgaccagggagctagaacagcaaggaatttgaacttggacaccagctggggtcaggctctctgggtctgagtcctgatttcccactttccagctagaggagcttgaatgagtcatttaacttcacggtgcctcagtttcccctctctaaaatgagaattatacccatacccacctctcaaacaccaagtgcaggcctggctcagagcaggtgctgcagcaatagctgccattggtcagcatcatcatcatggttggtaatggtcctactttgacttttgagacagagtctcactctgtcgcccaggctggagtgcagtggtgcaatctcggctcactacaacctctgcctcccgggttcaagtgattcttctgcctcagtctcccaagtagttgggattacaggtgtgcgccaccatgcctggctaatttttgtgtttttagtagagacagggtttcaccatgttggccataacaatggctgtccttgaagtagtcctgggtaccaggtgacttcagtgactttttttttttttttttttttgagctggagtcttcctctgtcacccaagctggagtgcagtggcacgattttggctcactgcaacctctgcctcctgggttcatgcgatcctcctgcctcagcctcccaagtagctgggacttgggatacacttgcccccgctggtcctcccttccacctctgtgaagaggaggtctcaaactcctggcctcaagtgatccacccacctcagcctcccaaagtgctgggatttcaagagtgagccaccgcacctggcccctgtttagatgttagcatcagtgacccagcaccttgctatgtggcatgcagggagcgtgctgctagacctccgggtttagagtcaaatagcttcctggctgtggtatgcattagactttctaactcaaggtcctcccactctctgagcctcagtcttgttgcctttaaaacgagtttaagtgtgctgagtccctatgctgtggctccacaggaatttccccaggtggaagacacatcttgccttctgtgaaacctctcagcagcagagctgtcaggccccgtcagcaggagacactgtggggactgctcagtcccttccactgtgtacctcggagctggcggagcctagatgaggctgagcatagagggcttcctggaggaagtggagctgaaacagtttctcagcccagggctgctctgtctcctggcctcacactaaaagtcagttgagaggccatagtggcataagtcactgaccctggcactgcccagctcatcaccaaaagcagggctagggagggaggggacattcgattggcagtgggcacctgtggctcatctgggttctggccacggtgctcaggttctgtgagctgaccaggcagccctggctcctctgcccccgtgtgggttctgccaggtcccatgggggcaggtcagccccttccttgttgcagggagagcacccagcattgctgacatgggacagggaaacgaggaaataacggtgtggtcattgaacacagagagcactaggtgctgtgcgaggtgctgaggacacgacatgatgacacagacaaggtcccccctctcagcaaacggctcatgagggagacagacatgttacatacatgaacccaaaaagtcagacgaaaacaaaacagagcgatgtgtttgggaggcaaacccaactgccggaggcgagcagggcgtctacctccaaggtaaacccagtcagattagttgtccccaaggctcaccagggagaactaatctgactaggtttgccttggaggtagacggccctgctcgccctccagcagttgggaacgtggaaacatgagtcagatctgggagtatctgtcccaggagtccaagacctgggtcctcatggtagctctgccaccgacacactgagtgaccttgggtaagtgaacccaccgccctggacctctctggcacgcatctcttgagagcagggacttagtgcatttcccgagggcctccacggtgcctggcacatagtggggcttagtaaatatttgttggtaactgaggatgcttcctgttcacatcagcgctgggaggatttcctgctgttcagacaaatgctgggctggctgtgagtcagccttgcagagagcaaaggcagtgggaaggggcgtgagattcccctctggagaggtcaggaggccaggcactgtctcgacatgagtgccagggagggggtgtggcctgtgggcagggcttgggctgaggcagagggacttgagttccaccctagctctaccaccatcaattttgtgtaactctggacaggccactgaacttctccgggcttagcctggcaagtccatttccccatctgtaacatgggccgatatgtacattgcctagggattaaatgagataaagggtctgaaaacagtaggtagctgctttatcattattattatttctgtattattgatgtctgaggctaggcccacagaggcagtacagtagagtggttaggagctcaagaatcagactagggttcaaattctgactccatcactgactgttttggggtacttctttgaacctcagtttcttcatcagtaaaatgggagtgaagtctctaccttgctggttgtaaggatgaaataagataatgcatatagatggtctagcacatagtagatactcaaaagtttgaggccactgctgacccttttccctgaaaggagacaggagagcggggtcgccaccccattgtcattgtcatctggaataggctgacagacttcccatggtgtgttgcagttttctagaaaattcagtaggaggcctgcctgagcttgagccacctgtggaggtggcttcctgcctctgctccacacctgaaacgcgtctgggcctcttctcaggcagccgtgagaagggatgagtgctactggtcatggtgggcagctggctctgctttcccccttcccagaggcgctcctgcctcctgcccagctccctgaacccctagcttctgcaccccggcactgtctggcttctgccccgctgagcacccactgtctctgacgctgccttgagtacttcccgcatgttattcaaatcccaatcagatcttccctcccgcagtagctggtcttctgttctggcttcctgccatcctgtcctccacacagcagccgggaaaggtttttttaaaggggactctccgatttaacacacttgggtggaaaaccctttgcttcggcctctgcaatctccctgccccctctccactttgccctggcctcatttctcaccactaacctcactctgcactctggccaactccccgcctgcttcctgattcagacactaagcacacgcagctcccctgcctggagccattctccctctccttctttcttctccctggcgaactccccctttaagtgatcttttcccaacacactttctaaattgcccccaccccagtgtgatttttctttatctcatagcacttggtctgcttcttatcacagtttgcaaggctgagttcagaaaggtgtgtttgctcattctgaggcaggagaggctaccttgtgctgctgtggtaacaaacagcccccaggtctgaggggtctgcagagacccaggttgacctcatactgcttgtccctccagggcctccagtgaggtttcggctccttggatcactcagggccccaggcagatgggaagattccactctgaacattgccaattgttgtgccagagtaaagcagagctgggaggtgggctcttgaattggcatttaaatacttttgccaggcagggtaaggcagctcacgcctgtaatcataacactttgggaggcctaggtgggtggatcacctgaggtcaggagttcaaaaccagcctggccaacatggtgaaaccctgtctctactaaaagtacaaaaattagccgggcatggtggtgggcgcctgtaatcccagctacttgggaggctgaggcacgagaatcccttgaacctgggaggcagaggctgcaatgagctgagatcttgccactgcactccagcctgggcaacagagccagactccatctcaaaaaaaaaaaaacaacaacaacaaataaataaatgaataaatactttagccagaagtagccatgcagacctccccccaccagtcccacccacaagcggacgtgactaccgcccccattcactgcctgatcctcctgttctcaggggctccaaggccaggcctggtttgaccttctgactttctgacttcctcctaccttcccagtaacctcatgcaactcctttcactcagcctcaatcatccccatgggtgtttaaacttgcccaagacatgcccctttgaaaaagcctgccattctcttgacccacatgcacgtcctgccccctccaaggctgctagttcctttaggggcaaaattgtgaaagagtagtctaaaccttcttcctcttcttacctccacttctttcttaccttattcccatgtggattctaccctcactcaggcctctagaacggttcctctacggcagtggttcccaatcttgactacgtgtttttttaaaaaaagtcctccacctgggcctgccaccaaggatttttctttaattgacctcagatggggttgaggccttgggaactggccagaacttcccgtgctcctaacttgcagccggggttaagaactactcctctgaagcccccagtgcctgcgcttttagcccgacggacaagtttctgcccttccatcctgtgacctccagcagggcctgaccatgtgagttttctgtggctgccgtgacaagttgccacaccctgcatggcttcaaccaacagaaacgtgtgccctggcagttctgggggccagaagtccaacatcaagatatcatcagagccacatgcccactgaaggctctcgggggaatccattccttgcctcttctggttgctggtggctctaggcattccttggcttgtggctgcatcattccagtctctgcctctgaggtcacgttgctgcttcctcttgtgtgtgtttctcttaaaactctctgcttctgtcttataaggatacatgtgattgcatctagggcccaaccagataatccaggataaactcttcctgtcaagacatttaataatcacactttgccatataaggtaattttttttttttttttgaggtggagttttgcactttcacccaggctggagtaaagtgatttaatctcggctcactggaatctctgcccccaggttcaagcaattctcctgcctcagcctcctgagtagctgggattataggtacctgccaccatgcccagctaacttttgtatttttagtagacatggggtttcaccatgttggccaggctggtctcgaactcctgacctcaggtgatccacccgccataagttaatattttttttttgagagggagtattgctctgttgcccaggctggagtgctagtggctcaatctcggctcactgcaacctccgcctcccaggttcaaatgattctcctacctcagtctcctgagtagctgggactacaggtgcatgccaccatgcctggctgatttttgtatttttaatagagaggggatttcaccatgttggccaggctggtgttgaactcctaacctcaagtgatccacccacctcagcctcccaaagtgttgggattacaggcatgaaccaccacgcccgacccatataaggtaatatttacaggttctggggattaggattagcatgtagacagctttgtgggggccaccattcagcccactatgctaaccctgtgaaccgttgctcgcttctccttgacatctgacggcctggccttctgcataccacacaccctcccacctctctggccacagttctgtaggctcagcctcctccgtaaggccattaagtgcttgtgctggtcaaagtttcatcctaggccttttccttacctcccttgatattttctccctaggtgagctccttcaagcccacagcttctgtgcttacccacactcctacctacattcccagcttgggcttctcaggccagctctagactcttgtatcccactgggttcttccacttacctttggatatctcaaaggcatctccagttggctgggcacgatggttcacacctgtaaccccagcactttgggaggccgaggtgggcagatcacttgaggtcaggagttcaagaccagcctggccaatatggtgaaaccccatctctactaaaaatacaaaaattagctgggcatggtggtgggtgcctgtagtcccaactactcgggaggctgaggcaggagaatcgcttgaacccgggaggtggaggtttccgtgagctgagctggagccactgcactccagcctgggcaacagagtgaaactccgtcttaaaaaaacaaaaaacaaaaggtgtctctagtgtaacataactaaaaccaaaccaatcatgcctccctcccccgcatcctccctcctggagggagctccaggacttggtcttctcttccagagttctctgtctcaaactgcgggaattgctccccacccaggcctaacctgaagtgtgagccttggcatctctttctatccacctgtttttcctctatgcacctcacaaccctggtccaagccaccgtcatctttcaaatggctgcagtagcctctaactggccttggaggagccatcctctttctctaaccagctgccaaccctgcaatggcctctgtgtgctttccagataaagcctgactcctcgtggcccgcacagccctgcctgggtggtcctatcctgcagcctctccagtaccatgaaccctcccttctctgaacctctatttaatccatttcatataccccgttttctcctgccatagggccttgcacatgctgttccttctgcctggaattttcttcctgcctccctccgcacccctgccttgtgttgtgggttcctcgctatcctctagcttttcgctcaggctcattgttggccctctagatgtattcacttctcttgtttgttaccctctgtcataggactgtgttcgtacttcccaaggagtcgtcttggtttgtgactgtacattttcccatgtgacatttgcttaatgcctctcccactctggggcctgtacaagccccaggaacaggacttggaccctcctgtttaactctacaatctagcatccagcaggagcgcaggccttcgttgacttttattttattcttattttttatttttgagatgcagtttcgctcttgtcgcccaggctggagtgcagtggcgtaatctcggctcactgcagcctctgcctcccaggttcaggtgattctcctgtctcagcctcccaagtagctgggattacaggtgtgcgccaccacgcctggctaattttttgcatttttagtagagatggggtttcaccatgttggccaggctggtctcaaactcctggcctcaggtgatccacccacctcggcctcccaaagtggctggattacaggcgtgagcccccatgcccagccttcattgacttttagttgacaactatttagcatttgctatgtgccaagaactccctgcctactaatgcagttaaccctcatgaagcctagaaggaaggactgccattctccccacttaacagatgaggatgccgaggcacaggaagtgaagtgactttctcagggtcaagcagggagtgagtggaggagccgagattccagctctaaccgcatgatgctctatacagtgtgactccggctctctggctgggccctctccatagccctgtgagggttaaggatagaaaacagaggctcagagagttgaggtcccttgcctgaggtcacacagctggttggccgttccctgggctataagcttcagtattcccaatgctgagcatattttgagaacccgagaaacagacgtttggctgggtgggaactgaactcattttgtcagggaattcaacaactaagttggccctgagactgggtgtgaagaccgctctgtcccctgccagctggatgacctcaggagagatctgatgactctgaggtcctgctgataggacctctggtgtctctgttccctgctggcctcccctgggcctgggttgggtttcctctgcaggaggcagctcatgtatgtgctcctagacgcccttgggccagcagctccttggctgttcctccctgagccagggcagccaactttcttatccagctctccatgctccccaccccagcatgagatgtcagctgagagttttctggatctcccctagctagggggaaagcttccatcatttggaacaggaacagcaggaacagcaaagtccctttccccaccatctcccactgcctgctgtgcttctcctaacagctcatggtaaacaccctgactgagcggcaggggctgtttcctttgggctatccatgtccacctacactgccctttttaatccttacaatttttcttggacacgggggcataatattccattgtttttcagttgaggaaactgaggctcagagaggtcaagtgtcttgtctgaggtcacacagcagaactgggagtcaagccagatgggctgcctccaaggatcctactcttaaactctagagtactagaaagatcttccgttgcctaatattgattcctgataggctatgcttgagtagcatctgcttttgaaaatggagcctgggtcggttgcggtggcacatacctgtaatcccagcactttgggaggctgaggtgggtggacacctgaggtcaggagttcgagactagcctgagcaacatggtgaaaccctgtctctactaaaaatacaaaaattaactgggcgtggtggcacctgcctatagtcccagctactccggaggctgaggcacaagaattgcttgaacccaggaggtggaggttgcagtgagaggagatcatgtcactgcactccagcctgggagacagagcgagactccatccgtctcaaaaaaaagaaaacgaaaatggatcctgaattttgaaatatgctgtgactcttccctagtttgggacatctgggtcaatcccttttgttaaagtagtttatttagttggctgagagcgggagctgcctacgtgacctggagcacaagctttggaattgggcttgggttagaattccgcctctgccactcaccagctgcgattaagaacaaagatactgggttgggctcctgcctctattacttgcaatctgtgtggccttggatgagatatttaacacctccgaacctcagtgtcctcaattgtgaaagagatcgagataacagctgaacccacatcccaggagcggattaaatgagatagtgcagtacagagtttaccgaagtatatggggtcagcagccagccagtaaaatggtggctaatggttatcatgattaatgttaacattaagctctgaaaggtccttcgtgaactcataggtatttgttctctctctccctttctctctctcttccccctgcccccttgcaggtggaactgcatgtccacctagacggatccatcaagcctgaaaccatcttatactatggcaggtaagtccatacagaagagccctctctccctgggatttgagtggggtccccagctccacccagaggcccctggggaattccagggtcactgttccttcctgtctccctgtgggaatcaagccagctccaggccagaagtgggactgtgaggacatggaggcctcagcactgagctggagacccgcagaccaactcctgagctttctgggcctctgagtcttgtcctcctggtgtcaggtgagccaggcctgagcctgctctccccacccacccacatacgtgcatgaaggtagttcccagggctgaatccgtctttttttttttcttttgagatagagtcttgctctgtcgcccaggctggagtgcagtggcatgatctcggctcactgcaacctccacctcctgggttcaagtgattctcctgcctcagcctcctgagtagctgggattacaagcacatgccaccacatccagctaatttttgtatttttagcggagatggggtttcacatgttggccaggctggtctcgaactcctgacctcaagtgatccacccagcttggcctcccacagtgctgggattacaggcatgagccactgtgcctggctcctgtcttttgacttaactgagagcctatatatagcaggtgatgtgctcacatgagatgccagtacaatttcttgagcatctcctagagctgggctgggctttatcagctcattgaattcctccacgcttggaagaggaggatacgctctctgcattttactgaggagggaatgggctcagccaagacagttgtccacggtcacacaaattaatagcagatcaagagttgaacccaaggctgtctgacccctaaggctttactacatcatcagggtcataacctgctaggagtcacggaaaagtggctccccaactctgggcctaaatctctgcatcttccaagtgagaacacacttcctgcctcagctctcagagatgctagggggccagagggtccccctgttccccagcgaggaaggttcttcccttcctacccagacctcaagggctcacagcagctcctctcttaggaccagcttttaagggcagggactttaaaggccagtggatctggattcaaatttggacatattatctcctgtctgcgaacttggtctctatcaactgaggctaagaacaggccctccctagagagatgacctaggagctaggggctccttgtccacccagccctgcccccgcagacctgtgttcctcggatgtttgcacaacactcattttgtttggagctgaaagaactcagcctctctgtcacagtcttgaaattcagctcgggacccaaatttgaacatttctgctccataagccagaatcctgttattcagaggcctgccctcatggagagaatgagggatcccggggggttgcccccaactctcgggagcatctccaccaactccctgagagatttctggtaagtccactattctccatcttttcgcacttccagggaccttcttctgccccaggaagctgccattgatttaattcctatttaactgcaaggcataagcacagtagcacctcctgtgtgccaaacactcctttaagtgcgttacccgggttaagttattgaagcctcacaacaatttgtaagataggaactctattgccgtcatttacagatgaggagactgagccgtggtaggtggagtaaggtgcccagtaagcacagggcggaggtttgaacccagatagtctgcccccgagtccatggccctggccattaccccctgtcagttagaggttttggtaagtgacgcccgtaaaatgcttagttcagggcctagcacacattaatgtgctccataaatgtcacttaatgataatattcttattaattggagcttatatctctaagtggggtgaaacctcttggcttatctctgcctggcctttgcccatgtcaagccgccaacttgccacaaggcccctaatgaggtcgttcagtggggcaccaagatgagatcgaacccaggcactcattaaggggtcacggagggctcatcagctgcagccaggggctgggagcgccgggtggggctaagagaaaggggaaaggagccgccgggaggggcactggtctgatcgtccattcctcacaccacctctgggccttggagatggcgtgcggcaggtgccagctggagcttggcctgaagtcagcaggcaggggactggggagtttgtcacactcagatatgggtgtctgtaaatgcacacaaatatgggctaagaatggaaggaggaggggagcccctggcctgagccctgctaggcccaattcagtggccctttttccagctctgggactcaggcctgcctcattaactgtcctcacccatttctccttcctccagttcccaggattctggccttttcaggggcctctccaacctctttctcagtcttgtttataaccctgtcaactatttctacagagattctgaaactggctgctctttcctccgatcactgccctggtctgggccaccactgcccctccctggtgctgtggcctcctgattggtctcagccatctactctggccttcctctctacgggccctgcagtgctgtagttggagcaagagccttaacccatggtcttcccagctcattccccagcttccccatctcactcagagtcaaagccaaagtccacacatgggccttaaagttctgcaaagcctgcattgcctctctgacctctctaaggctccttgcttagtccacactggatgtttttcaaacatgccagacctaggaaacagagagtctgggttacttgcccaaggtcacacagcctttaagtcacagagctgggattcaaacccagaccactgggcttcagagtctgctctttctcatgacacacaaagtttcatttcttcctctgtgcacccctacatggaaaatattatgttttactgacaagggcaccaagggccttagaggggagcgctcctgcctgggatgatgtggtaaataggggtgggagatggacttgacctgcaacccctgagctcatcctccctccctccctgggctcctgatggtgggcttcttgtgactgtgttgcccaccaaggccggaagaggaccagacagtgccccagcacagcagctgtggctgaccagggagtagggatcatctaagaacagagcgtgcatggtggctcacgcctgtaatcccagcactttgggaggccaaggcgggtggatcacctgaggtcaggagttcaagaccagcgtggccaacatggggaaaccccgtgtctactaaacatataaaaaattagccaggcatggtggtgggcatctataatcccagctacttgagaggctgaggcaggagaatcacttgaaccagggaggtgaaggttgcagtgagtcgaggtcgtgccattgcactccagcctgggcaacaagagcaagactccgtctcaaaaaaacaaaacaaaagaaaaaacagagggtggccctatgaggagccttcgcttgtgtgggtggccagggacagcaagaggtgccagggccctaggaacagctctttcctgcttcaactttgggctccagatgggcgctttccagctcagtctgagcagcttcgggaagctgtgtcccatgggagacactgggagtcccctgtgctctttgtctcctgtcgggcccccacattagctctctggcctcagctctggcttccctccaatttgtttcccacgcagcagccagaggagctttcaaaaaggtaaattatttcatgctagtcccctgcttgaaatcctacagtgccttcccagtgctttcagccaaagccccagtcccttcctaagcccagcctggccctgcctccctggtgcatcatctgcacaaatgcctgctctctgacctccagccaccctgcacttccaatgcccgcggcttcctgcctgcagctttagtacagacccctcccctgcccagaactgcccccaccccaaggcttctgctgaaatgtcacctcctcagagaggccttccctggctgctctgtctaaactctgtgttgagaagttccttcttgatggttgttgaggagggaggctggagaagaagaatcgaagaggagaaatagaaagcaaaataatttgttctaggggacgggctggtgctgggcacggggaggcgcccgtctctggtgtgggcagctgggtagatggaggagccgtatttggaaatgtggaacccaggaagggagtgatctagagggaggggaaaggtggcgcgagatgcctgcctctcaacaggtagccagacacatgggtctgtcttggtcactgctatctgcccagtgcccagcacatcacaggccctcagtggtggtgtatgggcatagagaattagaagctgtggacctctggatccggagctgaaaaccaccaaaggagatgagttggcctggccaggtgtgtaaaaggcagagtctgagagagaacgaccagagggcagagcccccgcaggtggagttctgggggctggagggagaccattaggagaatcgcacatggctggcgcagcaggtcccaggcaaatgtggccactgggtttggcaatatgggagccagagccctagtgtcatctccctgccttctacccagcagttcccagagtgatatccccaacagtgtttgacaactggtacaggctcttcagcggccacagttactgggcaaggccttgtgagggtgactttggggcagctggccagcagtgggaggggaagcagtctcaggggtacctgaggcactgagctccgacctccaggtgccaatgccgcaccagggcaccgttcccctgcaggctcttacagggattaggggctggtaaggagcagtgattaggggctgactagcaggctggtgggcaccagcatgaccccttggtggtaccctctgggcactcatggggacttgggctaacagatggggaagggagcacattcagggggcttaggaaacatatttatgtagggaagcattttaatattttagtaacagaagctattaaaggacttacaaacttacttacatacactaaaacactatttggtcaaacttctgtttctttggcactttcctcctttattcttttttatttttttgagacagggtcttgctctgtcacccaagctggagtgcagtggtgcaatcttggcccgcagtagccttgacttccaggctcaggtggtcctcccaccttagcctcccaagtagctgggactacaggtgcacgccaccacgcctggtgaatttttgttttgaaggggtttcactgtgttgcccaggctggtttcaaactcctgggcttaagtgatccgccagccttggcttcccaaagtactgtgattacaggtatgagccactgcacccggcctcctatttttctgcttctgctttgtggataattggatgcttggacctcctgatttaatcttctaatttccttaactgtttactcctatttttcatcatcttgtctttttgttctactttgtggaggatttcttcacttttagcttccagttcttttcttacatcgtgacagttgctgccgcattctcttgtaaatttccgagggctcgttcttgggttctgaatgttccctcctttcaaggatcttctcatctctttgaggatattcatgtcttttttgttttggttcttaggttttcatctgttctctgtgctgtttcctcggagtgcttttgtctattctgttgttttgtccctcatgttagaagcatttcttttttttttctttttttttttgtgatacagagtcttgctctgtcaccaggctggagtgcagtagcatgatctcggctcaccacagcctctgactccctggttcaagtgattctcctgcctcagcctcctgagtagctgggattacaggcacacaccaccacacccaactaatttttgtatttttggtagagacggggtttcaccatgttggccaggatagtctcaatctcctgacctcatgatcctcgcaccttggcctgggaggccaaagtgctgggattacaggcgtgagccaccatgcccagcctagaagcatttcttaatgtctggtgttctctggctgttgtatcttaaaaaaaaaaggggggggaaactgaggctcgaggtgaccttgtgagctggagcagagccgggatgggatgaggaggcaggagcgtgtgcagaagagagggagcccccctgagctcgcaccctgcttcccgtggctgggaggggaggccgagatgcttggggagaaatggaggctccaagccagaggggctgtttccagcacgctcttactgagcgctgctgtagtccagcttggtgtggcggctgtgggcagggaggggagagaggtctgagctggctggcggcccactgggcccctcccctgagcctccaccggccctctcccagtgcgctgggctgggcaagcctctgatgtgccagccagatggagggtgaagtcctgatgcctgcccctaccctgggaattgtgatgctgcagttactgcccctgataacccctgactgggcataggaccagctggctgagccagctcctggggctgaggaggaagccatgaacttgacctggcactttccttgtctccaagcatcagtcaaccaaggatatggagggggtgtgtgcatgtgtgcacacatacacacacacacacacacacacttcaacctgtttatcccccttgagatttgctgacttgtgcattgggggtagaaggtgctggaaaaattccggtcctggttctcagtttccccatctgtccagtgggagcagctggactgagagacgcccatgtctcctgctgtggtcctgcaaggaggctggcgctcctgagtctgctccatcctggcctgtcaggcctgcctggatcctgccccgggttggtccaccactcactgttttgtttccaggaggagagggatcgccctcccagctaacacagcagaggggctgctgaacgtcattggcatggacaagccgctcacccttccagacttcctggccaagtttgactactacatgcctgctatcgcgtgagttgcccccaacccacaggtcctagggcagcattgatccctatgactaggaccaggcctgtccctcagcctgtgggggccagagaagttgctctgaaaccacagctgtctttctcaccattgtgtacacttagtgagtctctccagtgcctttaggcctcagttttcccttctgagatgtgggtgtgatggactgaaattgcttcaagttctacagagaaatggcagaatatgggagctaagaacacagggtcagaggcagtgcagggcttgaacccgggccatctatctcctagttcagggcttcgtgttgtgaggggaggagaggcctgaatatagggtgggggcggggagatgtggggaagattctccaaaaggctttttctttttcttgtcttgagtcgccagggaacagcactaggtaccgaaaaggcccagaaggggtatgggcgagtactagagagaaatttccatgactgctttatttatttatttatttatttatttatttatttattgagacagagtctcactctgttgcccaggctgaagtgcagtggtgcgatctcagctcactgcaacctccacctcccagtttaagggattctcctgctttagcctcccaagtagctgggatcacaggcacccaccatcacacccaactaatggttttgtatttttagtagagatggggttttactatgtttgccaggctggtctcgaattcctgacctcaggtgatctgcccgcctcggcctcccaaaatgctgggattacaggcgtgagccactgcgcctggcctccatcctcatcctgaagatgcaagaacttctggtgaccccttctcctgagagtggcctgatctcccctgggcagggcactttcttcccacgctgggctctcccagcacttgtgtgccttccctcacacattctagtaaccacttcattttcactcttcatggtgggaacttccagctaagcacagtccaccgttacgtgatcaacacagtggccctggcaggccaatttgtgccttgcttctggaacaaacatgcagtaataacaacgaaaatgttttgagcatttgtccgctctgctccaagcactgacccgggtggggtttatgaagtttgactcatttgtccccgcaataactccttgacctaggtgtcagagggtgactaaccaggggtcacacagcagataagtgtgggcacaaggatccaagtccatgactgtatcccacgtgtctcccacatccaggcatccctctggacttgtccagctgtgtccttttctctcatttctcttccctgccagccttaactccatcaccaacaaatattgggctactctgtcctaggcatggtcctcagctgagaggtcgcagccatcccaagacagaggggtccttgccacatggagactgcattctagtagggaatacagcaaactggctgataagccatatgacacacaatgttgagtagtgataaggacctgggagaaaaagaaagcccaggagaatggtggaggggccgttttaagataaggcggtctgggccaggtacagtggctcacgcctgtatccccagcactttgggaggctgaggtgggcggatcatgaggtcaggagatcgagaccatcctggctaacacagcgaaacgctgtctctactaaaaatacaaaaaattagccgggcgtggtggcatgcgcctgtaatcccagctacttgggaggctgaggcagacgaatcacttgaacccaggaggcagaggctgcagtgagctgagatggcgccactgcactccagcctgggcgacagagcaagattctgtctcaaaaaaaaaaaaaaaagataaggtggtcagggaaggcctctctgaggaggtgaagcttcagctggctctaaaccaggggagcgggagagacgcagtgtaggacagtatcggggaagagcaggcctgtgtcttctccggtggcctcagggaatgagggagaaggaaggtgctggggaggctggcaaggcctggaggatgcaggccttgtgggcaggacctgggagttgcgatgtcactctccgtggcaggaagctactggggcttcgaggggagaagtgatatgctttgatttaccttcttaaaagattgccccaactgctgggtggagaacaggatgacaggggcaagcatggagacagggaggccagttagagatggcgtgattcaggccaggatggaggggtgagaactggtatgcagttccaaagtagagctgataggacttgcccagtgtctgggatcttatccagtggatgcccagagcttgggtctgggggatgaagtgggtttaatctgccaagggttggggatgtcatttgctcctggagctcccaagggacttggggaaggttgttcccaacccctttcttcccttcccaggggctgccgggaggctatcaaaaggatcgcctatgagtttgtagagatgaaggccaaagagggcgtggtgtatgtggaggtgcggtacagtccgcacctgctggccaactccaaagtggagccaatcccctggaaccaggctgagtgagtgatgggcctggaaggggccatgctgagggtgtggctgggaggctcagctctgagactggaagggcgaactgctgggaatccctgacccaagcaagaccttgttcttgcccccagtctggtccatggcctcagaaagatgggtttaactctgtcacaagagacgtggttcccatcctccctttgccgttatgttcttaccttgggcacaagtgtttggctgtgtcttgctctggccacaggcctgctgtccaggaatgttaacctgcttagccacccaggatttctgaggggtctcccttgtcactgatgctgatcagatctctaaaggccctaaaggtcctgctctaacttcataactgaagtgagtctggcccatttctagccccctgcctgggcccccatggatctctaagtggtatcacaaaaccaccctgccccattttctgagccatgattctgatacatatagaatgtgaacatcatggcaggcccaagcttagcaatgctgtccatctgggggtggggagggccatgttgacaccccacacctcccactaagatctaggagcacccagctgctttaagagctagagggacatgttagggcctgggggcatctctgccagtctttcctctgaggcagtgggtcagtgggggaggagggtcctccccaaagcctcctcttcctcctctgtcccagtcccagagctgccctttaggccttccttttgcctcaggcccatccctactcctctcctcacacagaggggacctcaccccagacgaggtggtggccctagtgggccagggcctgcaggagggggagcgagacttcggggtcaaggcccggtccatcctgtgctgcatgcgccaccagcccagtgagtaggatcaccgccctgcccagggccgcccgtctcaccctggccctgacctcctggcctagcagtggggctgtacctgatctcccctgtgccccacagccccatggtgtccccttgagcccactggcatgaacttggggcttcatgaaacaactggagacctcctaggcaggctcagaacttctggagatgttctccccagggacaccatgcctttatagccaccctgcaggaagctcaacaccaaataggaacgtaactattgaaaaaaaaatctaggctagattctgatcagcccatagtcctccctcgagacccagtggaccaggccccatcctgtctgggcctgaataggtctgatttccaagatttctgaggggtctcccttgtcactgacgcagatcagatctctagagtttgtgcctcatggtgcacagcctcactgtgtgatattgggcaggtcacactgctgctctggttatgcaccaagacacctcagttgtgcactgtcacaaggagatgatcacacttacttcattcctctaccctcaggattagtaagaaccaaagagctacctgcacgcatttcctctaatcctcgcagcagcctgcaaagcagaactaccattgcttagtcccatttgacagatgaggaaactgaggtggagtgaggtgcagcctcttgcaaggcacaaaccctggatttgtatccggggacatctagttccaaagcctgtgttcattcattctttcttaaacacttcagaataactttattggttaagagtacctaatacattagcgagatacttcccaatactagtgtgagttctattttagatgacgtgttaaacggtcctccgtttcctcatctgcgcatgggaataagcctaccatgagtgttgttggaaacaccaggtgagagaagggtccgtgtcatttactgagctcaggccccgtccttggtgctttacacacatggcctcggcaaagcctggccgtgaccctgtgcaatagctggcagggttctttctgaaaagggcggaaactgaggccataagcagagcagttttccgcaggccatgtggttaggacatagcagttaggatttgaagacactgagccctgttttgtgctggcctcccatggggggtttgggtgggacagcaggcaggtaggctgggaggtctctccatggtgctggtgacagagcctgggtgggcatctcgcccacagactggtcccccaaggtggtggagctgtgtaagaagtaccagcagcagaccgtggtagccattgacctggctggagatgagaccatcccaggaagcagcctcttgcctggacatgtccaggcctaccaggtgggtcctgtgagaaggaatggagaggctggccctgggtgagcttgtctcccacccatagttgggagaaatcacaagaaccagggaccatggtgtctcctgagttctgaagtgtgtctttgttgggtcttaaggcttggaactggaatccccctgggccaggcgtggtggttcatgcctgtgatcccagcactttgggaggcgaggcaggaggattgcttgagcctaggagtttgagaccagccagggcaacatagtgagatccatctctgcaaatacaaaaaaaagtagtcaggcatggtggtgcatgcctgtagtcccagctacttgggaggctgaggtgggagaattgcttgagtccaggaagtcaaagctgcagtgagctgtgataatgcgactgcactccagcctgggtgacagagggagaccctgtctcaaaaaaaaaaaaaaggaagaaagaagaaagagaaaagaaagagaaagaaagagaggaaggaaggaaaaagaggaagggagggagggaggaaggaaggaaagaaggaaggaagggagagagaaagaaaagcctccacttggtgttgggagtcctgtgctgagcctgcttctggctgtgatttgctgtgtgaacctgggcaacactgtgtcttctctgggcctctgtttcttctattgggatgactgagttggagccgacatctcaaaagtcgcttccagcgtgatgatgaatgggcctcctgtggagggtgcagcatggtggagaagtcagggctctggagtcccactgcccgggctcagagcttggttccacacttcctgtctgaccttggtcacattacttgaatctcctgagcttcagtccttcatcataaaatgggtgggataatagttgtgaatattagataatgtatacaagtcacttcatatactacctgacacatggtaactggctaatgagtgacagctaccacttagataaggacttggagggtaaaagaccaggtttccccatgctgttgaagcaggcagcatgactaggatggttcaatctccacagcatggtcaaggcagggcctgccggggccctcccgctagggcacccatgacctggctctcccccttccaggaggctgtgaagagcggcattcaccgtactgtccacgccggggaggtgggctcggccgaagtagtaaaagaggtgagggcctgggctggccatggggtccctcctcactgcctcctcccatacttggctctattctgcttctctacaggctgtggacatactcaagacagagcggctgggacacggctaccacaccctggaagaccaggccctttataacaggctgcggcaggaaaacatgcacttcgaggtaagcgggccagggagtggggaggaaccatccccggctgtcccaacttcctgtatagagaggcagaaagcagggcgggtcccaggaactcgaggggtggccccaggcccagacatggggggaggaatcagcatggcctggggccatccctgccagccacacacctgctcttccagatctgcccctggtccagctacctcactggtgcctggaagccggacacggagcatgcagtcattcggtgagctctgttcccctgggcctgttcaattttgttccaggaaggccaaagagggaagaaactttagggattgggcatcagcccatgccgcgtcttttagatatgaaatctcttcgacaccctgggaagcaggcattgccgtcctcatcttacaaatgaggaatccgaggcccagatgtgctgtggcttgactgggattacccagctgctaaccagcagagctggggccctacagctcatcagctggagcagaacgctccattactctgagggaagcttccacacttccaattctcccaactctgccccctgggcatcgcataggaagcaggagtccctctggccagcatgttctctcttcctgacacctggcccttgggacccctgggcattcccctgagcgccatcttgaagctttccaccggagggtctgttccaccctgcctggctcccatcctggagtctaaccagggtcaaggccctccttccgtcctgtcgccaagccacaggagcagtatcaggccttaggaaaaagccgccttccccaagacaaggacagcaagaactcagggtgaccatggtcaggccagcacttatccatctgccaggcatatgagaaggggaggggcttcggctctgatgttctgatgacaagggggtcttggggcttgccttagggacacgtggcacctgtggaggttcttggaggcatgtgggtataccatgggctggaaaaagatccaggagtcatctgcacagatatggtggctgaaggagaagcagtggccccaggaggtggtggagcaagaagggcctaggatagaacccagaaggacaatggtatttaagggaccagcaaaagagacaagtaggaggaaagtcaaaagtgtggtgtcacagaaatccagggaaaaggtttcaagaaacagtcaacagtgtgaaattctgctatgcaagtcgattatggtcagagctaggaaagatccattagatacaacaagatggtggtcagggatcgtgccaagaacagcttccatggtatgttggagtagccagctcccagtgggactgaggaacaagcagggtagggtgcagaggggaaggctggagagggtggcagccggagggggatgttgctttcttggctcccacccccacgcccccaccggctgccattctgcctggttcccatgtctggcccctctgctgcctttgcccagctctggtcttcaggatgggctggattctggactttctggttacatagacttgaacaagtcacctaagttctgaatttatttccccctctgcacaaggatcagatctttcagatctgtttgaggctgctgtgaggatcaaaggcgggtgaacgtcaatgtgttctgactatttatgtaagagtaaaaggaggctgattctctcctcctccctcttctgcaggctcaaaaatgaccaggctaactactcgctcaacacagatgacccgctcatcttcaagtccaccctggacactgattaccagatgaccaaacgggacatgggctttactgaagaggagtttaaaaggctggtgagtgggtgtgagccatactggccttgactcgggtttgggagtatggtatctacaggtccagtccggggcctggaatctttggagagagggagtgagtctgcctcaacagtccaagacaagcccaacctagacactttccacagagaagacatctttgtgttgacgtcctgacctaggaccaggtttttgatcctttgcttgggttgagtgcctttaaagaatccagtgaaagctgtcaaccctctccccagaaaggtgtgtgcagcagctatgaagtcttgcacactctcttcaggttgttcttaaatcccaggctgaataagtccattcctgcacgtgtctgcgaggtgtctctggccccctacatgccaccctgtctctcaaaggtttctccaacttccttctcacagccctttttcatgtaatgacaaattaagaacacgacctcatggtctctactctggcacttgctgccgtgtgacagtggacaaatccttccccctctaagcgtatctgcccatgttgagtgaagaggatggactatcactacattgctaagagctgccttctttgttctctggttccatgttgtctgccattctggcctttccagaacatcaatgcggccaaatctagtttcctcccagaagatgaaaagagggagcttctcgacctgctctataaagcctatgggatgccaccttcagcctctgcaggtaggttcctgtctgggcttctgggcagttgccctgtcctggccccagtgtggctttctgtgggacttctagcaagatgcccttccattcttgggcagcgccatgaatgtgtgatgactccctggtttctgggccctggctgggagcagcgtctcattagatcggtttgttttctataaaagttcttgagaggctgttctaaggggagactttctgaagcccagtcccaaaggtctgggcagttggggacacctccatggctgcccaaagccaagggcagggagaggggcccaggcctgttctgctcctttcttcctatgtggtcttggcaaggcatcttcttgccatcataggaaggagttcctttctggttctggtgttctatgatttttacaacatcctgggtactacaagttgcctgatctttttgcttctctgaaccaacgagcagggcagaacctctgaagacgccactcctccaagccttcaccctgtggagtcaccccaactctgtggggctgagcaacatttttacatttattccttccaagaagaccatgatctcaatagtcagttactgatgctcctgaaccctatgtgtccatttctgcacacacgtatacctcggcatggccgcgtcacttctctgattatgtgccctggccagggaccagcgcccttgcacatgggcatggttgaatctgaaaccctccttctgtggcaacttgtactgaaaatctggtgctcaataaagaagcccatggctggtggcatgcagca

SEQ ID NO: 61532 - DNA, 28955 bp, Homo sapiens
gcctcgtgcccgcgccggtcggttggtggcgcctttgtcctacggcgggcaggtgggccgacgcggaggcggcagcggcgggcctgaggcgaaggagcggccgggagcccgccgcgctggtagcggtgagtgccgggaagcgctggccgtcagccgaggcgtggggctgacgggcaggccgttgtggggggcctggccggacggggaggctgaggcgggaaggcccactcgacgcgcggccacggtctcggctcctctccgggtgcgcgcggtgctgcgcatgcccggtgcggggcgcggccgcctccggctcccgtcaggcccaggcccggccggccgaggcggcctacggttctctgtggtggacgcaggtcggcggcgtcgcatcgcagccgcctgtctgtgcacgaacggtcggtcactaggagtcctcaaggcttctctggttgagccgcacatcccgcaccccctgtcgaaacggtggagtcgctcgcccgcgggtcctcagcgagtcagtggcgcagtcgggattcgaaccgggcccaaggcgtcccgtggcaccgggcgttctccaggcgtgcagcgccgagcggtgtactgagcgctgtcccccgccaccgtctcgcggcccctgaccgcattctcggggtgtctccttgtggtgtgacaccccacgcgttttgtaggcgcggacctcgggcccagagaacggggagaggaactgttcccgggtttaccacgtagctcagcgccagcgtccgatccggccggctttccaagctcccggcgcggggcactgtccgctccccgccagcgggcgaggggcttctcttaggacggcgttgcacacgtttcagtctcgcgttgcacctttatgtccgtggaccatctgtactgctatttaccaaatgttacattttttaaaaaattcaaactgactctttttttctccttaaatatatttaaggcggcaacttcaatcacaaaccgggtactggaaagccagttatttttctaatgcttataaaaaaaataaatatctgtctgttgaaataaacagtgcgtccttgttcctcctgaaattattctgcgttccacactttgggaaacgctgcccgaggagtagctgattaattgtggttcttctggcttgcactctgtgcacagaatttttcctgaggcaaagcagattctatgaatgccctgggctcttcagggataatgtaacagctttcttgtaaactgttctctttgttgacttaaaagtgttagtcccagggaactgcaagaactgtgttcactcaggtgcacccggtgtgcctgaattttcttacagcgttgtgatgtcgtagccccctgttggctcataaaaagatgtttctacaaatgctggggaagcttttgtgagttttgacaactcttaatttaatgttttctctatgagtcagtctgggtgtgaaaactaactttgtgtctactttttgcaaccagtaaagcccatgctttgcattgtggatattagaaatcacttggctatttgttaacatccatttcttcctttattgtgatttctttgcctttctttgagctcatctgtcactcttcagattgcctttgaaacctctgacacttctcttaacctaaaacttagaaacactgattttccttgtagaatgtcccagcgaatccatattgcaaggctcattggaaggagtttttctagattcagtttgctcaatgttgcatacctgtgaacaccacaagtttaaaggaggcattgacagattaacttacttgtaagttaatagtgtgttcataagatctgtttatgtgaatgtaagagcagatttaatttaaatcattgacaggaaagtcccataagtcagttcaggcttattcaagttttcttcccctcccctcaaaggctgtgtaaaaaaatatatatatatgtatatgtatatatatgtgtgtgtgtgtatgtatctctccccctgttaaaaacatgtttctttggggttaccttggtatgatcacaatgtagaatttacgtaaggctaaggtcattttcttcacatttctgagaatttgatttaagcccggcgtccgtttcagaacttcagcaaatggaaactcatctaccagtgcttgagagctaagaaaaaacaacttgtttgttttggttttgtttttgttttttctgagacagagcttcactcttgttgcccaggctggagtgcagtggtgcgatcttggcccccgggttcaagcaattctcctgcctcagtctcctaagtagctgggattacaggcgtgcgccaccacgcccggctaattttgtatatttttagtggagacggggtttctccatgttggtcaggctagtctcgaactcccaacctcaggtgatctgcccgcctctgcctccgaaagtgctgggattacaggcatgagccaccgcgtccaaccagaataaacaatttttggaaagactttcgtagtctgatgagaaaagatttattggtttgaaacttcattttaaataatcattgcaagcagtccatgtttatgacctgcagatggcagtgcctttgtgtaatgttttactactgtgaggattaataaaatttagttgtgcttttaagaatggaaaatcttcacaagaaatatattaaactttttcttcccttcagtttaggttgttctcttgtttttgactccccacgtgaagaatgaaacgtctattcctgaagtcactgttactcttagtgtagtaatgataataacatacagccagtagtgcatatggtaaatactaaatcattgctcctgcccgtcatcttatgagactgataaactagtttgatcttttttatttatagggaaatgatgactcaaagaggttagatttcttgccccagatcacataattagtagaacatattcaagacatcattggagataattgatttcagggtcaagcaaaattgggaaatgttgagatatagtggtgtccttactccaaaacttctcagaggcatttatgtgctaaatatgtgcaatgtcaatatctgagagaggaagttatcatgatgcctttctcctgctatcctctcatgaatattttgaagtaatagtgttcctcagaactgactactctttctactacgctgtatttcctctctgtaccttgtggtttattaatgattactgcatatctttaagacagctgcttttaaagctcaatatcagcttttttgtgcaaaaatagttgtcctgtgaatagcacatatatttgtttagaccattctgcttaagcagagttaaactgtcaaaaagttaaaagagcaatgactaacagaattatcctttatgttactctcattaatgagagtcattaatgacaggatcagggtaaagccactgtctcaagcagcagtacattagagaaatatgaagtatattgacagctaaatatataataccagcatgcatgctgctttttaaatggtggttttgttaccaccagatatgaatatttatgggaatggtcatcttcattctttatcctttcacttaaaaaaagagataataggtcatctggaccaattttatgttaaggaaatagttcacctcataagaatcagaacttttccagacatcctatgtaaagaccagacaactttaggcaaggatcagggcagcttaagttgcattagaaaacagagtgtcttgtcttatacctttagctctgtaaagtatcttaaggctgggtacagtggctcacacctgtaatcccagcgtttggggaggctgaagtgggaagatcccttttgatagaagtttgagaccaacctgggcaacatggtgagatcctgtctctacaaaaaaaattagccagggtggtggtgcatgcacctgtattcctagctacatgggagccctttattgaaagtaaaatcatgactttttcaatttttttctccttcagtgtcaaaccaatggtctttgaagaatgttactaaaatgggcaatattttgaatgtcttacatttaaatactccctcaccgcatttggggataatatacataaagtttcgttaatttggcttcattgagactctgtggtagttcagtttatagcccccaatagaccctctagccactagattcttccttgtccatagcaaagtgttttgcaatctggatctagtccaactcttgcttcatgttattcctctctcttttattcctcctatccccgtgttcccaacaccaaacttcctgtagtttttctaatttattatgtccttcacaccattcctttacctttgtatgttctgggatgacttttctctttctggtaaactcccactcattcctcaggacccagtttaaatgttatttttaagccttccctgcctcctcccatcccattcacccccaccccctccatacacacattcttcctagtctcctctctgctctgttcctttcacctgccacacacatacacaaaattaggactccattatctctgccataatcccactttagattgtattgtaattatctgtgtacttgtgcctctcctttattaaataaacagtgaactccaggccaggcatggtgactcatgcctataatcccaacactttgcggggctgaggtgggaggatcacttgagcccagaagttcaagaccagcctgggcaacatagggagacagtatctcaaaaaaaaaaaaattagctgcgtgtggtggtgcatgcgtcttgtcccagctactcaggaggctgaggcaggaagaccgcttgagttcaggagtttgagactgcagtgagttatgatcgagccactgcactccagcctggacaacagagctgagaccctttcttttttaaaaatgaacttctttaaggcaaggactttagctgtgtcatttccacatgtgtaaggcctgggacatgtgtgacacatagtaggcatttgacattatgaatcaatgaagcattcaatgtattaattataagctatccttttcaaattcatcacttgttctccacttgtacagtttagttgaaaatttgccagttttaaatctgtattttaaaattttaagcagctcagactctttttttgtagtttagattagctcaacctttgcaaatccaaaatcattttttctcagctgatttttctccttgagtcaacatagctaacacaggcagaatatccattttgtcagaaaggaaatatagattcagagaaatcaaatgactggagtaaatttcccaaagtaaggaccacagctcagatttgctatccccagccaaatgccctttccttaaaagaataagaaaggtaggaaattaaatgttgataatttttgtcggaagagttgtggtgaatgttaatagcaaaccccagaaacactgtagtttgaggtaatagaaactgaagtcgtcattgaataagtaggttctaccctgttgggtgtctctgggtcatttaagcaatggagtgtctagcatagactggaccttttccaggttccatcagtatttgatcagggagtcctagcaagaatattctaaatggaaagcatgtctttccactccgttggaggcagcatagcataatgtttaagtactttggtgtaagaaagacctgggtctgagtctcagctctgcctcctgataattgtgtggcctgtcacttaatttctctaaacttcaaattttctcatttgcaaagtagaaattatagcagtatttaattccaagagttgtaaaaggattgaatgaaataatacacataatgttcttagtacacaggctcaggaacaaaataagcattctgtaagtataaactattgtttcccccatttctgttcccaggaataatattctaatacagttaaagatgtaataattattttagttggagaataaaggagataatcaaatatatagggaaagtatagtattcaaagtgaacttaaagggttgatttagaaagagcaagcataacattctcttatccctgacttgttacaatataactcattacaatatccctgatgttgcaatatatcatcaaagttgtcttcataaatatagtttagcgagaagtcctgtcatttcccctcccaatttgggggatttaatgtgtgatattctctgtcttgtcagtatggttttccaactggcattatctttatcagcatgtaatgccactttagtaattcttgattgttagttggttttcaactaagccttttagagagttttatgtcatttgtagtcagttattaaaacagtataggcttctgggttctttgaacagctagtggtggtactgtcactaagtgttgtagttcatgtggctgtcaaaagacaaaattacagcacacttagtttagagatcttaattgtcttttatttgcaactctagaatagggcaacacctcattctataaaatagaacaagtgttccaatgagctgagcagaggcgtttggctttataaacagagaagggagctgaggaaagcagagacaaggagcaaaaagcggattggtcatttcagagttacttttcttgtgaagggtaaagcagtgcagacttccttttcatgctggctaaaactggcctatttgtggttttggccattatttatctcctgatttcgcagaacgtcaggaaaagatctttgtcttggcttgatagcgtggaacttcatcatgaatttggtttggtctttgggcctagttcaggagctcagtccaaagcaatggcctcctggaaattttctttgacaccgctcttgttattcctagtcctcattgttttctgtggctgtagcttatgaactataaaatctggttttaaggtgaaaagagttgttttatgattgtacaattaaaaaataagtagaacaaagtagtttttggtactgtgagtgaaagaaacatgcatttttatttatagcattatccaaggaccattttgtgacccctgtctggcatattagtctaaaataaaattgtggattagatattgtatattttgggagttcttcaccccatccttttgtagtttataatggttctgccatttccagcatgttttctagattattttccagttcttttccttgtatgtaaagctctttttcttgtctaaaaattcttaactgagaagtgcttttaactgttttcagaccaccacttggacactatagatattcaggccaagataaagcacttcatggtgattatgatgattttgaatggcattcacattgctagtataattaacaaagtatagaagtatcacccaaactgaagtggagaagacactgagagatgacttttggtcttaagggcagttggccagaataaagtatagcagaaggggaaagaagtaccgtttcttcccttttctattcagaggagacattagacctctccttggaagagattcccaagttgccacttccctcttgttgattaatttttctccaaccagagttccccatctgatgtccagaaagatctccaaattgtctttctacctttttttcccttctttacattaacaccatttctatttgcttggtgttgattatatctctctataaggatttaggagaaaataatctgattatttaatacaaaataaaactatagattagatactgtgtctttctttgggaattcttcaccccattcttttgtggtttaaaacagttctgtcatttcctacatgttttctggattattttctggtttcttccttttatgtaaagccgtgagttggtgctttagcattctcaatatttgcattttcaaagaaaatcttttttaaatgaaccctctgcttccaactgacaggttttcaaattctgtgacaaaaaaaataggatgagggaagttttttcttgacttcttgaatctttgctctccgtgattagttccttaaagttatttattcttctgtatttctgaactcatggatttcccaaaagttctatgtgcacatgtgttaggattttttgggtgtatggggattggcagtaatgttggtggttgtgtttttacaactctcactgaaaactccccagccctaccctaatctgagcaattctattagataggaaaaaaaaaaaaatccaggtctcattttctccatacgtcagcccagatggaaatttaaggaactcttaaatagagatgaataaacagatacttgacatactacactaaaagtttactaaaccctaaaatgagacaattatctgagaattcttgtttttgcagaagaaacatcccatgctgtcaaatataaatactttggactacccaatgaaaatagatactacgaggcaaattacaatcaaaatggtttaaagatataatcttgaatattctttaatcttttaagtaattacaaaacgattccaccagcttcaaagtaaaatatttatgtccttcattctaactagaactggttttgttccaaagatatagtatacatgaccatgtgatttctccagttctgtatgtagatgctcacgaaactggctataattatacagtgtaatattccttttcatatgtagagagcaaattattggtaatagaaacctaccaattaaagtaatactatatgtgttgtactcttaacctgaatgtttgccaggtctagtcagtgtttagatgtgagtttcctttattcacaagaccatttaataatatatgaactcctgctgaagttatgttatgtatattttttatcttaatacacacccagtgtattccagagacaccttgaaaactacttaaaatactcaaagatattatatttctctctgaatcatagccaacctatataattagaaagtggtacacagtaagtgaacagactcagtaagtcataaacctgaactagtattcttcacaattacgtataatagaactagatattccctataaggcctgtcattatataatttgtaatttagaccattataaactttaagagttgtaaattgtgaaagtactgcatgcagtagcaaagctatggtcagatattactggccaagtcttacatagaaaatattttcaggttttttttaaaatagaaggattatatcttgtgtctgcttaattgaaaaggtaagaatcaatttaagatatacttcactatttagctttatattattttcagttttgtcagaagccatttttctagacaaattagagacttctgatttaaaatggaattgaagattaccttcatttgatcaggaactcaaaagttggcaaaatagcagcataaaatctctaccagacctctaagtttcttgttattgctgtggtctttcatgtgataggaatctggttgggatttttaaaatacataattattattttaaagcactcgaattatgtgagtacttaataccatttgatgtcattagatacactattaattgtttaatacggaaaaaggggaacaaactctactgcagcagaaagcacttttatttcttcattcatctgaagtatgaaatttgtaatgtatttatttagctttaagtcatatgaaaactgtcaggtattattttggggcatagatttcttagtacatggtatttattattcacttcaatttttgtaaagcaggtattcttggtttttagcaaagcaggctttagctatacaaatttgcttttctttaagcttatgtgattctacttttctcccatatctagttctatacgccagccttctctaatgaaaacaacttaggaggagtgttttattacctaaccctactataccaaacgccagtccttattcttggttatctgtagatgttaacaggtcatattctttgtttattaaaaataataataataattttctttcctgcatgttattctggaagattctatccagtggaattcaacacaagacacactaacaggaggccctgcttcatgggatattggaagttttaagacaatgaaatccagctattacttcttagtaacataaaatagaattatttgcctttgctcttttgttttttaaactctccttatcttcccccccactttcttcctcacaaaaagaatcttacagctgctttctaagagtttagaaaacaaccttttcctccccttggagggaatgtgtcaggtctaggtcttggcagcgtgttaaagcattgacgtaattagtttaagacaaattacgtgttaactagaaaacgaagggacatttcttaccaagccgtgacaatgtactaccttaactcaataataaaaattgcccaagtgacagtgtgtctctgctgaatggcttttcttacaccatctggttgtcattgtagtttttgttgttgttgctttcatttgaaatgtgctgatgatcttgtttttattccgtagcattgaacagatgggttgattattcttttcagatattaataaggcagcggaaagaagaaatatgaatacggctccatcaagacccagccccacacgaaggtaaagtaccctgaagccgtgagttaccttgggagagttgggctctggggagttaagcccagcttcgtacaccaaaggtcttttcttccccccaacaagtgaaacgctcaagcaaacaataagaacatgaaccctgtgtgaagggccttgctgctttttttaaacatacatcaggagatacagaggaagctttgtgttttcggtggcaaatccagcaagttcagcttgcaacatgagttgcaggcaattggaagaggataaacctctgtctgtccccagctcacgtgtcattgggagcctccagagcagaaggagtgccccagagtcattggtgtatgccatgctgcactgcagtgggcagcagagattcgactcttcattccaaatggctgccggtccagatgttaacccaggtttacggaaagtgctgcttgagagattgccgctgtgcctgtgctgcagatcccctgtttgcttacatacttgggttatctgtttgaggggaaataaaaagggcaaaacactccagctctcgaaggtctccctttttcttagctttcacggaaatcgagggtgttttcccaatgtattcttccttccggtgtatacaaaagagataatcctggtgtgtaccctcaagatacacattaaattggtccctcctctcaaagaagagctttattaatgataccatttacaccaaaaataaagatactgtattcaattgttctggccccataacagcacacaagtggatgcagttttgtgtagagggcagacagatatgatatatttcatacgaatgatatatttcatatctggtgtctcttcaaggcccaaatggattaattgattttgccttgcctctaagtaaaaaagccagttttccccagaaacataactaaactacgtaccacagtaaactgcatttcctacagtgaactggacagtgctgcatacagtgaatcctcgtctgtactggtagctccactggtcaccttgtgaacccaactaactgagcattacgcataacatacagctgtcctgcttttggacaaaaacacctgtattttgttacctgcttatatgaaagaatgtccactgtgtgtttcatgtatatactcctacttggatgtgaagttctagctaccgggaatagattacgcatgcccactctgcagtttaagcagaccctaagggcaagtaatgctgctggtttcattcagttggagtctttgtccactctgcctgtgcagcagagttgaatccaataccatagctacagctatataccacagctgtcgtgtggattccctggccattcgttggtttcactgcggaagtgggcatgtaaattggtattctgtctgttctctctaaagaatgcttgcagcttgcaggtaaatactctgttggttgatttgtgtgtatgtgtgagtatcctgaagaacataaacaaatcctgcagaacttcagcagttccgtataatgtctgctttcattagccttcatctaaccatgccacagatcttgggcagtcctatctgtgttgctccttattgtcccagcacagaatggaatacaggtggataagagttgcatctaatcttcagaagtacagggttcccattggaatctttagttgccaggtggcttgaaaggagataaggtgtgtatccaatttccaaagagcgctaacgtgtgtgtttcctggtgacttaccaggagtgtggaatttgtaactataaaagacactgactccgctagtaaaatcctacccctctctgttgtctccatgatacttggtgatctctggataatgtctgtgtgtttctgcaggcaaaaacaacaacaacaaataagccacattgcagaatagagaatagatcctgtttctgttatggattgagaagggtattttatatcatcctgttaatgatacttaaccaaatgcttttaacatttctagttgattgtagatattcaacaaacattgcagtgttggggaatgaccaacttccctggttgaaacccagtaatagccgttgccagagcattaaattaaaaatattaatttaccccaatctagaaatagttttatgctttttttaaataatagtccccgcacaaacaaacatacagacagcactggagagggccttataaaatgagcttctagccaggcacagtggcccacacctgtgatcccagcactttgggaggacgaggtgggcggatcacttgagctcaggagtttgagaccggcctgggcaacatggcaaaaccccatctctacaaaaaaatagccgggcgtcatggctcttgcctgtactcccagctactggggaggcattgaagcgggagaatcacttgagtgcagggggttgaggctgcagtgagccgtgatcacaccactgcacttcagcctgggcaacagagtgagtccctgtctcaaaaaataaaatgagctccttaccaactatataaatatacaggtcacctttgtatgccttttaaaatatcaccttcctcagaaatcaattgtaaaatgaggtcatttggtggtgtggatagggcagtgacttcctgctttatttacaatcaacaggagggacagctaggctaattcaaattccattaacaatccatcttccccttggtgatatttccctagctgggttcctcagcatgttatttaacatgatgaagttccatacagtcatgtttatttgcttcagggaagaatgatggtcaccattagtaaccccatctaaaaaccgaactaagagtcccagttttttaccttaaaaaaaaaaaaagacaaatttaacattgtattcaaaatcccagttttttaccttaaaaaaaaagacaggtttaacattgtattcaaaatagcgagcactaacattttaatcattgtcctgatcatactttatctcttaagatataccaatagggcagacataaattgcaaagagtaggtgagacgggcaagtaattaatctggaaggggcaaatcatttaactgagggtgaacactgggtacctcctttgggtgcatgcttccagtcaaagccttgagataactccaaatgtatcaatagttgacaacaacaaactgcctttatttggcagccctaatcattttgtatgcccccagccacagggggtgcatcattcacaggggaaaaaaaacactacctatggcaaatatttcctaaagttatacctctacatttttagcgctttctacgtttaataagaatattggtataagcatactggcaagacctttataacaccttgttttgctggacttaacgtaggtatctttgggagttttacaggattatcacctcttcagatgtttcagtaaaccacagttctgctggctttgctctctattcaataatatgactccctgatgactccagctgtcagtgtgtaattctgacaatattggcccagccaagcacagaactctgcatgaggaatctctgctctggatcacatttcagcctgaattcttatcatctaactcttgagggccacttcattgaactcctgtgagtaccttgcatagttaccatgcaagttgtcaagcatcgatactaagcattagtccttcttcaaagacaggatcatgattccagttgtgccttagatatctcagttaccatcttcagctcaacaccttgacagtccagatcttgtagcatatctttatgcagatgtggcctctaggtacaagaagtaagactgtacttctgaatgacttaaagaagaacaaatagaattaacttgtctgcatccaacgctctgcagaggatttttccccatatatttgtgaaagatgttaaacctggtatctctttggtgaaagtcattgggtatcggctcatcagaaataacctggctgtagacaagtttcttatatgacctgaaatgctttctgcttatccacagggccctaatgcttttgattattgcttgctccctggttgtgagacagcccttgctctaggtgggccacaaagaaattccaggttgtgattacctctgcagtaacacttgaagaagtcatcagttctcagcagctgccacctctaccaataagaaagttctgtttgtgctggagaaggttgtcagtgcttcctaaggaaaagcatggacatgtgtaaaatttgggtctgtgaggtgtgatatctcattgcacgtccatatcctacctccacctaatggcaatattctggacaagtctgttgtctccatttctaacagtagcatgaagccctcctggtggaggatcaacatcatacagcagccagccatttagatgatgatatttgtggacagtatatctgtgacagaagtttgaagagctaatgaaggatttttcagggtcagaaagaggctggccctcccaaggaagacattccggtgaacagaaaggaagaaaggagatgctgacctttgcagaaaagaaagaaaaagacaggggtcttcctccctgaccgtctgtagaaccaaagccaaagaaaaccatcttggatgtgaagtttcagtctcttgccaaagagaaattcaaagtccatcacagttttccaagatgatcatctatcagttcttactctgtaggctgtcacatgcctggtgctctgcacacccctttagtcctcaggaagagacacattctaccagaagctcatcacttgccaccagagccattgttttccccttcacccctttcgcccttacgtctcaaatgtttcccagcagtgtgactatattcccctcaaggcaaagagtatttgcctttttccccctcctgaatagatgaggaatttacagcagaattttagttgtgtttgccacctgccttcagtttgtggactccagtgctgaaatttaaccactgttcagtttctttttatcctctagtgatgtagtacctgagggtatgctgcatttggttcctttagtaaaacacctctggtgctgtgggatgatattgttaaccttattatgctccagaaacctgattctaacccacttatcatctgaggtccagcgtctcccacaggaagctttgtcttcttgcactttgattcgtgcatactactgcccttttgttagctgtagtcttgttttgaaaaatatgttggggccagcagcaggagcccttttgttctgaggagttctttgtttgggtcctaaagcaaccctaaagggttttttgttttgttttcgtctccagaagaacagcagtctaccatagtgtttatcttttggagaaaggaaaaaaggctttgcctttccttttgagaaaattattatcttctttgtccctacttccaccatgcctttggttctttttccttttgtgaatatcacctcttctacatttttaccctgaaggcacttgagagggaattagtagttttgttgcacatggacttcaaattatttgagggaaagggtggggcttgccctctcagactggaagattgaacccagactttgcgaatctagagttttagtcaacttgcagggatggactttgacaggtaagtaaggtttttcagtggattcaaaagaatgaggaccaatcataacataacacttataatactccgaaggtggtaaataacatgctatgacatgccccaccccgatttccaccagcccaaggctttgtgtgtggtctgtggtctgtcaggatcatgatatctcagccctgattgccaagaacacttgaaattggattccacctctaatgactacttctaactgctccccaaggcaggtttatctgccgatcattaatccaaaaatactttgcagttgtcctttctctttggatcttgagtgtttgcccacattacatgctacatcagatgttacatgttaggaagattatatgatgtaataaggaaggttgaagtaagaatcttggttagtctttactttattctaataagaaaaataatgcttagctattctcatttaaagtccctggtctatgatatgtttgctctcacaagtcaggaatgctggtgaaccttagaatatataacaaatatttttcatggaagcaaaattggcatttaaattgtttttgctgtgcccgtgtagctgaggtgaggttttccacaagctgatgacatcatgatgaatacctaacgtgtgtaaccatggtagacgacaaaagtatgagcaaaacatgctgcctgctcttgagaggcttacagtttagtagaataattcaattcattaaacatttactgaactcctatggtgtatcctagagctacaaagccttcaagagaacttcttatttggtagggaagccacgtaaacaattacagaacagtgtggtaagtgcggttatagaagtttgtactggagcaagattcattcaacatacatatagagcatctgtcgtataacagacattgttctacatagtgggtttgtagtgcagaatcaaagtgacatagttcttgtccttgtggcacttgtagtctagtagggcagacagacattaagtaaatatgtaatgtcaatttgtgataaatgacaaaagtgaaaacagtgctatgagagaattttaggggcagaaagtaaactttgattgaatctaacaatcagggagtaggggatatttatatgctgagacctggaagaggagtatagatctcttcctgctactcacgtaaagggatcaggaaagacgttggctaggcagagctgaaaggccggtgtggcaaagagtggtgaactagggagagggtgtgacagggttagagaagacaggagccaagattatacaggaccttcatggcattggtagaggttgtagattgaattctaaatactgtgggagcctggcacagtggcacacatctgtagttccagctacttggtaggctgaggcaggaggatcacttgagcccaggagttcaaggctgtagtgttccgtgatcccacctgtgaatagccactgcactccagcctgggcagcataggtgagatctcatccctataaaaataaatacatactgtgggaaaccagggaagggctttacatacgtaacagatcactgtagagtgatctttctggagaaagatttggaaagaggcaaaaacagaaatgaggagactgctttagaaggctcttgctgtggtttgagggtgagatgattatgcgctggccttcagttttgccaaagaaggtaaaggaaagtgggcagaactgagaaagaatggagaaaatttggaaatgtggttggaagggaggatgaggctttaagggaaagatgacatccagtttcgtggcttgagtaactgagtagttggatgtgccatttactgagatgggaaggactggaggaggagcatggttgttggggaagatcaagagttcagggcaggttttacggagaaggtaatccttaaagcgggtcagacataagacattgttgtaaaagggtaaatgccagatcaagatgagtaatacagatagaaagtgccctgagctgagcagaagagatcagcagttaggaagggtagggaaggtttcttggaagacatgggacacgaacttgcctgtgtggattggatggtacttggattagtgcaggaaaaatattccaagtatagaaatcaaataaataaaactattgagatagattatatcttgtgagttataagaattaagtagaactgaggaggttgaattagaaatgagagggagataatagctgtcagatttattaggctttctaacatagaagttggcattttaggatagttagtgtatttatgtgttgaatgaattgaaagcaagtaggttgatttttaattttgtgttttggaaacctgttggtgtcagaatagaaataagggcttggattggacttacaaatccaatgggaatggaaagaaaaagtgaacgggacacaagtgactttattgggatgggggaagaaaaagcatagttaatattcaagaacttaaaacttgataagtggaaagatgattttgtcaaaagtggaaaagtggggaatgggactgatggggttggggtaagaagtttttaattttaaatatgttgaagaggagtttccagtgggttgaaacgtctcatgaagaacattgagtcagagcagacaaagcatatctgtgacttcactgttcaggttgtttttttgttttgttttgttctcttttttttttttttaaaccatcttgagcaaaatggaatcagcttctacgtaaaccctcagattgagagataccaatactcaatagccctgacaaaacagagaaacagattgttcttggtcctttactgtatgtatcttatagtaattttttccccttaattttattatcctgccaagatacttcaagtgcattttccgtactttaaggacagttcctttgatcacttttataagattgtgccattcgctctttttttcttcatgagtcttgcctccttactctgtcactccaactttttaccccttgtaaagtctctttcaagcaagtctggtggaaagacactttcactttgaaagcctgatgaatactgttatccagtcaaaaccttcagtttttggtcatgcattcttttgatgtcctaatcttttgagattgtggaacctctagactatttgctgaccagatggatgactggccttaaatgttgagtcatgttctgtttggctgccctgttttagagaagaatgcttggagggtgggggttttctcatatgaagagctgatgggttggctactttcaatttctttgtcttagcattttcttgctacctcccacagggatccatatggctttggagacagtcgagattcaaggcgtgatcgatccccaattcgaggaagtccaaggagagagcccagggatggcagaaatggccgggatgcccgggacagcagagacattcgagacccccgagacttgcgggaccacagacatagtagagatttgcgggatcacagagacagcaggagtgtgcgcgacgttcgggacgtgagggatcttagagactttcgtgatctaagagactctagggattttcgagatcagcgagaccccatgtacgacagatacagagacatgagagactcccgagatcctatgtacaggtacatacgtagttactctgcttgttttttcctgagttctttttatgtatgttctgctaaactaattgaaagctctgtaagagcagtcattttatcagccttttatttctggtgactgtcaagtgatagatgtgctgctgctcaataaattttgctgaatgtatgaatgattttcaacatttttaacagaaaataacagtgttggaaaggtatggagaaattgaaactctgagaaattgtaggtaggaatgcaaattggtatagccactatggaaaacagtttggcagttccttaaaaagttaaacatagaattaccatatgatctatcagttccgctcctgagtatacactcaaaacaattgaaaagagggactcagttgtacatgaatatgcatagcagtactattcacaataaccaaaaggtaaaaacactccagatgtctatcagcagattaatggattttttttttttttctttgagacaaggtgtcattctgtttcccaggctggagtgcagtggcatgatcacagctcactgcagccttgacctcccaggcttaagtacttctcccacctcagcctctcaagtaactgggactacaggcatatgccgccacacctggctaatttttttgtatagacgtggagtctcactgtgttgcccaggctggtcttgaactcctgagctcaaggtatcctcccgccttggcttcccaaagtgctgagattacaggtgtaagccactgtgtggatttgtttttaagtggtgtattcatataatgtggtatcattcagccataaaatgaaatgaaattctgatctgtggtacagcatgaaggacgttgaaaacattatgctaagtgaaataagccagacataagacaaatattgtatgatttcactttatgtgaaatatcaagaatacgcaaatttatagagacagaaaatagattaaagattaccagtggctggggagaggggagttatttcacgaatacagaatttatgtttgaggtgatgaaaaattttagataatggtgatggttgcacagcattgtgaatataatgccactgaattgtatacttaaaaattgttaggccaggcgcagtggctcacgcctgtaatcccagcactttgggaggccgaggtgggcggattggattgcctgagctcaagagttcaagaccaacctaggcaacatggcaaaactccatctctactaaaaaaaaaataataataataataaaaattgttaaaatggcaaattattgttatatgcgtttagatataattttaaaaagcacaagggagggacatgtaatgtttcctcaaaactagtatcaataattcctgccagttattttgcatttaatatatgccaaagaccatgctaagtgctttctgtacatcatctcagtgagacaggttaactctatcacagccacagagctgataatgcagtgagtcccagatataaacctcatttgtctaatcccagagaattctctaggtgactttttcaggataagacacagttttatctttatgaaaatttccttaacttttcaggagagaaggctcttatgaccgatacctacgaatggatgactattgcaggagaaaggatgactcttattttgaccgttacagagatagctttgatggacggggccctccaggcccagaaagtcagtctcgtgcaaaaggtaaagtagctgaaacagtctattcctattattgatagaacactttacaaaagagagaggaaactaataaccagtacccccatctgaaaaagggctagtgccttggccaagcagtgtataaaaagaagaaatataagtagcttattagtgggtaaagagcatttggcttgaaaatgatttttaagatgcaaattagtaccatcatctggtttagtcatccaacaagaagaaataaatatgaaattccagcaataagaaatgaacaaaatgctggtcactgtggccaccacctgtaatcctagcactttggaaggccaaggccggcagatcacttgagcccaggagttcaagaccagcttaagcaacatgataaaaccccatctctacaaaaaaaaatacaaaaattgtcttggtgcagtggtgcacacctgtagtcccagctactcggggggctgaggcaggaggatcgctggagcctaggatgttgaggtctcagcaagccatgattgtgccactgcactccagcctgggtgacagagtgagaccctgtctcaaaaaaaaaaaagagaaaaatgaacaaaagattggagctgaagacattaagtgcttgttttttgcctactgaccaagtaactatgactgactatctgcattatctaggcaaaataggtttttggttttttttataacttttacctaacagcatctcttttttagatgaaggcaaacatgtctttttaaagcctggtttttctcaatacatctttaaaggttcttaaattatttcatacctggccaagttgaaatctttaagaatctcatttttaattttaattttttaattttaaactttatacttgatttttttcttttaaaaaaagaacttttaaatttttaattttaaactttactacttgattttttccccaaaaaaaaagcaaaaatgcagattagaataataataatattcttatctgtcaagttggcaagacttaaaaagaatgacagtactcactgttgactaaggtgtggagaaataggcactagatgatctacctctgtggaggtataaattagtatcagccttctcagggagcagcttggcagtaagtatcagatgcagcattaaaatggccacgtcctttaatccagcattacattttggttaatttataatagtaaaaaatattaatactggctgtttttaggagatagaccagaggattgattcagagtattatgacctttgcctacaagtagctcaggatttaaaatgagggtccagtccttatttcagtttaccctggtggtgttttgcagagcgtttgaaacgtgaggaacggcgtagagaagagctttatcgtcaatattttgaggaaatccagagacgctttgatgccgaaaggcccgttgattgttctgtgattgtggtcaacaaacagacaaagtaagaacccttagatatttctccccagtaaggagaagagtcagagaaattcaggctcctgtttagcacctctatccactgaatctgagctgtgtattcttgcattgctgtgcgctgttagccagggttctttcagttataggtgacagaaaactcaattcaaattgaggccaaaagggacatttttcatttaagcaaaaattaactgggaaattgaggcacagccacatccaggatcaaaccatgtcatcaaaattggtctctgtgttagtctctaagcactgttttcctcagatttgcctttgttctcaggcaggttttgtgcttgaagaggcagaatggcactggccctgaacgtgtgtcttcttagcttagcaagccaagtggaaagagaacttctctttcccagtgtttccacctgaagttctgcagttctttttagattgacctgactcactttcccatccctgagcctgtcactttggcaggggtgctgggtgttctgattggccagggctaagtcatgttcccatcccaagagctagaggtgggattagccctgtggaaccatgcagactgagagtggaagagggtgtagccgctggtcaagcagagtagtatatactcccttcatgggacaacccaaatgcccaatactttgggagacacgcctctgcatttgtcagccaagaaccaagtctttgtgaagtaccatggccttgcagaactgttacatgaccatgttaccaagctagggcttatagcattgtttcactgcatccctgttttacattttctccttgaagaggcagagcagagaagcagaaaggagtatagcagcttgcaggcttggcagtagctatgttccctttccctaggtggtactaagtaaataacttcatgtattttctagcagtttggggttaaagagctaatttcaaggcagtgactagggaaataggtgttgagacaccaagcagtaggcagagttcacaggctcttggctgtcttgttcagtgatagatgctgcttttaactctagagagctttttttggacacatgataatagctgttattttctgagcacctactttatgtactaccccatactaggtgccttacataaattatttttaatcttcacagtaatcataaaaaatgagcattcagcaaatcttttatacgtatggtggatggcgggtattggggctgtatagcctcattccactggtggagcttacacccaatggggcaggtgacaaaagcatacaggtgatgagtcctatgagaagagaatgtcagagatctaatttagattggagggaaggtcaaaaaaatgacgtatgaactgagccatgttactcctgttttattagtaaagaaactgatgtttgtaagaggtaaatggacttgcttaagcttcacaactttgcaaataaattttaagggctgggatccaaacccatgtttctagcgttaaacccatgatcttcccactgtgttgtgcagcctacccaaaaagagataagtgccacaagtcttagggagcaggatggtcttaaggaaggaccacagggctagagaatcaagagaaggacctgggtatcatactgtgctactggcaacttctgacgtgatctcaagcaagtcacaaccgttctgagccagggtagagagagagtattggtctagatacttggatcctgaatacggtactggggtagactaaggtttgagttatcagtaggaacacacacaactggcttgagacacacgatgcagatttggagttggtcgctcacctggatcttatttatttttacagagactatgctgagtctgtggggcggaaggtgcgagacctgggcatggtagtggacttgatcttccttaacacagaagtgtcactgtcacaagccttggaggatgttagcaggggaggttctccttttgctattgtcatcacccagcaacaccagattcaccgctcctgcacagtcaacatcatgtttggaaccccgcaaggtacagagtcagaataccggaggtagtcactagtccattattagtcctttatgccttactcagaagaagcaggttttgggcaaatgactcttatatctcagttcatatatggtagggcccctctcttaagtaccatggaagagtcttgcatagtcacttacttatctgatagtttcttagtggatctctgttacactatacttagccactaggtatatacagtggtgtgctggcacacgtgtaacaacaagttccagtgtggggggagggcgtttatagcatttgctgatctccatggtgtaaatactcccaccatgtttcagttcaagccaccaacctgaagtcactgaagggagagttggaaagaaatgtacacagttggctcttgccactgagatctggctccagcacacctctgccatgtactccactgaatgtgacaaaatccttgcttctgccagctttctaatggaggacagagaatataacaggcatttagggtcctttttgtaagtgtgctggagaagtaaccagaggggctaagaggccgtgaccctgtagaggcccaggcccagttctcgaagtcctcctcagaagtagcttttaatgcattgagcccagaggattaagagtccgccagctgataccctgctcctcactcttacagcacagacttaacccttttcccactatacgcaggatctctctttgcctcacccattaccctcataaccatacaattacataaggatctccagtgggtcatttgtctgaggaatagtcctcaagatgtgtgaggacaaaagttctaaggagtcctctcactacccagtaaaccatgttgcccatgggtgaggagaggaggttatttagggtcacagtttgatcttaatctatgacttttgaactgatgaattaaaaaatggtaggccagctctgtcctgaggagcacagtggagagccctgctttccagaggggcctgttggcctcctgctgctggtctagaggctgttgggcctgcctcccatggctgttccccacgtggtctgtttgaatctgtgggaggatgtcatgtttctttggtttttactacaagtctgtgatctaggaattcccccaaagaaccagctgtatataaaggtgcatctcctcaccaaaagtgttcgttcacttcccttcctggccttcatctctccccccacaccaccccactctcaatctcaaggctttttgtcaccaaaatgattttcttgctggtatgaggttaggaaagacttgacagagtgcagcaggtgggcacttaaatatgtcatggaagaaaataactcatgtcatttcctcctacagagcatcgcaacatgccccaagcagatgccatggtgctggtggccagaaattatgagcgttacaagaatgagtgccgggagaaggaacgtgaggagattgccagacaggcagccaagatggccgatgaagccatcctgcaggaaagagagagaggaggccctgaggagggagtgcgtgggggccaccctccagccatccagagcctcatcaacctgctggcagacaacaggtacctcactgctgaagagactgacaagatcatcaactacctgcgagagcggaaggagcggctgatgaggagcagcaccgactctctgcctggtgagctacgtggcagggccgaggtgaagttctgactctgcatttctctaatccccaggctctgttgggagggtgtcaggcccagggctctttggagtgggtaagggaactaagtccatcccttgggttctcccgtgggccacccatgctgatataatgttaataataactttatatttgggtactgaatgctgatccctatagttaatgtggtggattgactagtattgctggctccgtggtagccaggatggatgcccttttgttttttagcagttctctaggggaactagcctattgttttctgtaaacagcacatatcatgaagcggcctctttgggaaattgatgttatcgtctgtgtactgtatgattgatgtgactcagtgattgttgttcttcctttggctgctaggcctcctgcccttggggggtactttgaaccagatacctccctcttctgtcttccaggcccgatttcccgccaaccactcggggcgacctcgggtgcctcgctgaagacacagccaagctcccaaccgctccagagcggccaagtgctcccctctgctacacccactccatctgcaccccccacctcccagcaagagcttcaggccaaaatcctcagcctcttcaatagtggcacagtgacggccaatagcagctctgcatccccctcggttgctgccggaaacaccccaaaccagaatttttccacagcagcaaacagccagcctcaacaaagatcacaggcttctggcaatcagcctccaagcattttgggacagggaggatctgctcagaacatgggccccagacctggggctccttcccaagggctttttggccagccttccagtcgcctggcacctgctagcaacatgactagccagaggcctgtgtcttccacaggtatcaactttgacaatccaagtgtacagaaggctctggataccctgatccagagtggccctgctctctcccacctggttagccagaccacagcacagatggggcagccacaggcccccatgggatcttaccagaggcattactgaagctaaatctttcaactctccccagtcccctcatcccctggcctcctcccacttacttgttctaaatagagctgtttggaggatgttctctgcgctcccaggccggcatcgagtgtcatcaatttctaccacctgctctctcttctgcccaaggctgtgttgcttattccttacaaagtttatactgcatttggggctgtatctttttttgttttttgttttgtagaaaataaatatctccgggggcagtacaggtgtctgggcttgtatttgatggggtttctccggtccctgtttctactggatttggagccaggcccagctagccaagtttggaatggcatttgtcatgtcagtagccaccacctttgttcattgtgaacctaccaaggctttccagcttcatacacattgaccagagctcaagctcctgcctgcaactcctgcctagagttgaagaaaagcaaactggccttggcaggcacagtgtcatcataccctcaccccatatgtttggggtctgcttgaggattcataaatcagccactctggattgttgaggaatggccatggcagccacagaaaaaagaatttttctctctgagccaaggttgttttttgtttttttctcttttcttttttgttttcatttcattggaagatctccaatggactgaacagctccagtcagcagcagttaccacaaactgtgaatctgggccccaccactcttccctgttaaccagttctgtcagcatccccctctccagcagcacttccatgaagttggttctgagactctggccgtgaacacccgtttcttcagtgatttgttttgggcttttggctcaaaaccccaggctcttgtttttgtctagactcttattctgtttcctgagcagcaggaggtagggaccactttgatgtcagacttctggtagctggacatgttctcgagatgggtggctgttcgcgacttttgtaccagagtgaaattgttagaaggagggtttctggctgtggttctaaatggagccccaggaagctgccctctccccagggtttgtgctcagtagagccctgtggatcacagtcttgaggtcctctagcaggggtgagggagagcagcgacttcagctgagtccctgccagtggttaagcaaacaatggtttcaaaattcaaggtccccaaatggcagcattttatgttctgacctgtttgtgttatatagtggttttttttttcctctttggaactcttgtgttgttaataaaatgaaatgattactttttaattaaaatgaaaaaagtaa

SEQ ID NO: 61533 - DNA, 31590 bp, Homo sapiens
ggtttgaaaggaaggcagagagggcactgggaggaggcagtgggagggcggagggcgggggccttcggggtgggcgcccagggtagggcaggtggccgcggcgtggaggcagggagaatgcgactctccaaaaccctcgtcgacatggacatggccgactacagtgctgcactggacccagcctacaccaccctggaatttgagaatgtgcaggtgttgacgatgggcaatggtaggtgggggcagatgtgcccaggtgtgccagtgggggcaggtgtgcctgggtccaggagcagatctttggcactcaactttggggtgggaggagaatgatacaaaatggtaggttggtcctacaggccagcacaggtgttgccaagtgaagcccatgtgcccaggcacagtgatcacaggcattctgggtgaagggaggcctgcaagggccaatttccagcaaaagtcgatcccggctattcctcccaggcccttccagtcctcactgcctcacagtggctctgcttggcgcttggcacagtgacgtgatggtgagctcccccttggtgcccagctccagcgattcagcccagcacggccccttcgtgaaccccttgggcctaggttcagagagacggcaagggatgttgtatccctggagatggtggttggagacataaccgcatttctcggtgtctttgggactttcctagggaaatgaaattggcacttagggaaaatggagctctcagggaagttttgctaactacgaagccaactcagcactgtgtgtgttgtgtgtgcgttcgtgtgtgatagtgagtttccatgtaggttgtatgggtggggtgatgccttcaggaacccatttgcatatgtgtgttcatttgtctctgtgtgtgagttctgggtctattttcctttgtattcattgagtgggtctgtgtttgtgtcttaggagttgcccgtgttgatcttgcttatgtatgtaagtgtgtatgtgtgtgtacttgtgtctgtggatgtttgtacatgtgtgctgtgtgtgcgggtcatagagcacatgcgtttgtgcatgcggacctgttggagtgccctgttcttcctgcatctttatcctgtatgggcgttttgtcgtgtgcccatatttgtacctgctgtgtatatatgcagttccctgtgctgcgggcgggggtcagcggtctctggtgtgcacgactgcacagacccaaatgcaggactctgttgttgccactcaccaagtgagattcatatcagcaacatgtccgtttgtctctgagcagattttgttgccgctgcgtctcgccagattgaggcatcccctccgacatcactggagcatatctggaggggtggacagttctccacagggaggtaggggaaaagaggaggcccggaaacccctcctggagggaagagccccatcggtcccaggccagcctcagaggagagggggcaggcagctggctgaggtcagcctgccaccctgcttccttctgtgtcttggagccactcagccagtatgaggctgcagctccagctgaggtctggaatcttgtggtcagctcagctagggtgaggaggcagctgctgggcactgcttgttgtcagctcagcaggtgctcacctgcccctgccgtccagtcacgtgtgaccttgggcatgtcacctcccctatcctggcttctgtatcttctacaaaacaggcttcattcccccaggcctgctggctggacggcttttaggcctgtctgaggaccacgccaggagcgcaaggcaaaaacacaccagagatagcaaacaagctgctgctgcactaggtggagtgttgtgtggccccacgaggaccactgccctgccctgggctgctccccgcccccatcactttttccaagcccaggaactgtgtgctcctgaggcagaggccaagcccctgaactgggagtcccaaagacaagaccacctccagctctggaaccagaaagatctgggctcaaatccggcatagatccttccaacctgtgtgaatgtggcaaggcaatttcctctctgagcctcagtttcctcacctataaaatgggaataaataatagtgtctgtctcccagggctggccagaggataaataagatgaggtgcctgggtgcttagccctggtaaagggcctggccccaccatgggtcatctcaagggctctgagcatctgtaagcagggtccccacattcctcactggagtttgaagtggtctgaattggggttatgtgaagttgtcctctgaagtgttttgagtacatcctgggctggtgtctgaaaggctccaaggatatttctcccccgtcctctccccaccccaatggagcagcagccctgggtggctccttgttcattagaggcccagcagacacctcaacatgtgtggcactggctggagtagcccagcaagcctggaccataaacccatggctctgcttcacgggaagcagtgcgatgacaccaggaagccacttttcctctctaagcctcagtgtcctcatctgtggaatagaggtgctcggctgacctcagaggggagatgatagagctgacagcccccagcccatcctgcctcagaggtgggagctacttccccagcctcctgctgaatggccaggagctgtgggggtcagctctccccgggggtcgggggaggagaggccgagggagaaagggcacccacgtggcttaacaattatccccatctccaggaataattcaccaagtggagggggctgcactcctggggacacctgggagtctgcgatggcagaaatgagatgcggcagtgtctgcttgtgcaaggagcctggaagtcctctgctccgagagttttcctatgtggaaaagtttttatttcatgaacactgatatagtgcttactatgtgccaagcacttcacatacacatatgagaattcaccgaatccccataacgaacctaggggaatatcacgttccccattttacaagtgaggaaacaaaagcatagagaagtaaacgaacacagtcaatgtcacacggctaaaaagtgggcaagctggaattgaaccctgggcagaaggacttcagaggctgtgctgttacctacagtgcatggccctctctgggtcttaactggatgcccctgaggaatccaaggttggattcaggatttctatgaatacacgtgtgtgtgtgtgtgtctgtgtatgtgtgtatgtttgtgcatgtgagcatgtgtgtgtggactgtgtgtatgtgtatgtatatgtgtggactgtatgtgtgcacacatttgtatatgtgtgtgttgatgtgtttgtatgtatgcatgtgtgtggactatgtgcaagtgtgtgcaatgtatgtggactgtgtgcatgtgtggactgtgtgtatgtgtgtgcatgtgtgtggagcgtgtgtgtgcttatgtgtggactctgtgttcatgtgtgtgtactgtatgtgtacacatgtgtgtatatatgtgtgtgtgtgcgtgtgtctgtgtggtgtgtggactgtgtggtgtgtgtgaactgtggtgtgtgtgtgcgtgactgtgtggtgtgtgtgcgcgtgtgtgtgactgcttggtgtgtgtgaactgtggtgtgtgtggtgtgtgtgtgcttgtgtgtggtgtgtgtgcgtgtgtgggaactgtgtggtgtgtgtggactgtggtgtgtaaggtgtgtgtgtgcttgtgtgtggtgtgtgcgtgtgtgtggactgtgtggtgcgtgtgtgtgcttgtgtgtggactgtgtggtgcgtgtgtgtggactgtgtggtgcgtgtgtgtgcttgtgcgtagcgtgtgtgcgtgtgtgtggactgtgtggcacacacgcttgcattttcccgggggctgacccattgcatttgtcatcttcttcaaaggggtctatctttgctgaaagatttgctgacaaataaagggggttcagctgctgctatttttttaaatttggaaacaaattttttaaattttttaaattttttaaatttggaaacagaccagtcaaactgctgccttttatggttagagaaaatgaggcccagaagaaattgaagcagggaaagcgaagttgcccaagtttacaggcgagttagtggcagcatcagcagtagtgcccaggactcctggcacccagcccaagatcctctttccacctgcctctacggcccccctcacatttgtgtagatgcagtagcttttgcctgtgggatgggagggatgggagatgtgtccagaccctcctaggaggccacatgagtgtgactgttctcggcccaagtctttctcgttcctcagagaatttgcggggcccctgggcacacaagctgagatccacccagccctggtcccttggcaagaactgagggacaggacctggttctggggaaaatgcaggggaatgtttctcccttccacagcccccttgcgagttaggaggccggctcccaccccagaaggtggccaggttttcatgccttcctagagaaagctggggctcgtggcctccaccacaggaagacgcagaccctcagaaacaagtctgtgaagtcacaaccagccccagtttacagatgtgaaactgaagctccaaaaagtcaggaggtcactgagtggggaggtgatggagtgggaacagcccccagatctggctgaggccgaagccctggagagatccccgcaaggctcccttagatgcctgacattctgttcttcctgaagcctcactcccttctctcctggcgcagacacgtccccatcagaaggcaccaacctcaacgcgcccaacagcctgggtgtcagcgccctgtgtgccatctgcggggaccgggccacgggcaaacactacggtgcctcgagctgtgacggctgcaagggcttcttccggaggagcgtgcggaagaaccacatgtactcctgcaggtgaggagcctcaatttcttcagctgggaaatgggcacacttgggctcatggccccaaggtctgtcttctccctgagtgggtaggtcccagagacagctgcccttcagggccttcaaggctcttctggttttgtaaaagactttgtgaatccaagaagagcatctattctaggaaccacatttactgatcatcaagctactggctgccgtttattgagctcttatcatatgccaggcacaatactaagtctttgtgtgtatttacccatccccttgagcccattgttgtttttcccattccatggggcctctcctgaagcctcagtagatgagcccgtcttccagtctggtgctgtttttgggacaaataggagattgaccccaggccgttccacctaccccaggggcttccaccaaccccaaagtcttcccaaggccttggagagccctctttcgaaagcatctcctgttctgggtaatgacaataataaaatcatagcagctgtcaattgcgagcacttgtcatgtacaaagactgtgccccatcggcgcatgacttcatttcacctgtcaacacccctgtgagatggttactgttgttattcccattttatagaggaggaagctgtggcttggagggctaggcatttgcccaaggtcaaccagcttgaatcactggcagagccagggttaacattcagggccccacccatcaccacggtgtggcactgcctctacttcctatccccctccagagagaggcttatgtgaaccgagtattaactctgagccataaccaggagcctgctatgggttctgagcttttataggatgtggtggaaatagcagggctctggtactccagaggtcaaggttcccaactcagctctaacaccaaccagcagagcgacccaggaccacatgttgcctctctgagcctcagttttcccatgtttagcaggacaggactgggctcttagagagttcatagcacctttccagctcctggtgggttcaagagagaactcccgggatgaagagatgagagcactgaggttggggggtcaactggatagccagggccctagttctgtcctaagaggaggaagttgtgtcttctccatccaaccatccaaagccctccccagatttagccggcagtgcgtggtggacaaagacaagaggaaccagtgccgctactgcaggctcaagaaatgcttccgggctggcatgaagaaggaaggtgagcctcggccctccccgccccaccaccactgccccacctgcacccacagctccccgacagtcatttacaactgtagccacactttatgactcagtggcaggccccagggtgactggctaatggctgagaagagggagggcctggaaatctgaccatagggagcggctgggcttggtcttgagaaagattcagagagataagctcccactcttggctcctcaggctcccagcaaccaccacccctgcctgcctgtctgcgccaccacaaagcagccacgttgtgtgtgtgtgtgtgtgtgtgtgtgtgtgtgtgtttaatataatatttcgaacgttaggacaagcatagagaatgatattgcaaacatctgagtactcactatcccaactttacaaaagggacagccagaggagcccgatgcctgagcttccggtcccagggacaaatgccccagttcccttagtattcattcgtgggtatcacgtgatctccaaagtcttcacattctagaaaatgggaacaagaccccagacccatcctggacaaaggaggagaagaccagagcacaacatttattaaggtcttgccaggcttcctgctaccagcaggtatcagtcactgggctgtgctttttccacacttcagtaggttgggttcatttcattttcatgacaaccctatatgggaaaatgttgtgaaaatgaaatgagcccagcccattgaacctattacaattcctccctttttgtggatgaaggaactgaggcccacaatggttaagcaacttgcctagggccccacaactgatccttggaagatctgaagtcccagagcttctgctatttggaccacacttcagcactgtctattattttatgctctccagataccagggacatttaaaattgttttcagcccaagcaagggaagcaaaaatcttttaactgctttaaagtaacttgaggccaggcgcagtgaatcaggcctgtaatcccagcactttgggaggccgaggcaggcaaatcatttgaggtcaagagttcgagaccatcctgaccaacatggtaaaaccccgtctctactaaaaatacaaaaaaattagctgggcgtggtggtgcatgcctgtagtcctagctactcggaaggctgaggcaggagaattgcttgaacccaagaggaggcggttgcagtgagctgagatcatgccactgcactccagactgggcaagacagcgagactctctcaaaaaaaataaaaaagtaacgagttcattttcgaatctcttcatttcctgctcctctaaactcaacctttcccagctctgcgactagtcccagaccttcccttctagcccacagttgtgccgtaccagccaaaccttggtctagtcctgctagttcggtacaaacacccctcacccccatcaccccagcacaccccagaagcaggaacgtaggacccagcttgctccagggcccactgagaaggaggggaggggaggctttggtagactctctttcccctgtatctgctcctggccccctgttttctctgccccctcccttggaaatatcttctatgtctcatccttatgggaccttagtctgggctcatgagctgtcttggaaaatctgggcttgctgatcccgatgcaggagtgggtggtccccaaggcctgctctgaacgctgcaattctaacatctagatatcagtggttctccaagggcaagaggggctttttaagctgcaaatactccctcctctcccaaacccagttttcaatggggttaagcctgtctcatccacttcaacttccattttgtggactgggaaagattatgaatgggaacctgatgcatgtgtgaacagttggaggcaagaaaaagattgagaactacagtctaaggttccaacatttctgtggttgtattagtcagtgattccattatcccaaaagcctaagattttaggcactatgattcctcataggtgtcatccagagggcactgtgtttgagagaacagctctctcacagtgaaagttcaggtctgtgacaggcagatgggagaggggttggcagccctcctgagtggatggctacccacctccactgcgtgtggcctggtcctgcgtgtggtcagttgttataaatgtcttttattagacatccagagtcattttcacttgtgtaatttagggacatttctgtctcttctgggctctagttttcccatctataaaatgaggacattggataatgaacccttcagccctatgagtctcgctcctcactccctgacctacctgcacaagtcacactgcccactaggatgggtgtgtttgttccctggtcccttcttttttttttttttttagatggaatttcgctcttgttgcccaggctggagtgcaatggcagtatctcggctcactgcaacctccacctcctgggtgtgagtgattctcctgcctcagcctcccaagtagctgggattacaggcatgtgccaccacacctggctaattttgtatttttagtagagacagggtttcaccatattggccaggctggtctggaacccctgacctcaggtgatccgcctcggcctcccaaagtgctgggattataggcatgagccactgcgcccggcccctggccctttcttgagctgctgcaaagccagcaaaccccttactaggctcctggaagggggatgagagccccagaccattcagccttagctcagccttgaaaatagctgcttgcttcctggcccagggaaacggacatgctgcccggaggataggagagttggctgatggcgagtgagcgtgggttagtcgatgctagtgtttgtttacatgcctgggttacctggaagatcatgacacatgcagtcacttggttgttttgagaacgggccagagtgacaaagtgttcagttgccactgtggtcaagccataggaaatgagggtattcctagctgtgcctgtcttctaggccccaccacccctcctcagcctgctgggaagctcccaaagccaaaagaaagtctcggtggaagtctcactggccaggagagttgggacaagtttttatttctttttcttgatgaccttaggagaatttgaggactgaaaccctaaaatagtccctgagaaccagaaagtgtgagctggaaaggtaggatttcaagaccagctgagtctataagaggtcatcaaatctacctgctccccactttacagaagaggacactgaggctagagaggtgatgtgacgggtcaggggtggagtcaggtctagaactcaggctccccagagctgagcagacaccaagctccctggagtgaaacttgcagtgatcagcttgggaggcacatttcttgatctagatggctgaaactttctctcgaccacagagaggggcttcaggtctcatgggcctataagtctctgccacaggatagtccaccatggctggaaggggctccctggaaggccaaagaatccagggagaaccctgggggtcagtgggccaacagcaggtcaagaattctttcctgcaaccgaaagccagggagacagacacctgccttggcctaagctgtcaggcccaggacaaatattcggctcctggcatcaaaaacccagcccagaaagcggacccagagttgcaggaggtgagcgtaggtgatgggccaggggccatctgaagaggccttcctcggaagcccctgccctgctccccacagccccctacccaggagttccctgggaagacaggctcatcacctctccgcctctgcccaggtcggttaatattcaatagaagttacattaggtccccgaccctgctaatactgagcaaacatttggaaaacatcattccgtgactgagctcgcgccgggcactgataacgcccgcctaaccttgaggagccctatccgcagctgctgacagcagccctttcattccgcccgccggccactcggcgccctgatgggtgggtgcgggtgctggcaggaggctgccgtgggaggggtgtgggcgggtggggtggacggcccggtcagggaagccgtgctctgagctggccccgtccacatggtggtctgagaggaggttgcttgcctctggacttctgttctatccactgactcccgggctcaagtgcaaaggatttgacttttattctctgattttaacaatgtgtcaacatcaagagaaagttgaatagctggggtgtcaatgttccctggagaaatagggttcttataagaattagagtttatgaccaggtgtggtgcctcgcacctgtaatcccagcattttgtgaggctgagtggatcacttaaagccaggttttcgagaccagcctgggcaacctaatgagaccccgtctctcaaaaaaaaaaaaaaatttagccaggcgtggtggcacacgcctataatcccagctattcgggaggctgaggcaggaggatcgcttgagcccaggaggttgaggctgcagtgagctatgattgcaccactgcagtccagcctgggcaacaaaatgagaccccatctcgaaaaaaaaaaagaaaaagaattagagcttgtctcttccaatgccttcgttctctcactgcacaaatattcattgagtacctactgtgaaccaggccctgttctggtggctgggactacagcagtgaactagagggatggagttttggccttctgaagctttccttctcagagagagacagatagtaaaggaagtaacaaataattctacaataagtgacttgaagaaaaataaagcatggggggcagggccagggtgggagtcatgttgtgttagacagggtggctggagagggtgtctgaaaggcgacatttgtgcagaggcaggagtgaaatgaagatgctgctgcgctgtgcaggaaagggaaccccaggcagtgaccacagcagcctacaagcgtgcggatgcgtccaggtggggaggcgggttttcgcggacagagtgtgtagggggaagccggtaaaaggtgcgatccgagaggagaggaagggccctggggacttgtgaggttggaaggcactggttttgagcagcaggcgacatgacttgaacggatccctctgtctctgagaggaacacagactgcaggcgcaaggcagaagcagagcccaggaggaggctgatctaatccaggagagacagcgggcctgggagcagggagggagcagcaggtctgtttgtcaggatcacgacagcactggggtgtgaggggaagccaaggaaggtggccaggcttgatgccagtccctgagacgagaaagagtgcagggagccggctggcagggaaatgcctacgggtagggaaactgagccccagagagaggctgcgattgccaccggcacacagagtggcaggttccagacaggaagccgggtctggtgcagcttcaacctccctcctttctgaatcagccaagcctcattccacagtgaggcctcttggactccaagggctatcccatccactgtcgggatggtggaaggatcatcttctatctcaggccaggactgacccagatgggagcaggcagtggagcctggggccccggtgggcgtaggctccagatccctcagtgcctggaacagagcagcagtgggagggagggagacagcgcctggccttgctgatgctgaggttagtctggagtacatgcagctcctgctgatggacaaaaccatcaaggcagttggagcccccagatcctcttgttcaggaatccccaggccatctccttgtcacccagagtaatttgttttgcttgctttactcactttcatttggaaagaaagggacccttttgtagaccagagcttgaacatctttaagctagtcagatcccctcctcaatgctcaagaccaattttaaacccatagccgagtcttcactgtcttgcgcgcccctgctgatgggtggatcactcttatagcctctccattgtgttgggggcagttgtgatatgtggaaagttcttccaccagctgagttagaggccatctcccctcattccacatgctgatgtgggcctgttctctggacaccccccacctcctgctcccactcctcatcagtcacagacacccccaccccctactccatccctgttctccctcctcacctctctgtgcctcctcacagccgtccagaatgagcgggaccggatcagcactcgaaggtcaagctatgaggacagcagcctgccctccatcaatgcgctcctgcaggcggaggtcctgtcccgacaggtaccggggtgatcctgccacccacccagggatcccccacactacagaggagctcacctcctccacctccattctccccagccaggccctggagcagctgacgggaggggcctcagatattacagaagggacactgagtccggtttcacatggcccagtttgcagcaagggcaggaatcgaacctggcgccctggggcactttctaattcatcctactgcctgcatcccacaggccaagcagagtcttcaccttcactgagggcctgcgatcagctcagctccgagagaacagagcagtggctcagtggagagaggtggcaaagtggggcccagcccttcccttgctgagtgaccttgggcaagtcacagcacctctctgagccatggttgcctcattgtcagaaaaggatgatgattttttgccctgcttctcctctaaggctgacagactccttggggctctaaagctgacagaggagggggcagggggcaggtaacaggtgaaggcacagagggagcccttctccctcatccctgcctcctccctccctccgtttttaccctgagcttccttcagagctggagggcacccactatccagccccctccccacatctgattccagggagggggctctgtgcaggggacagagagtgcgggagggcccggacatctccagcattttcttccctgtatctctcgaagatcacctcccccgtctccgggatcaacggcgacattcgggcgaagaagattgccagcatcgcagatgtgtgtgagtccatgaaggagcagctgctggttctcgttgagtgggccaagtacatcccagctttctgcgagctccccctggacgaccaggtgaggatgggcgtggatggtgggcagtagtgggcagtgggcggggcagccagggggctgctggcccacctgggatatagccgtggactggcttgattttattttatttaacaaaatatgtagtgcacacacgtgtctgaaactttaaatcaccttacaaatattaactcagttagctcctccaacaactctatgaggtaggtactaaggtactattattactgccatctcataggtgaggagattggggcacagagaggttaagtaacctgctcaaggtcacatagctactatccagcatagctgggattagaacctggcaggaagctccaaagtccaagctcctgaccattgtacctgaggctctcccagggggatgttgacagggaccctaggacagggatcaggagattttggcttaagctatggctctaagactggttgtctgcctaatcctgggcaaatgagttcctctctctgagcctcagtgttctcttatctgtaaagtggaaatgataatatccactttagagtgtggttgggaggattgaggacattggtgtctgaaaagtacaaaaatcaggtgatggggcaagctgcacagtggccagaccagagctggtctccctaaacattagtttcttccttgtttcccaccaaaacgattgaactcagcatcgtgtttcccaccaaaacaattgaactgagcatcatatttcccaccgtacatttttttggaatactgaaatgtccctagggggaagaaagggttgaaggaaggtggcgtgtgtctgaggacagatgaatttcggagatgccacctatgaagctcctgcccagagcacccctgggcctccaaagagatgttacccatctggggaagaggagctgggctgggccaccttctcagcttcggagacagactctggtgcattcgcttacccgtttcgcacctttgcataagacactgacaatgcatgtgagtctgtgaaagcttctgagaagtctcgtccaggcagttgtttgactttgcagaggccgaggcttctcaaactccttcggcaagattctcctggaacacctattaatactgcacattgggacactgtgaaaacgctggtttggcttgtccccagcctcatacaggggctggacccggggccctcttccatggttcctccttccattagcagagtcgacagggcaaggatcttggacaatccgcccctaccctctcccctgttccttgtgctctggccccagtcccctctgctggagtctctacattaatgtttaatccctcctgttccttcccaggggcttagcagggcaacaagatacccccaacctgagcaattgttaacctcgatttcccacccaaacctccctggctggggctcagagcattctcagagagcaatgatgggtggccaataacacaggacaatcattaacacaccaccccgacctcccggcccaccccccagaacagctgccatatcagggggttgaacctgggatcagaagggttcccagctccccattcctggtatatgaggagcccagcttgcccaatgcaggtggggcatccctgggaaagtcgggggcattgtcctccaaagggcttcccaattttgttgacattgccccagaaactagattcccagttggtgtgcttcttgggcctggatacaattgcagaaagagattggggcttagagagagacagaaatttgcctgaagtcacagagcaagttagcgacagaactgggattcaaatccaggtcttccgcttcgcgatgtgaaggccactggagtgactgatgaaagacttgcacagtgcccagtgcgcaggaggcgcttggcaatcagcatcctcggcctccctccatactggtcatggaaagtggattttccctcccaggcagtttcctctttttctgttttcctcacaggtttctatccatggggaatagaaggggcaaggacaagtggctgcccaggagcagctagagctagagaggaagtcaagatgtttgctcattcattcattcatttcccctttccttccttcattcaaatatttattgaaggcttattttgtgccaaatatcttcagacaaatgccttctttcctctaacaacaatttcacctccttagaggccttctctgacctccccatctaacgtagccattcttgccccattgctctcaccatcctttccactcccctccctccctccttcccttcctcccaccttttctccttccttctttcctttatgctgtgatcaccctgtgtcctctgtacttatttgttctctactatctgttcatcctctctcctataaatgttagttcgatgagattagagaccttgtctctcgtttttaaacattgtgcctccattgtcttaaaaagtgtctggcatttagtaggcatttaggatttgataactgaaagaatgaacaatcaaattaatgaacaaacaaaggattttaaccttctagtttggcttgctatggaacctccaaactccctaacccaaccttgaagatgagaagatgagatccttgaggctaccagcctggtgctgttttgtttcaagccatcctttggtcctcaggcaagcactaaagcagatggctctcagtgggctggctatgtccttctgtgagcttgctgggcccctacctatgactccagtcttagaagtcttgccttgtaccccctgcagagaatggtttcatcaagctgattctctgccaggggccagtgctcatacatttgctctgagaaggaccagccctgagacctaacatccacatccaagttcttgtaatgccctctcagaatcctggagtcctgcaatgtcgatccctggagggatctgccagaccaatgatttcccaaacagaattgcacttcagagtcaactatggagctttttaaacacagatccctgggcccaccctaaacatacaaaatcaggatcagaatctcagggcctaagaatctgtattttcaggccgggcgcagtggttcacacctgtaatctcagcactttgggaggctgagttgggctgatcacctgaggtcaggagttcgagatcagcctggcaatatggtgaaaccccgtctctactaaaaataaaattagccaggcatggtggtgcacgcctgtagtctcagctactctggaggctgaggcacgagaatcacttgaacctgggaggcggaagctgcagtgagccgagatcatgccactgcactccagcctgggtgacagagtgagactctgtctcaaaaaaaaaaaaaaaaatagaatctgtatttttacaaagcacccttcataattctccatagctggtccatgggtgggaatttgggacccacagttttggaactttttgggatcatagacctttttgagaatctcaaaaaagaaaaaaaaagcacacagaatgttgcttacagtttcatcaggcacacagaagaggcccagcacgaagcagtttcttgcccaaggacacagcagttcaaggacagagtcagcgcgaggtctctcagctctgagcacatgttctttccccttccaggtttctagttttatgggtagtagttttatgatgcccatttcacagttcaggcaggtagaggcagaggggagcattaagctgacttgcccagcgtcactgagttggctacgggcagccttcccaagggtacagatggcaaacactgttccttctctctttcaggtggccctgctcagagcccatgctggcgagcacctgctgctcggagccaccaagagatccatggtgttcaaggacgtgctgctcctaggtgaggcggctgcctgccctggccagggctccagggagggtatgcctagcatggcactcacccaggcaaggagattcacatggtggcatgcaagggtgagggagactagtcaggagtggccctgtcctcaggcttgcattagagggctccaggactcagttttcaactgggtaccccactcagatgcaaggaaatgtggatgcaagtcaccaaattcccagcattgaagtcagagcacgatcagggttatccctggaattacctgtgcatccttttttcttttgacagagtcttgctctgtcactcaggctggagtgcaatgatgtgatctcggctcacttcagcctccacccgccacgttcaagcaattctcctgcctcaccctccagagttgctgggaccacaggcgtgcaccaccacacccagctaatttttgtatttttagtagagacagggtttcaccatgttgaccaggctggtctcaaactcctggcctcaaataatccacccgcctcagtctcccaaagtgctgggattacaggtgtgagccaccgcgcctggcctacctgtgcattctgatgttctttctggagtaggagcaagaggtggttaagaatggcacaaagccccagcccgcgtcacctgtgccttcatggcatagttattattttaaacgcttgtacagcacacactgtgtgccagggactgtgctcactgctttgcaaacactacctattttaatataacaatgctatgagggaagctcgattatttatcctcatcttatagataagaaaactgaggcacagagaggttaagtaacttatccaactataaccagctatcaggggcagagccatttaagcagggcagtgcagttccagaatctggtcctttaaccttgatgctttggtgcctatcaggtgacctttgaatgtcatcgatcttgtgagtcatgttggtaaatggagcttgggtcatgtgaaagaggtcctagaaagccaagttccaagctcagccggatgactcaaggcagcttatcttctgaatctgggcctcagcttccttacctgtgaaatgggagtcaccatccctgcaggtcctcctcccacaggcaccagctatcttgccaacttaaaagccaaaactagaggagaggggtcaacccaaggtgacttcccatcctccctccctcccaacccttccaggcaatgactacattgtccctcggcactgcccggagctggcggagatgagccgggtgtccatacgcatccttgacgagctggtgctgcccttccaggagctgcagatcgatgacaatgagtatgcctacctcaaagccatcatcttctttgacccaggtacagtgcacacctcctaagccatccctgactctctctccagaacgctctgccagacttctcctattgggttctgtacactgagttcacagcctcatctcatgttaacgacagccaggagaggccgttttcatttaacagatgaggcaagtcaagatttgaagagacaatatggccgggcgcagtggctcacacctgtaatcccagcactttgggaggctgaggcgggcggatcacctgaggtcaggggttcaagatgagcctggctaacatggagaaaccccatctctactaaaaatacaaaaattagccaggcatggtggtgcacgcctgtaatcccagctattcgggaggctgaggcaggagaattgcttgaacctgggaggcggaggttgcagtgagccaagatcccgccactgcattccagcctgggtgactccatctcaaaaaaacaaaaacaaagggaggatatgacttgacagggcaccctgactccaaaggcctgggctttcccttcttttacttcttccctccatccttctttctctttacttcccatcttcctcttttctttcatatttgcttcttttcctcaaaaaaatttatcaaaataatatctagaaccggatgtggtggctcacatctgtaatcccagcactttgggaggcagaggcaggaggatcacttcaggccaggagttcgaggccagcctggccaacataacaagacctcgtctctatagaaactaaaaaaaattagccagggatagtggtgagcacctgcagtcccagctactcgggaagccaaggtgagcacctgcagtcccagctactcaggaggccaaggtgggaggatctcttgagcccaggaggtggaggctgctgtgagatgtgattgcaccactgcactccagtctgggtgacaaagcaagacctcatctaaaaaataataataaataaataaataaatctacacatacttaaaatgcaaatacttctccccatcctacttttccagctctaagtctactccccaagagaagcatgtctgattattttaattgtttcttctggcagtttcctcaacaattctaaatgaaagacaaagccttatatttgttgatgcatccattttggatcataatgttcctcctaggatggcagaggattttgcttttctccatcaccattcccatcttttcttccccatttttcccaatatatttttattgctatttttgagtctctgttgcaagttatgtgcttttatctttcctttcttgttctatcaactgtagacggtatctcccaacccttcacattgcaggatgaagaaaaagcattcctaccctctcctgtggctcttggctctcctctccccattctgtccactgacttttgcacctgcatttatacagaatgcatttgtcatcagtctttgtacaaaacttgcttttgtttcccagcatcaaaggtgcctgaactctggaggcttgcttgccttccctgcttacatgttagaggggacctactgtgtgccaggcactgtccttcacgctgcaaatagattacctctagtaataatagtaatgaaaaggctgggtgtggtggctcacgcctgtaatcccagcactttgggagactgaggcaggcagattacttgacgtcaggagttcaagaccagcctggccaacatggtgaaaccccgtctctactaaaaatacaaaaatcagttgtgtgtggtggtccgtgcctgtaatcccagctactcaggaggctgaggcaggagaatcgcttgaacctgggaggcgggggttgcagtgagccaagatcatgccattgcactccagcctgggcaacaagagcaaaacttcatctcaaaaaaatacatatatgtgtatatatatataatatatattatatatatataatatatagtgatatatatagtatatagtgatatattacgtataatatatattatatatagtgatatatattttatatatatatagtgatatatattatatatagagagagtgatgaagtggaagatgagccccatgtattgaatgctccctaaagagctgtttttaaacactttatgtggattgtcttacttaccaacatggtacctgtgaagtaggaattattattatctccattttacagataaggaaactgaggcatgattaacttgctcaaggtcacacaaccggaaaatggcagagcttggatttgaacttcagaccacctgtcaatcccaatttctctctctcaagcccacattcttacctaccacctgctatcccacacttaccagagggtgagatttctagttctagttccctccacagcctggcccagcctgtatcctctgtagtgctcaacacgaggctggactggcagaattgttctgcaaaatgggaaggatcactgatgctgagtcagaggcagcagcctccagcaatttgaaggggcgggggacctagttcaaggcctggcatgcaggaggtgctcaataaacatgtgtggcctgaatgaactaatgaataagcatgattcagtggagacagcccactagaaatgtgggtgaatgttctttctgccacttcctttgtccatgaaagaggaaataaatgcattacctccatgaaggttgagattaaatattgtatgaccgcttaagttcctttctaggctaaggatctagaatttattcactgatttttttttcattcattcatccagccatctaacaaaaaatatacatatagttatcaataaatatatatttatatataaatatatattttttaaaatatatatatatatagtctgtcacccaggctggagtgcagtggcaccgtcttggctcactgcgacctccacctcccagtttcaagcgattctcccacctcacctcctgagtcgctgggattacaggcatgtgtcaccacgccaggtgaatttttgtattatcagtagagatggggtttcaccatattgaccaggctggtctcaaactcctgacctcaagtgatccccccgcctcggcctctgacagtgctgggcttacaggcatgagccaccatgcctggccctattcaataaatattgactatgcatggtgctaggtggtgagtttgaaaaggcaaaggccgggtgcagtggctcacgcctgtaatcccaacattttgggaggctgaggcaggcagattacttgaggtcagaagtttgagatgagcctgaccagcatggtgaaaccccgtctctactaaaatacaaaaattagctgggtgtggtggtgtgtgcctgtaatcccagctactcgggaggctgaggcaggagaatcgcttgaacccaggaggcagaggttgcggtgagccgagatcacgccactgcactccaggctgggggtcagagggagactcagtctcaaaataaaataaaataaaataaaaatggcaaataagacatacgcgtgcccctgccaaactcacagttggatggcacaacaattacatcctgtgtggtcagcagtgatggaggggccgcagagatttggaaacaggagggacacaggatacagatataggagggtagaaggcagacttcctggaggaggtgaaacctaacctgagtccctaaggtgataggaagcaggaaccagggaaggggagcctattctaacacagtagaagcagcaactgctgaggtctggatgaggggacctcaactgtggcccaaaaccccaagttcccattgtggctctgccaacaactggctgtgcgacccaggacaagtcctatctttgcactgtgtctgggtttccccgtgtgtaagatgaggcggttgctaggtgcttattggatgcattcctcaagtcccgccctccatctcctattcccctctcttctggtttagtgctttaggaaatgtggcagaaatctttttctgcctgtgtctaggaaatcataattcatgctggcgtaccctggttgttgaggtccctgaatccttgtgcccacactgctgaagactccttgtgtgatacaagtcaggggacatctgggtcttgactccccagatgctccagctggaccctgctgccctcccttgcccaccctcttccattgtagatgccaaggggctgagcgatccagggaagatcaagcggctgcgttcccaggtgcaggtgagcttggaggactacatcaacgaccgccagtatgactcgcgtggccgctttggagagctgctgctgctgctgcccaccttgcagagcatcacctggcagatgatcgagcagatccagttcatcaagctcttcggcatggccaagattgacaacctgttgcaggagatgctgctgggaggtccgtgccaagcccaggaggggcggggttggagtggggactccccaggagacaggcctcacacagtgagctcacccctcagctccttggcttccccactgtgccgctttgggcaagttgcttaacctgtctgtgcctcagtttcctcaccagaaaaatgggaacaaggcaatggtctatttgttcaggcaccgagaacctagcacgtgccagtcactgttctaagtgctggcaattcagcaaagaacaagatctttgccctcggggaggctgtgtgtgtgtgagtatgtatggatgcgtggatatctgtgtatatgcccgtatgtgcgtgcatgtgtatataaagcctcacattttatgattttgaaataaacaggtaatatgatagagtttaactgaaaaggaatcctctttagataggggaggccacaggagacctctctgaagtggtgactcttgtgctaagaccctaacggctgaaaggaaatggaaggcttaaaagacaagagaggaatattccaagaagaagaaactacttcaagggctgcggataggagagagtgttgtgtttgagaaagaagggcaaggttgtgagatggaggacgtgtaggaggtgaagatggagattgggcagaaaccaaatcataaacatatggctttgtcagccttttcagaaatttggattttattctcattgcaactattgtaaggagagtgaaaaccagactaagtatttttattctttgagacaaagtctccctcaatcatccaggctggagtgcagtggcacaatcttggctgactgcaacctccacctcccgagttcaagcaattctcctgccacagcctcctgagtagttgggattacaggcgcccgccaccacgccctgctcatttttttatatttttagtaaagacagggtttcaccctattggccaagatggtctcaaactcctgacctcaagtgatcacccacctcagtctcccaaagtgctggaatgacaggtgtgagccgccacacccatcccagactaatgcttcaaacaaaccactctgttgggtagagagtgaattgcagattcctgagaatgtcactgtctccaatcatgtgatggatgatggaggcttggaccctggcaatggagcagtgaagataaacctgatcatctatttggaggaagagcccacacccacaggatttgctgattgatcagacatagggagtgagagaaagaggaagagtcaaggacaaagtctacatttttgctttgagtagcagaaatgacgatggagtaatttactgaaatgaggaggacagaataaacaacaagacactgggtctgggggtggtagtgaggggtgacctcagagatccattgtggaccctcttttcttttttccttttttttttttttttgagacgagatctctctctgccacccaggctggagtgcagtggcgcaatcatagttcactgtagcctcaaccttccaggctcaagagatcctcctaccccagcctttcaagtagctgggactacaggtgcgtgccaccacacccagctaattcttcattcttattttttatagagacaaggtctcactatgttgcccaggctggtcttgaactcctagccttaagcaatccttccgacttggcctctcaaagtgctgggattacaggtgtgagccaccatgcccagcctcattgtggactttcattaagcatgagatgactattacaaatccaagttatcaaggaggctgttgaatgtatgagtctgttgctcaagcacaagattaaaggcagctctgtggaatcagggggaagatggagccatggagggaagggaagaagactggccagaggggtaggagaaaaccagggcaattccagaatccaagagaagagcgtgtttgaaggacagagtgtttaatggtgttaaactctacagagaaacagaaagaagcggggaagaaaggagaggtgaagagaggaggggaagagagaggaaagggtccattggattgacagctggaggctcttggcaattgtgttgaaagcagcatcagagagctgggagagtggaaaccagattggagagtgctccaaagagagtgagtgggaaggtggagatagagtagataaccctttgaaatggtttgactatgaaggggagtatgaaggagttaggatgactgcaagggagtgattagaatgataggtcatggagtctgggctgcactcaaaaagaaataaagatagaggccgggcacggtggctcacacctgtaatcctagcactttgggaggccgaggcgggtggatcacttgaggctaggagttcaagaccaacctggcaacacagcaaaacaccatctctactaaaaatacaaaaaaaaattagccagacatggtggcatgcacctgtaatcccagctactcgggaggctgaggcaggacaatcacttgaacccgggagatggaggttgaagtgagctgagatcatgacattgcactccagcgtgggcgacagaacaaggctctgtctcaacaacaacaacaaaaggatggggtgatagtgaaaagagagtgtcagtgaattgacagtctcagtagggctgaagaatttttgcagcgatggtattagattacgggagctggaaggacatgaggtgaagtcaaagtggggatgttgaattcgagattttggaggtgtttcagtgactgaagatgacaaggcgagggtgaggtttctcaacattggtactattgatacttggaactggacaattctttgttgtgtggggctgtcctgtacattgttcagctgcatctctgtcctgtacccataaggtgccagtagcacttctccagtggtgacaaccaaaaatgtctttggatattgtcaaatgtctcctgatgggccaaaatcatccccagttgggaatcgctgttatgtgatagctcatttcattctcactttgaccctgtgaacatggggttattatgaatcaggtgtcattgagatcaggatcaggagcctgtggtctgttgccaaataattaagagctctctgggctcagttgtctcatctgtagaatgggctaataatagtatccatcctataggattgctgtgaggattaaattatgtgaaacatgggaagtgctatacaacagtacctggcacgtgataattgttaattatcaacaattgttatttatcactgaaatagatgtactgtagagatcgcttgcaagcgttgaaattccatcatcgtcatattactcaccataggctattattaaaccatatcccatgtggtatttttactccctgacatatgtttgaagcggttactgtgttccagacaatctgctaggccctcaaagaaagaagaaaaatacctctgaaattgtaatgctcatagacagaagaagtggttgttcctaaaagttgtgttacagacaaattactatgagaaatccaaggaaggagaatcaggagaggcttctaaagagaggaaatatatgagctgggatttgggcttatggacatggaacaggtttggggtggaaaaacatctctgacagaagcaacaacgtgagcagaagcatagagatagaaaaacacaggggacacatagatgctataagtaggtcagttggctgcagcagagatgtgggggatgaggctgaaaggtgaggcgggaccaaatggttgaaggacttgcactccaaggagctttgagagccattgattacatccattatgttactatgtgaccaatacactactcattagaacatttacgtgatctcagagcttccttatatgcaccttgttcctttcaactcacttttgttctcttggttttttggggtcctcttaacaccctcatgaagtctatagatgggaatggtacaccctagtttactaacccaggaataggtacccaacaggcactgccaatattggatgggctggttgattggccacgcctgaggaagatggcgtcccaaggcctgaggtctgcatcccagactctccatcctgatcgaccttctctacctgcagggtcccccagcgatgcaccccatgcccaccaccccctgcaccctcacctgatgcaggaacatatgggaaccaacgtcatcgttgccaacacaatgcccactcacctcagcaacggacagatgtgtgagtggccccgacccaggggacaggcaggtgggcaaactctgggattttaccttgcaaagggtgaggatggggcttaagacaggaggcaggagaaagtggagtctagaaggtagaaccaggatgcaacagttttctgggttccagggtagggaataaagggcaagattgtccatttgttgaggctgtttattcagtaaggtgactgacagcctttactgaatgaagccattgttgggatgaggcaatccactggatgaggtaacccattgggtgaagatgttcttgggtgagaattccattagttgacattgtccattaagtaaaagtggtcattgaagtaaggctgcacagttgggtaaggctatccattagacaattagatgagactacccattgggtcaggatgtctgctgggctagaccatcctctgaaacctccaaagtataaacttgtcattgggcaaagctcttcaaaggataagattatcaatgggatgaagtgatccactgagataagatgatattttactgacattgttctcagggaaagttttccattgaacaaagatggccaattgggtcaaatttgctctccaaacctgccatgagagtgaggccaattagtttctattactcatctcctaaatatccaagaaatggtattttttgagccagctggtccggggtttcatcaactgctgctccttctcccaggaaagactatccctgtcacccatcccattgccgctggggacagccaggcctgggccttggtttgggagaagcagtccaagtctgcatatcaaataaatgatggaggagatgggtggtaggaccttccagacctcataaaacttaggctttatgatctgggactcacagaaggttgagcaataaaagaccttagggattatctggtttaattaattctctcattttatagaggaagaaattaagtcaaggtggggcagggtgggaggggagaactttcccgggcctcttcatttactcccacaaaggctggaattttgagcagcccctgtctgtctgtttgtccttccagccacccctgagaccccacagccctcaccgccaggtggctcagggtctgagccctataagctcctgccgggagccgtcgccacaatcgtcaagcccctctctgccatcccccagccgaccatcaccaagcaggaagttatctagcaagccgctggggcttgggggctccactggctccccccagccccctaagagagcacctggtgatcacgtggtcacggcaaaggaagacgtgatgccaggaccagtcccagagcaggaatgggaaggatgaagggcccgagaacatggcctaagggccacatcccactgccacccttgacgccctgctctggataacaagactttgacttggggagacctctactgccttggacaacttttctcatgttgaagccactgccttcaccttcaccttcatccatgtccaacccccgacttcatcccaaaggacagccgcctggagatgacttgaggccttacttaaacccagctcccttcttccctagcctggtgcttctcctctcctagcccctgtcatggtgtccagacagagccctgtgaggctgggtccaattgtggcacttggggcaccttgctcctccttctgctgctgcccccacctctgctgcctccctctgctgtcaccttgctcagccatcccgtcttctccaacaccacctctccagaggccaaggaggccttggaaacgattcccccagtcattctgggaacatgttgtaagcactgactgggaccaggcaccaggcagggtctagaaggctgtggtgagggaagacgcctttctcctccaacccaacctcatcctccttcttcagggacttgggtgggtacttgggtgaggatccctgaaggccttcaacccgagaaaacaaacccaggttggcgactgcaacaggaacttggagtggagaggaaaagcatcagaaagaggcagaccatccaccaggcctttgagaaagggtagaattctggctggtagagcaggtgagatgggacattccaaagaacagcctgagccaaggcctagtggtagtaagaatctagcaagaattgaggaagaatggtgtgggagagggatgatgaagagagagagggcctgctggagagcatagggtctggaacaccaggctgaggtcctgatcagcttcaaggagtatgcagggagctgggcttccagaaaatgaacacagcagttctgcagaggacgggaggctggaagctgggaggtcaggtggggtggatgatataatgcgggtgagagtaatgaggcttggggctggagaggacaagatgggtaaaccctcacatcagagtgacatccaggaggaataagctcccagggcctgtctcaagctcttccttactcccaggcactgtcttaaggcatctgacatgcatcatctcatttaatcctcccttcctccctattaacctagagattgtttttgttttttattctcctcctccctccccgccctcacccgccccactccctcctaacctagagattgttacagaagctgaaattgcgttctaagaggtgaagtgattttttttctgaaactcacacaactaggaagtggctgagtcaggacttgaacccaggtctccctggatcagaacaggagctcttaactacagtggctgaatagcttctccaaaggctccctgtgttctcaccgtgatcaagttgaggggcttccggctcccttctacagcctcagaaaccagactcgttcttctgggaaccctgcccactcccaggaccaagattggcctgaggctgcactaaaattcacttagggtcgagcatcctgtttgctgataaatattaaggagaattcatgactcttgacagcttttctctcttcactccccaagtcaaggggaggggtggcaggggtctgtttcctggaagtcaggctcatctggcctgttggcatgggggtgggacagtgtgcacagtgtgggggcaggggagggctaagcaggcctgggtttgagggctgctccggagaccgtcactccaggtgcattctggaagcattagaccccaggatggagcgaccagcatgtcatccatgtggaatcttggtggctttgaggacattctggaaaatgccactgaccagtgtgaacaaaagggatgtgttatggggctggaggtgtgattaggtaggagggaaactgttggaccgactcctgccccctgctcaacactgacccctctgagtggttggaggcagtgccccagtgcccagaaatcccaccattagtgattgttttttatgagaaagaggcgtggagaagtattggggcaatgtgtcagggaggaatcaccacatccctacggcagtcccagccaagcccccaatcccagcggagactgtgccctgctcagagctcccaagccttcccccaccacctcactcaagtgcccctgaaatccctgccagacggctcagcctggtctgcggtaaggcagggaggctggaaccatttctgggcattgtggtcattcccactgtgttcctccacctcctccctccagcgttgctcagacctctgtcttgggagaaaggttgagataagaatgtcccatggagtgccgtgggcaacagtggcccttcatgggaacaatctgttggagcagggggtcagttctctgctgggaatctacccctttctggaggagaaacccattccaccttaataactttattgtaatgtgagaaacacaaaacaaagtttacttttttgactctaagctgacatgatattagaaaatctctcgctctcttttttttttttttttttttttttggctacttgagttgtggtcctaaaacataaaatctgatggacaaacagagggttgctggggggacaagcgtgggcacaatttccccaccaagacaccctgatcttcaggcgggtctcaggagcttctaaaaatccgcatggctctcctgagagtggacagaggagaggagagggtcagaaatgaacgctcttctatttcttgtcattaccaagccaattacttttgccaaatttttctgtgatctgccctgattaagatgaattgtgaaatttacatcaagcaattatcaaagcgggctgggtcccatcagaacgacccacatctttctgtgggtgtgaatgtcattaggtcttgcgctgacccctgagcccccatcactgccgcctgatggggcaaagaaacaaaaaacatttcttactcttctgtgttttaacaaaagtttataaaacaaaataaatggcgcatatgttttctaa

SEQ ID NO: 61534 - DNA, 23830 bp, Homo sapiens
atggtccgaggggggcggggctgacgtcgcgctgggaatgccctggccgagacactgaggcagggtagagagcgcttgcgggcgccgggcggagctgctgcggatcaggacccgagccgattcccgatcccgacccagatcctaacccgcgcccccgccccgccgccgccgccatgtacgacgcagagcgcggctggagcttgtccttcgcgggctgcggcttcctgggcttctaccacgtcggggcgacccgctgcctgagcgagcacgccccgcacctcctccgcgacgcgcgcatgttgttcggcgcttcggccggggcgttgcactgcgtcggcgtcctctccggtatcccgctgggtgcgtctggggacgctgcccgggctccacgtgcggagtgggtgccccctaggccggggagcgggggatccccaggggtcgcggggccctggaggagcgggcatcggacgcggacacggcggggtgcatcccgagggccccctccgaggcagatgcttcctgcgggggcgctgttcctgggcccgggaagggggcgttggaaccccgagcggtccgggccgaagcctgggactctcgtgcgtccccacccctacccccatcaggcgcccgtgcatgaagggagaccctcacctccggactgagagtcggagcgtctcggagcgacggggagtagggagcgggacccggggcggagggtagtgctggcccctgcggactccgggtcccctgtgtcctctcgggaggggctggacgggctgagctgccgaggggccgatttgccctgggccggacaaagagtggggctttggccggtcccccacggtgggctccttccctctggggattgagggactcaagacaccccgcgcctgcgcttttcttttctttttttctttttttttttttgagacggagtttcgctcagtcgcccaggctggagtgcagtggcgtgatctcaactcactgcaagctccacctcccaggttcacgccattctcctgcctcagcctcccgagtagctgggactacaggcgccagccaccaagcccggctaattttttgtattttttagtagagacggggtttcaccgtgttagccaggatggtctcgatctcctgacctcgtgatctgcccacctcggcctcccagaatgctggggttacaggcgtgagccactgctccctgctgcctacgctctctgggtcgcagcccagccttctgggggctgggtagcctcccagaagggcaaccctgggcatcctccagggcaggctaactggagtctagtggggaggggtaccttgaaagaggaaagttgtttcctcctcctcctcctcctccagtgtttgggacccttcctgggggctggagtgcatccctggacaccccccaatcccatcctcttctctagtttccactgacctaggcccaccctcccctctccggctcagtactcctggaaatgagattccgtacatttgaatcttgtcctaatgaaatatttgtccatgtgggtacctgtgtgtgtgtggtgggggtgcagacggagggtttgtttctcactagctggaactactggggtgtggtatgcttcctgggaatttgtgtgccacagtcctggaggcgaggagggggttgtgagccagtaggcaggggctggggcaagtagcattgtgaagctattgacacccagacgtccccaggcaggagattatgcccccattagcccccttttatctgggcttccttaacaatggactctttgccctgcctgccagagccagcagggagtgactgttcagtggtgaggaagcgggcagaggaagccctgccattgggtaggagcagtgggcagcccctgggctgactgggaggtggggattagggattagacagtcctggctgtctgccttcccctaagccagggggagaggagcaaagggcacgaaatgtggcctccaggaggattagaccgccacatgatcatttgcacaccctggggtttagcaacaataaaagtcagcttttttgtatcccaaggtggcctgtggacacccacatggacaaatgtttacactgggacagaattcaaatgcagaggtcccaggagcctaaagtacactcactctggtatagaaaggattccttactgggcagaggacaggtgcagcctggggctttcccaggcaggacacagggaggctcaggaaccaccaagtccctggaaggtggatctggaggcgttggcaggagccactccctgggttccagggctccaggttcctgctttaaccccctgtctcacagagggctgtgcacttgggggctgctgagcatgtcccagaggctgcatcctggacacagcacctcagtgcatctgagctgaggctaacttggcaggagggacaggcagaacctgccagccacgtgcaattccacccctctggccactcagggaaggagagctgtgagtcaagatcagatttgggtcaggacaggctggggcctgcctgtccctgtgcatcccaagatttatggctggccaggggttgggctgggaggggtggtcttgcatgccaggagagtgcagatcagcctgagaggccaggccagtaagtgaggtcagatctcctgcacctgatagcattaaggccatctacaccaaagctctaatgctgatatgttcctggcctctatgtggggcatggaggtggggcatggaggtgaggcctgctcgcctgggcttctggaagtgggagactcattcctgtggctgaggcctacagcagtgctgtgtggtaggaatacactggaagccatgatgtcattgtgcattttctagaagccacattgaataaagtaaaagacacaggtagaattaatttcattgagcccaatatatccaaaataatatcattttcacatctattcaatataaaaatttactaatgagatatttcatactaagccactgaaatccagtttgtatcttacacatctcagttttgacgagccacatttcaagggcgtgatagccacatgtggctcccatagtagacagtactggtctagagaaatgttggtggcatccttgctgtctggtttctggccttgccaaaagtattaccatcccagtgtggtacattctttcatgtatttgtctcctgtccccagagcagactctgcaggtcctctcagatcttgtgcggaaggccaggagtcggaacattggcatcttccatccatccttcaacttaagcaagttcctccgacagggtctctgcaaatgcctcccggccaatgtccaccagctcatctccggcaaaataggcatctctcttaccagagtgtctgatggggaaaacgttctggtgtctgactttcggtccaaagacgaagtcgtggatgtaagcagtttgcttatctggacgttgtcaagttagaaaagctgttttgggatgggtgtggtggctcatgcctgtcatcccggcactttgggaggccgaagcgggtgggttgcttgagcccaggagctcgagaccaacatgatgaaacccagtctctacaaaaattacagaaaaattagctaggcatggtgttgtgggcccatagtcccagctactagggaggctgaggcaggagaattgcttgagcctgggaggtggaggttgcagtaagtcatgatcatgccactgtactccagcccgggtgacagtgagatgctgtctggaaaaaaaaaaaaaagaaagactgttttgttttggaagcaacacaggcagttgtaggccccctgtgccagagtgacataaactctgtacacctccagtgatttggtccatgtttgtaaaccctgaatgttccagggcagtttcttttcttcactttttatctcttttttttgggtgggggggcggggtacagagtcttgctctgtctcccaggctggagtgcagtggcgcaatctcaacctcccgaggagctgggactacaggcacaggccatcacaccttgctaatgtttgtactttttgtagagacggggttttgccctgttgcccaggctggtcccaaactcctgcacccaagtaatctgcccacctctgcctggcagttacaatttcaaataattcctccctttccttcaacacttggctcatgaccgtccagtccaaggaacctgtcctgcaggtgtgcctctcccgagcttcctctatgcatcttccataatgaagatgccttctcactggaaaccctacaagggtgggaacgtgccttatttgcctgtatcctcagggtctagcagagagaagataatttgtaataccaaaacaccattaaattcagctgatgctttcataagcgctccttggaggaaggactccatttacttgacagatctgtgcaagacagcagcctggcgcgtctaacctgcagccagttgcatcctctgtttaaccttgtttgcggaagctttctctaaacagccagcacttgtctgttcccacatgggtccgttctcccagtgaatcaccgtggtgcctgctgactgctctgtagcacagtgcttcgcaaagtgtgatcctgggaccagcagagcagcagctcctttgagcttattggaatggcagaccctcaggtcccacctctgacctgctgcatgggaattctggggagggacgcagaatctctggttccacaggctctccggtgatgctaatgaataccggcatttgaacagcaccgatctagcccctttcagtccatgagccaacaacccttggtcctgtctgtggtgacccagtgtgactctcatggggagcaaggagaggaagttgaagttcactgacagggttgttaaggggattatgcaatagatgagacccatgggcctgaagtccgagggtgtatgttagttccccgttcttttgacccatggattaacctactctgtgcaaagggcattttcaagtttgttgccctgctcacttggagaaagcttatgaaggatcaggaaaattaaaagggtgctctcgcctataacttctctctcctttgctttcacaggccttggtatgttcctgcttcatccccttctacagtggccttatccctccttccttcagaggcgtggtaagtcggctttctctgctagcgctgagtcctgggggcctctgaagtgtgctcacacatctcctgcctgcagggcactggtgtcgggcacctcagggtctgtcccatggtggagccccatgcctcactgcctttcagacagagtagccacagctggccctatttccaggctacccgggcagcaaaacttactgcatgtgtaattaattatttggctatctgtaaggtaaactggctggttcacttaatctgcaccttaagcatcagatagcttctcagtgatctagttaaactatatgatgttggccaggcgcggtggctcatgtctgtaatcccagcactttgggagcctgaagcaggcagatcacttgaggtcaggagttcgagaccagcctggccaacagtgtgaaactctgtctctcctaaaaatacaaaaattagctgggcatggtggtgtgcacctgtaatcccagctgctcgggaggctgaggcaggagaattgcttgaacttgggaggcggaagttgcagtgagccaagatcgcaccactgcactccatcctgggtgacagagcgagactctatctcaaaaagaaaaaaaaaaaaaaggtaaataaagtatatgacactgaagaatctgttacccctggaaggtggagctttactcttagggggaactataacagtcatatatatatatttttttcttttctttttttttttttttgagatggagtctggctctgtcgcccaggctggagtgcagtggtgcaatctcggctcactgcaacctccacctcacaggttcaggcaattctcctgcctcaacctcccgagtagctgggattacaggtgcctgccgtcacgccaagctaatttttgtatttttagtagagacagggtttcatcatattggccaggctggtctccaactcctgacctcaggtgatccgcccgccttggcctcccaaagtgctgagattacaggcgtgagccatggtgcccggccaacaatcacatgtgttgtaaacaacaacaaaaatctgtcagcctggtctaacctagatttgtgctttgttttgttttgccactttgtgatgcacaggaggaagtttaggctgtaaaatactagccttttagggtaatttttgaactcacaagagcagcagcggaacctttgatgcaatcctgtatgtagcaccagcagagccacgtggcagagggactcgcattaggagcctcccattacagactacgtgctcctgtgcgttatcttatagggtccccacaaccaaggggagatgtgattattcatcctgtgtggctgtggggaacttgagagtcatacttgcccaaagagcacggccagcgagcttgcacccaggtcactctctgctcctctgtcagaacagggcatgtcttggttcactgcagggcggctcttctcattctctgtagtttggggtccaggatagtggtccacggagccactggagtgcccagctactgagtgaccaaagcatattttggatttccgacattgccacagcatggttgggcatcagcaggaccccaaccccttgttatgctggtggctttatgtggttatttgatcttccccagaactcagcaggagtgcacccagcagcaccgtagtgatgctctctggctccccagtgcacggttctggctttccttcctggtcgagagtttcaagccctctgggtcctactctgtccttttcagcccatagctttgttcaaaagctgctggcagtgttcagatttggctgagttcagtgaatatgtgcattggctgatttctgagccatgccagggggatggagaagccgaagcaggagtgtttgttctgcaggctctggagtaggcattgggtctgtgccggctcacttgctagtcttgcatccttccccaaccccctctggggatgtctggccacatcagaagacagtttgggttgtcagaactgggggagtaccaggccgaggtgggtggatcatgaggtcaggagatcgagaccatcctggctaacacagtgaaacctcatctctactaaacatacgaaaaaaattagctgggcgtggtggcgggcgcctgtagtcccagctactcgggaggctgaggcaggagaatggtgtgaacccggggggcggagcttgcagtgagctgagatcctgccactgcactccagcctgggcaacaaagcgagactccgtctcacaaacaaaacaaaacaaaacaaaacaaaatctgggggagtgccactggcatctgatgtatagaggcccgagatgctgtgtcatcacccgttgagtgcgctcataggcatcttcctgacaattagaacccattattcttcaaattcaatgcaagcaaattcaaagcattactgtgtacataccgcatgctaatcaattgcaccactggagctcctaaattcaaaacattactataaaaaagttcaaaatgcatggaaaagttgtacatggcaggagaatatttgggcttctgactaccccttgaatgaagatgatccaccagccgccttcctccttggtcttcactccagattcctagcatttcattctgtgtctctttatgcagtgaggtttttgtttgttttttgagacagagtctcactgtatcacctaggcctggagtgcagtggcgcgatctcagctcactgcaaccctcggctcctgggtttaagcgattctcctgcctcagcctcccgagcagctgagattacaagcacacatccccatgcccagctaatttttgtatttttagcagagacagggtttcaccatgttgcccaggctggtctcgaactcctggcctcaagtgatccatgtgcctcagccttccaaagtgctgggattacaggcgtgagccaccatgcccagctcctagtgaggtttttgatgccttgctacatctgccctagaaattgtgtgactacgattttggaaatgttgctgtgtaaacttgtgatcatttctggactccaggcaagaatcttgatggctaaggtgtggctgaacatgtctgattctctcctggacctgttttaggccaaactctgctctgaaattcctccgtgtggaagggcgggctggggagagcctcccagctggaatcttttggatgcctttctctgtgggtatctgatggctggctctgatggctggctgtgatggctgtggctggaaatcattgttgacatgagtttcacagatgcaggctctgtccaaattgtagcaaaagctgcctgccccagccgagctatgggcaataaggtggtttaaggatatagatgaaggaaaactcacccttagaataatttatccaaaatgctgctgtgttgtgggttagaggacattttctgaggtcccaggttcattgtttcatttaagtctcaaaagtccctccaggtgttggttctaattgtcaaagcatggggggagatgggctcatgggttaaaggtcttatcccagatttctgtatcctccttgcaagcagcaaaggggtctggatttgaatccatgaccatgtttctcctttgggtttccatcacactctgtccccgtgcactgagcaccctttagttcatatgacccccttaggcatgttacatgggcactcctataggtgcccatctggccctaggacttggccaacacaacatggactccagtttccatctgcctctttgccaggcacttttgtgcagtgcacacactgtacaacagtagacggcaaccctgagagccagagtagagcctgtcctagcaccggaatgctcggtaaggatttgtcgcaggagtgattccaaagccaatgtcctccctccatatcagcctgtttgtggctctgagaagctctgcccacatgtgaaagcttgttaagcacttaagcactaacccagagcttcagacagtgccagtcctttttccccttctttaaaagcgatatgtggatggaggagtgagtgacaacgtacccttcattgatgccaaaacaaccatcaccgtgtcccccttctatggggagtacgacatctgccctaaagtcaagtccacgaactttcttcatgtggacatcaccaagctcagtctacgcctctgcacagggaacctctaccttctctcgagagcttttgtccccccggatctcaaggtgagttggtggtgagggggcaggtgttctggggtgcagctcttctttgcctccctgattgccaggagctaccagttactgtctgcacaatcaaacagaaatagacctgtccttgatggttaacggaaataaaaggcgcttgtcccagaagctcaggtgaggcaccaccctgattatgggaatcacctgggaacatatacccagacctaaaactcagatccacttcccaggctgtggttatatagtcaggggggtgcagtatgggtattaggattttttattttttagttataaagatttttttttggtttgtttttgagacagggtcttgctctgccgcttaggctggagtgcagtggtgcaatcatagctcactgaagcctcagactcctgggttcaagcagtcctcccacctcagcctcctaaggagctgggacccacaggcatgcagcaccacacctggctaatttttaaaaattttgtggagtgttgcccaggctggtctcacactcctggcctcaagcgatcctcccaccccagcctcccaatgtgttgggattacaggcatgagccattgtacccagccactaagatgattcttatttggaaacacggtcaagaacaactgcgttcggtagtttaaccttttttgattgtggtggttttagtatgccttaccactctaccatagtaagaaatttgcagaccatgtacaccaacctttggtgctcctggggagaaagaaagaaggctatgcaatgcaatgcatgctcacagtccaagggagagggaaagctgtctaacaggattggttttcccgtgtgctttataagcagatgagtagaggagacagctcttattgtcctagtggcaattgggataggctgcaaagtttgttagggtggaggcttattccgggaccaagggagcccaaagaaacaagctcctgccaggcgcggtggctcacgcctgtaatcccagcactttgggaggctgaggcaggtggatcacctgaggtcaggagtttgagaccagcctggccaacatggtgaaaccccgtctccatgaaaaatacaaaaattacccgggcatggtggcgggcacctgtaatcccagctactagggaggctgaggcaggaaaatggcttgaacctcggaagtggaggtggccgttagccgagatcacgccactgcactccagcctgggcaacagagcaagactctgccttaaaaaaaaaaaaaaaaaaaagaaaagtaaaaggaaaaaaaagaggctctggcctgctggggtgcctgcaaagtctccgtggaagggtgacattcaagccgagacctccagggaactgtctcctgggagcacagagccctttgctcagcccccaggtggctcagtgcccccagccagcagactcagagcttgcatgattctttggtgctctctgcggtcttccaatgatgctgaaataaatggtgcttggtgtctccctgctgtagtccccttgcttgctttgctcacaggtgctgggagagatatgccttcgaggatatttggatgcattcaggttcttggaagagaagggtatgtatgggctgggaggatcagccatgcccttttgacaagcatttactagcggtcttggtaaagacttgagatttgccttagttctaacacttagtgcccaacgccttccttgtgttgctcaacctactcatgagcccaggagataggaaatctccgtcccattgtacagatggggaaacagaattttggaaaggagagccaagcagcacacacccctccctgaggggcagagccgagatttgaactgggatgtcatgactccagggccctctccctccccagggtccccttatctgaaggcggtttttctttccagctcgacctcttgtgacccttagtttaacaagggccgaagttaaagagtttctgcgcctggaccccaaatgaagcaatcagatttctcatctccagtcaggtgtgggtccaagcccactagacaagtttgctcttcccagagcacatttctgccttcaagtcatcctggcttgtcagggctgggggagttctgctgtagaaatattagagtggaaggaaaaagatgtgttgggagctatttttctttaatactaaaagttggttgatgaatttgtcgttggccaagaccaaggagactgcatttttaaggacatatgtgtatttatctgctcagaaaatgttcattgctgtgtgctagggatactgcagtgaacacagaggtgtgacccttgccagccttgtgagagaagtgagcagataagtaagcagaagggtgatgctgtgtcgatgggaaagtacaggtgccaatgagaaggcacaggtgtcaaggagaagacacaggatgctggaggctcatgcaggatggatctccaaggcccaggggaagaagggcctctcggaggacgtgaatccacattaagactttggggataagtaggagcgccttaggcatggggacccatggatgcgaggcctgtaggacacagacaggatggcatgaaggcctgtgcaactggaggggtggggatggggacactaagagatggctggaagtgtgggggtggggacactaagagatgactggagaagagggggtcaggagtggtgaaaaatgggagaggagggcaggctgggccttttggatacagggggattgcatcctgcagtggtagggagccactgagggctgctgcagtaggagtgaggggatcagaggagagctttggaagccccctggatgcgggacaggaagcgagataccagtgtctaggaggccagtgaggcagccacaggctccaccaggatcagggctgcgagggtcatgaggaggaaaccaatttgaaggagtccaggggaataggacttggaaatgaccgatgggacatttgggaagaggaagacagaagagcgcagtcccggcttctggctttagcagttgggcaaggggagatggggagatgtgcccatgggttgagggttgaggacattaggagggagccggtatggcaggaagagctggtgtgccagagatgctggaagcagcatctgcctgagaacagatacctggcaatattcctaagggaaagtgacatctcggagggtgaggagggcatctgatagggcctggaaagagccggggcaagcatgaatgtgaggttatcttggggggcaaggctcaggcgttgaggagcagcccctggtctcttcagcctgaagttggaagccagagttgggccaggtgcagctgtggttgtctgaagtccccctcccccagcccagtgtgccaatgctgtaagagcaagggccgctcactggtgctggtggctgagtcccagcacccaggacagggcctggcacatactggtgcccaatcctcccttctgggtgcttcttccaaggccttgtgatggaagtgagtaccctcttcgacatcagacccagcttcaaatcctggctctgctatgtattggctgcgtggctttagacaagtcttttaaccttgctgtgcttctgatttctcagctgaaaaatggagatgatgatagtggtttctgtaaggccttatggtgaagcacctagctcagggcctggaaggcaggtgtaaccagtggttcagttgttataaaccaacactaaccctcgcctttgcacctcatgaaaccagatatgtagatggagcccacaaagctagcaggagccaagctcacgtgtgtcctgctttaaagccccatacccctttctccgggtgacaaacacctgtgctcgttctcttcccttcccctcttccccttgcatttggctaataacaggccagctgcctgcctccctgcagtttggtagatgggtgggtaacgaccaccactcccacgttcgcctgatgggcttgttttccgtgcccttcacaggcatctgcaacaggccccagccaggcctgaagtcatcctcagaagggatggatcctgaggtcgccatgcccagctgggcaaacatgagtctggattcttccccggagtcggctgccttggctgtgaggctggagggagatgagctgctagaccacctgcgtctcagcatcctgccctgggatgagagcatcctggacaccctctcgcccaggctcgctacaggtacccactcctcggggtgagcacgggcagcaccttgttttctttcttgtgcattatggaggaagatggtactgccacatgggagcgatagggtgaggcaaccatgacaggtggttgggaacatctccttccatgtgtacagcctgggctgctgccatcactcccagcacagcccccaacccccccaatcctggaaccttgccaagtctcccttcccatggggtcatgaccaggaggaaaacaaactccagctgagccccttggggttccccatataggctcctgcctgtggcagctgggccctctgtacccctttccaactctgtctccctaacatggcacctgagctcctgccatcctggatttcatggaccccaaggatgggggtcctgcatctgggacttggcctattactcggagctccttttcagccgcctccctccacctgtccacccacctcaaggctcctttcttgagacctctcctaatttctcccttcccctaaacccacaattttgaacctccatcgaatggtgctgtattttataatgtcatcaaatatcaaatggagacagtgctatggtccaaatgattgtgtaccccccagaatttgtcttttgaaatcctaacccccaacatgatggtcttaggaggtggggcctttgggaggagattaggtcatgaggaaagggctgtcatgaatgggattggtgcccttattaaacagacccaagagaggtcccttgtcccttctactgtgtgaggactcagaaggtggtgtctatgaagaagcaggccctcaccagacaccaacatgtctgctgccccttgatctgggaccttgcagcctctagaactctgaaaaatcgatgtttgttgttttataagccactcagttggtggcattttgttagagtagcctgaacacggactaagtcaaacagaagaacccacaaaccagctacagagttgggcatttggagaaattcaaaaatgagtcagacataactccttattcttgaggtgccctaagagatgggacacagcagctgcccaggtgcattagtttgttctcacattgctataaagaaatacctgagactgggtaactcataaagaaagaggttgaattggctcacagttgcacaggctggacaggaagcatggtgctggcatctgctcagcttctggggaggcctcaggaaacttacaatcatggcagaaggtgaacgggaagcatgcacatcccatgactggagcaggagtgagagagagagggaaatagagggaaggtgccatacacttttaaacaaccagatctcatgagaacacattcactatcaagagaacagcaccagtggggaaatccgcccccatgatccaatcacctcccatcaggctccgcctccaacactgggaattacaatttgacatgagatgtgggcagggacacagatccaaaccatatgaccagattaatacgatttgaggcatcacgaggtcattaaagagagggaataaaagactggggctccaggaagaaggctctggaatccagcagagggtcaaggaccagcttgtaaagctggtggtgcctgagaagtacctaggagaacatagatgctgtgacgtttgatgtagctgttttttgttttgtgttttggtttttgagacagagtctcactctgttgcccaggctggagtgtgcagtggcgtgatcttggctcactggagcctccatctcccaggttcaaatgatcctcatgcctcagcctcctgagttgctgggattacaggtgcacaccaccacgcctggctaatttttgtgttttcagtagagacagggtttcaccatgttggccaggctggtcttgaactcctgacctcaagtgatccaacaacttcagcctcccaaagtgctgggatgacaggcatgagccaccatgcccagcctgatgtagctgtttctgtgcacattatttgctgtggggtatattcagatttcttaatacaagatgattctttgcctcatgacttacacaccattttctatttaatttcagctatgatattggaaatggacatgtcttttcaaggaaaataaaagcaggctttctggaatggcgacttccaaacatatttgtcaatttaaaggagctgggagtggggaccctatgctccgtaagcactctcttagctgttcttggctgtgctccccgcttcagcttcacactgcccttgctgtgaagggagcagcctgggccgggcgcggtggcttacacctgtaatcctagcactttgggaggccgaggtgggtggatcacctgaggtcaggagttcaagaccagcctggccaacatggtgaaactccatctctactaaaaatacaaaaaattagctgggcatggtggcaggtgcctgtaatcccagctacttgggaggctgaggcagaagaatcgcttgaacccaggaggcggaggttgcagtgagccgagattgcgccattgcactccagcctgggggcaacaagagcaaaactctgtctggaaaaaaaagaaaggagcagcttggcaaaccccaccttgtcgcttttgtgagtgcctctgaccctttggctgccaggacgggcgtattttatggaaatgctaagcaccaacagagtaaagtggtttggtttttcacagtggtgggagataatagctccaaattgtctttttcagcactgagtgaagaaatgaaagacaaaggtggatacatgagcaagatttgcaacttgctacccattaggataatgtcttatgtaatgctgccctgtaccctgcctgtggaatctgccattgcgattgtccagaggtgagcattttaggtggctccgtgtcttcctcacagggttgatatgaggatgaaacaagatgatagatcatggtggcatgtagtctgggacctggattgtcgtgccacagatcacagctcacagtctatgtgcaatgcccctgaatgttgcccacctgtcctcaagccacacatgcacctgtaactcagtgcaagcccagaaactccccgtggggactcctagagctgtcagtggcctcacatagcagctggtccagtctcttgtgattgcccaaggaaactgaggcctggagagcttggggtcactgctctgaggccatagagatgcctagtagaagggccaggcctagaagcaggatccttgctgcccctctgagctgtttccatttaaaatcacatgaaggccggcgccgtggctcacggctgtaatcccagcattttgggaggccaaggtgggtggatcatgtgaggtcaggagtttgagaccagcttggccaacatggtgaaatgccatctgtactaaaaatacaaaaattagtggagcatggtggcacgtgcctgtactcccagctacttggaaggctggggcagaagaatcgcttgagcctgggaggcagaggttgtagtgagccaagattgtaccactgcactccagcctgggtgacaggagagaaaccctatctcaaaataaaatgaaaggtaatgaaatgaataaaataataaatcaagtcacggccgggcacggtggctcacacctgtaatcccagcgctttgggaggccgaggtgggtggataatgaggtcaggagttcaagaccagcctggccaacatggtgaaaccatgtctctactaaaaatacaaaaattagctgggcatggtggtgcatgcctgtaatcccagctactccggaggctaaggcaggagaattgcttgaagcaggacctaggaggcggaggttggttgcagtgagccgagatcatgccactgcactctagcctgggctacagagcgaaactccgactcaaaaaaaaaaaaaaaaaaaaatcaaatcacatgaaagtagaacatagggaattccatctttcgttctaggcatagtttgttaatatgattcagagccagcagttaggagaacacagtgtgactctcctagaacttcttgattgggcttcctctgattgggtttcctctgattgggcttcctctgaaagtgggggggatggggggtggggagcagaatggtcagagcttggctcagcagtcagactgctcttcttcaaatcctggctgcattgcttactacagctgtgtgactccagatgactgaatccacctctctgtgctgcagcttcccgtctagagagatcacctggagcagagggtggtcaggagactcaatctggttactgactcacagtgcaggagtactcatcccatagtaagcatccagctagagatgttgatttctattttcaggtaataatgatgatcgtaaaattagagacagataaaaggtatgggcattaggccagggcactgcaatttctaagctgtgtgacctcaggcaagttactcgacttctctgagcctcagcggtttcatccgcaatatatggataggaaaaccgacctcagtgggttgtctgacagtggagggcacttgattaaaaaaaaaaaaattaccctggtctgaatattaccctggactgaaagaaaaatattgagctaatacaggcatcaggaatggggctgcagggagtccagggaagggagaacgaagagcctgaaggtgtgaggaggtgcgagtgctgatctgtctgctacaaagaggctgctgagcctcctgtggatgtggccctggacttggcagtttaatacctgagctgttaaaataacctcagatgctgtgttctttaaggggtaggattcagattcctgctgaaatgcttctgaaagggagggaatgagccagcccatccccagttgctttttaagatcattgggaagttctggtcttgccatttgtccctggaccactcttaggtcctcctgccccacttccatctgggtgtgtgccctgggctgtccaccacacagctacatcctgccatcttccctcctggagccactgtgccatgcatggatctgtagcttcatttttcttggcttttccctggtttttctggagcagagtctctagtaaactcccaaggaagaaaacgtttgactttatgtgtgttgggaaacgtgctttttttctattacatctcagtgataggttggccatgtctagaattgcaggttgaaaatcatttcctctcagtatattggttagtgagaagcctgggactgagacagtcacattctcacttctttgcaggtgagtgctcttaggactgtctttttatcccttatactctgaaatgtcatatgtcttggtgtaagtccttatttcagttattgagctggacaagtactggagaccccttcagtcaaagccttctgtcattctccagctctaggaaattatcttctattgttatttctgttattccttcccttccattttcttttttctttttttttttttttttttgagacagggtcttactctggtgcccaggctggaatgcagtgacctgatcatggtacactgcagcctgaacctcccagactcaagtgatcctcccacctcaacctcctaagtagctgggactgcaagcacacatcaccacacccaacaaatattttttaaaaattttgtaagatgggatcttactatgttgcccagactttttcttcctcttcctggggctcttattaggaagatgtttgacttcctgggttggattcctgtctccgtgtctgactttctctctttgtcatatttttcatcactcgttgtctttttgcgtctgctctgacagatttcctcaaattttgtcttctagtcctatcctacagtttttactttcagcaaatataatttaatctccaagagtactctcttgttcttttttcttagcattctgttcttgttttatggatgtaacattctcttggaatatttgctgtcctctagatcatcccttctccatttcttcttgggctagtttttctgtttcttcatctttctcttttatgctacttattctgggcgtgttcttggtgggttttttcccatatagcaacagaggacttggagctcagggagaaaagggtaggtgcatcacctggcagagctcccagacagtgacaggcaggctgcgggaaggatgtctacttggcggtgctaccgctttcctagaaaccctttccctggagctggttgaactgttgggttttgccctggtggtgaacgctggctccccgtgctctgcctgtttcatcaccagccccctccccttctgcctggggtccagtaatctgttgaaatatatatcttgctcattggtgagctcctgctccttcctcgttgctcttgcagatttatcacttctcgtaaggctgcgcttgtacttcgggattttctctgtgccacactgggaaacatagggtggttgcatgctgcagtcctgagcacttatttcactcacatctttacacgaagatttggtgggtgtttactttgtttttagtaagttagtctgtcatgtcctttgatcctttttttttgttttttgagatggagtctctctgtgtcctccaggctggagtgcaatgtcgcgatctcagctcactgcaacctccacctcctgggctcaagagattctcctgcttcagtctcctgagtagctgggattacaggcatgtgccaccacacctggctaatttttgtatttttagtagaggtggggtttggcatgttggccagcctggtctcaaactcctgacctcctgacctgcctgccttggcctcccaaagtgctgggattacaggtgtgagccaccacacctggccctgattaatcttttaatgcccagtctctccttcaaaagccggctcctttctctccctcgccttcctagattccttctccactccccaggatcagcctcctcctccccaccccaccactgccggggggatgtctgtggtcaggcatttatcagagaccctgaggtgggggtcctttatgtgtctgggggatggagagtctagaggaggtagcgttcagacctctccatggtgcctctgctgggctcacatgtgaccaagcacagcaaaccatgaggcaggggatggtcttgaccatgagagcccttgcagcagctgccatgggcctcagctcctctccaagctgggaagagccctgaaaagccaaggtgtttttttttccctctttatttcagtgtaagtcccttgagctttcttgaaccagaagtgggctcattttgctttagagatttcaggtgggcttgtccttgtcctagcatcccagatccaccttctgggaagtcatcagattggaggtgatgttggcagcttttgtaaacaaagggtagtgttgtaagctgttgtgtctgcctatgtgtgtgtttgtgtacttggtctcatctctgcagactggtgacatggcttccagatatgcccgacgatgtcctgtggttgcagtgggtgacctcacaggtgttcactcgagtgctgatgtgtctgctccccgcctccaggtaaatactttggctgtgggtgtgtgggccggacgggcacctctctcatctgatgaggcctcacacgacattctagaaacagctggctgaacaccaagcaaggagcttgcccttgggtgtggggaccctgtctcatgggaggcagctgagtcagtcagaggtcctggcacacctgctgagagctgccacccaggccaacctgaaccggagcctgggaagacttcccgtcggatgagtctctttgagtgcagcattgatggtggaagagcagagaggccccagataagcagggaaaggtgcttcagacagagtggctgggatgaggactggggagtgtcagatagcgctggcgtgtctgagcgaaggagctctggcacccatggcacaggaaggaggtgggaccctggaggggcagggctagcagagctcctcggagcgtgtggctaggtgcctggtaatgcaagccccctgtcctccaccctctgttgtactgagtcacagtctccggggtgaagcctagcagtctgcgttgacaggccccaggggatgccgctacttcctgaattctgaattctggaaactgagccggagttcagggcctggctcccattaccagggttgggcgttatcctgaaaatcataggccttggtttcctcacttggctaacaggggtgatccccatcccctcaatgggtttccgtgagctcctgagagcccgtagcatggtacttggcacatgctgggcatcaggaggtatggcctctcttgctattgttgttattggtagacacagaaggatttaaaagtaggggaatgcaaagatccgatttgctagggaagagggcagtagtggccaagtagagggtggatcctgggccctggctggcagcaggcagcaaggggggctgccagggcccaggcagggacgatctgtagaccgagaggcttcctaaggctcttggacaggaggaggtgtcggttccaagcctaaggagtggggcagccctggtgactggtggtcagtggtgccaggcggtgggtggtaggacaccctggcaggcaagtaggtttgtgtgggggaaactgataggcccctccagggattcgttggtggacaacacctgtgatgtccagtgggaggtgtccaggtagctgggagggccacaggcttggaagacctaggtggtgacatcagcccagcactgagggctagaagaagctgtgtctctggctgtgacggcaccctagagtgtgtgtggtgccctctactggccggcaatgtgggtccaccgtagctcagactgcacactgcagcagcgggaacggcctctaagccaacttcctccatgtgtttcaggtcccaaatgccagtgagcagccaacaggcctccccatgcacacctgagcaggactggccctgctggactccctgctcccccaagggctgtccagcagagaccaaagcagaggccaccccgcggtccatcctcaggtccagcctgaacttcttcttgggcaataaagtacctgctggtgctgaggggctctccacctttcccagtttttcactagagaagagtctgtgagtcacttgaggaggcgagtctagcagattctttcagaggtgctaaagtttcccatctttgtgcagctacctccgcattgctgtgtagtgacccctgcctgtgacgtggaggatcccagcctctgagctgagttggttttatgaaaagctaggaagcaacctttcgcctgtgcagcggtccagcacttaactctaatacatcagcatgcgttaattcagctggttgggaaatgacaccaggaagcccagtgcagagggtcccttactgactgtttcgtggccctattaatggtcagactgttccagcatgaggttcttagaatgacaggtgtttggatgggtgggggccttgtgatggggggtaggctggcccatgtgtgatcttgtggggtggagggaagagaatagcatgatcccacttccccatgctgtgggaaggggtgcagttcgtccccaagaacgacactgcctgtcaggtggtctgcaaagatgataaccttgactactaaaaacgtctccatggcgggggtaacaagatgataatctacttaattttagaacacctttttcacctaactaaaataatgtttaaagagttttgtataaaaatgtaaggaagcgttgttacctgttgaattttgtattatgtgaatcagtgagatgttagtagaataagccttaaaaaaaaaaaaatcggttgggtgcagtggcacacggctgtaatcccagcactttgggaggccaaggttggcagatcacctgaggtcaggagttcaagaccagtctggccaacatagcaaaaccctgtctctactaaaaatacaaaaattatctgggcatggtggtgcatgcctgtaatcccagctattcggaaggctgaggcaggagaatcacttgaacccaggaggcggaggttgcggtgagctgagattgcaccatttcattccagcctgggcaacatgagtgaaagtctgactcaaaaaaaaaaaatttaaaaaacaaaataatctagtgtgcagggcattcacctcagccccccaggcaggagccaagcacagcaggagcttccgcctcctctccactggagcacacaacttgaacctggcttattttctgcagggaccagccccacatggtcagtgagtttctccccatgtgtggcgatgagagagtgtagaaataaagac

SEQ ID NO: 61535 - RNA, 25302 nt, Homo sapiens
ggagcuggcgcugggaggggaggagcgcgcagcccgcgcgccgcagggccgggcggaaaguuuuuccugacggaguuuuggcugcggcagcggcggcggcggccggagcgggccauggacgcgcucaagucggcggggcgggcgcugauccggagccccagcuuggccaagcagagcugggggggcgguggccggcaccgcagugagugugcgcgcgucagccgggccgggccgggaucgggcagaggcgcgcggggccuccgcgggcgcccggagugcggccaaguugggcagaggcggggccucaccggcgcuccggucccggcguggcccuuucccggcccugcggggcagggggucggccggggucaaguugugcaccuacucgccggccgcucgaugccgcugcgaggaggggcagcgcugaggaaggagcccgagcucgggguccucaggugcagccggcaugggguggggugcagguugggagaagaggcccccgccacccgcggcaccucccgcccugcuguccuggccagcuagggggaggcaggcgcucgucgucggugccuaggggaggaggagagggcgcaggggcuugggaagacgcccccgucccgcaccccugcgccccagccagcagcugcggcggucaggagcccacuggcccguucucccgcccccugcccgacccaccgggccaacuuuugacuccgggugcccagacacccauccaggugugagcccggggucgcagguacguacuugaaauugggaacgaggccccgccuggggugccucgggagagccccacaucaggcgaucuagacccuuacgucccuuccucuagccggguccagguggcaagccuggcgucccgacuauuuuugaaaccuguuuucucucgcaccuuuccccucgggcuuccagagucccuugggugcccaggcaaacgacagacucgccgccaccucucccuggggcgucugggaggcugggaggggccucccccccuuucucucccccagucucugauuacgcucagggaacuugucaccuggcaccuuccccugaagccagaagacccagccuagcgcaggucucguuguuugggagggagaagagaguggcuugccuggggucacacacaccuuccugcugguuuuggagccagagcccaggacugcugcacacucccaccucccugccaccuacuucgggccacagcuucuccccucaucaggaaacaacugacaguacagcacccccucaucccauccccucuuggccuuacagggcucugccaggggagcccgagcucccugguccaaggagugccagcgugucugggccuagagggcccgccucccuccuccucuggccccacucuguuguucagcuguggccgccucccagcugagacuggcauuggcauugggaaugugggguggugccugcuggugggggguggggucagagacccauuagggcugggccacuaggccaggggauguaccguuuaucacacugauugcaucccaaaauagacccuuuaaaaacuggcaagauuugaccaggacuucugagauggccaucuguuccagugggagaauccugcggguuuucuccaggaaugagggagggagggugguggggcagcccccagggaagugguuuugaaggaaggggggcuggcaagggaagggaggcuagaaagaaauaucucugaaucuggggacguggaagagguagccgcuuuggauguggaagagaauuucucuugccaucuucaaucuugagcaagucacuuguccuuucugauccucgguuuccucaucugcaacauggggauaaaaacucuuaccuggcaggaguaucaaggagauuauugguaauaaugcucccuccuaacugguggcuuucuucuccccugcuccucuucccccugccuauccuugggacgcugccagcaugauuaguacuguggugagauggguuuugggggccccgagccugucugcaccuuuggaggaaaggagaggagcaccucucccccuccuccaggcccugguaagcccaaagugcuguccuggagccucuggaucugaaggagggcaggccgagccccaccugucccucgugaugaagucucaauuuccucaccuguaaauugcaaauaacaguaguaccugccuccagcuguuuguggggaucaaguggaauugcguuugccuggcauagaggaggaguuugguaaaugguaacugcugcuuuuguaacuguuuuacaaccuguuuuugcuuccauucucucauugacuccugugaggugacagagcagacccauuuuagagacaaaggaacugagacucugagcauuggagucauuggcuccagacacagagcaucuaagaggcagagcuccacauuccuagcgcaggggucuuaccagugugcuuggugaacucugccaugggaggagcugggagcaggccccaccuaccccacgcugggcuggcagccucugacagcaguggccacagguuagagcaggggccaugggguaugugggggugggggugcuagggucaccuugcucaggguugugacccagccuggccuuggaccuggucccugugguugaguuuugaggccaaacugaagccaguggaguuaaaguuagacucgaacccugcucucaguugugaccugcuccuccuccucaagguccucacuaggauuagcaugagcauugcuuauuuguggagaaagaagcccagagaagggcagcaccuugccugaggucacacagcaaagccagcaccccaggcuucuuuccacccagcuucaugccugcaguggauuccugguuguccugaccuugaaagagggcucucuuccucucccacacauggcuuuuccuauccccuggggagacaucaauauuuuaucucagucccuggccaggcauuuuccuuccagcugccuggaagaggggcucaccuuggccccucagcacucuuuccagagguacugggaucauucaggcccuccgguuauuuuguggguugugcuuacccagagagaaggggugaagaaauaggaggugcagguuccaguaaagcuaguucaugguggaaggcaagggagggaggauauaaucauauuuauaauauuuauaauaaaggauauugcaaaugaauguggcccaacacaaauucauaaacuuucuuauggguuuuuuugugauuuuuuuuuaagcucaucagcuaucauuaguauuaguauauuuuauguguggcccaagacaauucuuccaguguggcccagggaagccaaaagauuggacaucuguggcuuacagucuggugcaccacaacaaggguguagaucaguggugugguuguggacauugguagcaggacaaauaaaaauaaagcagggugaggaaaugaugggacagcuuuguaagauaggauggugucuucauuuggguuccucuagagacaaggauuggagugcaagucauuuauuugggacaagauggcaggaaauauuguuaggacaagugagaagggaggggaguccacaaagugggcauuauaaagcaaauuaccagcagggcgcgguggcucaugccuguaaucccagcacuuugggagaccaaggugggcagaucaccugaggucaagaguucgagaccagccuggccaacaugaugaaaccccaucucuacuuaaaauauaaaaauuagcugggugggguggugcaggccuguaaucccagcuacuugggaggcugaggcaggagaaucgcuugaacuugggaggcagagguugcagugagccgggaucacgccacugcacuccagccugggggacacagugagacuuugucucaaauaauaaauaaauaaauaaauaaauaaauaaauaaauaaauaaagcaaauuaccaccagggacuccuggagcuuaaccccgcugugggaacugugggaggcaguguagaacgugcucuucagagccguuccacuggaggggcaguucccggaagcccgguggagaggacuccuggggucgggagaucuucauuccccagucugcgccagccucagcaucuccagcaggcagaguggcagguacuggcagucagcacaacauggaaauggugugcagggaggauaagggcggccacugacagcaccagggaaggucccucugagaaggugacucgguacacaccggugaaucccaggagggaggagucugggaacaguguuccagcuagagggaacagcaagugcagggaauguugaacuggaggcuaggacucugcuucucccgggucugggggcugugugaggggcauguggcuugaaggagucagaggucacccacugcccacugagggucagauacucuuuuugagcagcccugcagggcucugccugaccccagcaaggggcuugggcugcaggaggcagguauggacugaagucccagugcugucaauuaugagccauggucaaacuccucugagcuucuuuaucugugaaaugggaacacugaucuauccuggacucuucucucaauaugagaauggucauggacacguuaaaucucuuugcauuugaccacuguaaugacaguagcucacacuugugauacuugguauguaccagacaagcuucuaagcucaccucgggugugaacucaguucauccucaagacaaccccauggauggauacucuuuuuuuuuuuuuuuuuuuuuuuuuuuuuuaagagggagucuccuucuguugcccaggcuggagugcagcagugggaucuuggcucagugcaaccuccaccuccuugguuuaagugauucuccugccucagccucccaaguagcugggauuacaggcgccugccaccacacacagcuaauuuuuuuguauuuuuaguagagacaguguuucaccauguuggccaggcuguucugaacuccugaccucaagugauccaccugcuuuggccacccagagugcugggauuacagacaugagcuaccacgccuggcugagguggauacuccuauugucccuguuauuuauuuauuuauuugagacaaggucucacucuauugcccaggcuggaaugcagugauaugaucauagcuuacugcagccucgaccuccugggcucaagggauccuccuggguagcuagaacuacaggugcacacugccacgcccagcuaauuauuuuuuguagagacgaggucuuaccauguuguccaggcuggucuugaacuccuggccucaagcaauccuuccuucucagccuccuagcacacuggaauuacaggcaugagccacugugccugucuugucccuguuuuaaaguuaggacacugagauccagggagguucagugacuaugaacuccacagcccauagcauauuuuucucuuacuguguaaguagguacuuaggaaaugguagcugcugcaauuugucauuuuaaaaauuauuuucuuuugauaacaaucucaacagcuuugacuucugaaauuuuccuaguacuuuucacguccagaaacuucuggugacgcuccugaggggaugaacccauuugucagauagaauuacagcccagagaagcagcuacacuccaggucagggcagagcuugagcccucuucugagauguugucacucuggccucugaggccaucuccccaccaggcugggggaggcuggaggccagagccccgguuggaggcuccccuggccccuggguuuggcugcagcucugauguugcagacacaccagccaggcagggucucugggagcagcagaacgggcacaagggcauucagcccagcucugacucccgggugguugggggaccuuaacaaggaaagaacacguguucacagcuguaauuuagaccuuagaccaggcauauggucuguccccagcuaacuccagcagcaggucaucuguaaaauugcaacguuaaaauagcgcagucauuacccacuacagggccaaaaauaacuaggaccggaacagggcugugcacucaggccuguauuugcccaggggccucugggagcaccuccugaagccgugggcuccucccggcaauaaggccuccggcuguggcuggcgaguagggcggguggcggguguggcccugagcccuaccaaugggccuucacugagagcucccaggugcugguuucuguggggagggugugggcaugaggggccuuacgcucuagugaagacaugagucaugugcacagaccacaggagggaagcagcuuccuagagagaaaggagcaucucaguggggccugggaacaugggguacaagggagaaacaggaccagacuggacggccacauugggcaggcgcacgcuuccaugccagguccuggggaagcagacaugaauggcagguacuuuaaagggaagagacguguaggcagugcuuggcagugggugguguggcugcaggaggaagaagagauuuacagucaagaaaggcaccaacagcccgcccacaggagggaugaggccccacuggaagguguacugagcaacugcgaugggccugccucucugcuaaauucuauaaacuuauccaagggucacaacagcccccaggagucagagcuguuguuucccccauuuuaaagaugaaaaacugagguucagggaggguaaugagcucacucaagaugacucagacaugaagcauuggagcugauaucuuaggauuaaggccuugcuguuaaccacgaggcuauauugccucaaaggaggcuuccuggaagagguuggaugugugggguuugaucaagugaagaaagggcauuuaggauagagggaacuacuugagcaaaggcaaagaaguuagacaguaaauauuacauuauuaggaagaagcucugcaugguuggagcuucuugggguaggggguauguagggauauugugggagaagagacggggaaacuuaaaauucccucacagucacuggucauuguggggauugucuauaguggacuggguggggugaggagagucccucugacuugccauguuaccuugcacaggucccaucccugucugggcuucaguuguaucaucaagugaggggcuugagcugagggccuaaggcugaugaguggcaaccagucuguaaggacgugguuagaggaggggaagggucaggccagggaaggaggaaugcagaaaaaugcugaacauuucaggggucagggaggacuagggaauguuuugacagcagagagaucaccagugaccuuggcaggcuuugguucuuuggaauggagggagcggaagugacuuuggaaaggggccaggaaagggcugaaccagaggaaaugggagaauggggacaugaaaaugggggcuggagagggagaguggagaauguuugccagggguagggauggauaaugagauguucaaaccuugaucaauuaguauugcuugccuggggccuugugcugagaaaggaucagagggaaguagagcugcaauugauuaucaaugucugccaagggugcgggucauaggcacaguagcacuucuuuccauugcuguccuugcuuagaugggucucagguugaaauugguggccuggguauccuagccugcagaggggaagccuuagguauuaggaauaccuaauuccaggugagaagaaaugccuccgccuccaaaaaccugaucuuuugcuagaauuaagguaguuugcugcaugauaaaguaguauggucucauggucaggagcuugggcuuuagagucaguccuuugagucucaguuuccucucuguaaaaugggaaugagagaaugccugcuugcaagguggcugugaguguuagaggugaugguaauagcuauggcuuuauuauuguugcaucuuuguuauaugaaagcgcuguuuuucccugaugauggugcuguuauucugaacuugagagcagggucugugucugaguugcuccagggccccaucacucaacccaggacuggggacaucucagggacuuucacauucuuuuggaggaucaaauggaauaggcuugugguugaugggacagaggauaaggucauguugggcuuuggggucaucucaguggagaccuggccucauguugggguggaggcccagggaugagaucuagggcuggagggucacugggccuggggccagggcuggggaugggaugggguuguccucgucauuucuuccuugagcgaguauugagcgcuaccugcaugccagguucuagaugacagucaguaagucccugcucaccugaucucaagacaugaggggaacuggguacaucuguaaguuccuguauaacccuccccagcccugacacccgcacccucuuucagaugaagaaauggccucagagagggacaguggcuugcucaaggcaaauccagagaaauguggguguacaaggcuccuucuggcuguggagagggggaccagagccccuggaggcccagggcucuaggauaggagcugagaggggcagcagggauccagacuggguaggggaccuggugaugccaccuggacccagacuucugcucuugacagagccggaacuccagaaccaagcugagccuuguaguaggggcccacaucccugccagagccucagcugcccuggaacuagcaauacccaaacuuucuuccuguggcuuuucaaucagagccagugaggaaggccucaggaggagguagggagggcccaggacaucucccagccccucccugggggauggucuagggaagcuggcccuggcuaccucucguggccccuggaagcugauuccuggcuggauccugcucuguccucaacaagauugugugugaggcugaagagcaguuuucuuucucaucuguaaaauggugcagucauaacaaacaccuccuacaagcacagcaucugugaggguuuccucucuguaaaaugggacagagagguaggggacaggaaggggcucuggcagguggaagugugagguguucauucaucuuucuucauguccuccuuccgaggagccggggauggucagaaacugucagugcagccugcuuuugcccucaugcccauuugccuccacggggcccucaccuacgugguggggcgcucuuuccacgugucccuccugguccauuugcccacccagugaggcaggcucauccccuuauuuccugacauuugugugguuggugcuuuuagagaacucuccuuguggacucuguucugcaccauugucacagcccagagaggggggaauguuagucccaaagaggagaggggacuucccuaggaccauccagggggugggaagcagagugggucucgaaccuucuccgauuugggaaaucgccuucuccucuccccacccacccuuacccuucccugcucucccugggcuacugucuccugcccagccucccacaugccccuguuggucucuacggaugcgcacagggaggaaagcagugcaggcuggggccaugggaaccgcucaggguugaaguccgacucauuguauguggccuucaucucaugacuuugccucccugagccucagucuccuaaucuguagaaucauugucucacaggauugcacuaaggauucaguaagaaaugguaugauuugcccucagcaagugguagcauugaaguaaagagggcucagggcuugaaaauagggcucgaaacuuggcucuugcacuuccuggcucucuggacuugguuaugugauugagccuccauggccuccgugucuuugucugucaauggguuugauuaaagcguugaccucauagguucuuaggaggauuaaugagaacauuuuauguaaagcugcuuacauggagccuugguaugugccggaaagcuuuagcccuuuauuaaaagugacagcagacccagcacgguggcucaugccuguaaucccagcacuuugggaggcugaggcgggcagaucacuuggggucaggaguucgagaccagcuacucgggaggcagaggcaggagaaucgcuugaaccuggggugcagagguugcaguaagcugagcucgcaccacugcacuccagccugagugacagagugaaacucagucucaaaaaaaaaaaaaaaaaaagaguggcaguaguggugggggagacccccaucccccuugcugggguuuccuaggaaagaaggcuggugagagcuguugcugguggugggcccugagccgcagggucugagggccuacccugugcuaccccagagcugccugagaacuggacagacacgcgggagacgcugcuggaggggaugcuguucagccucaaguaccugggcaugacgcuaguggagcagcccaagggugaggagcugucggccgccgccaucaagaggaucguggcuacagugagcaccccagucaggaagggugggggaaccagggaccaaggaccagcuucuucccagggugcccucgucccagcuuguuacuccaguugggugugucugagccuggcccugcccuucauucuccuuccauccagcuuuugggccuuggcagaggggaaccauuggacuugcaaggucacgguuaguggcuucccuccagccauuauggccucuuccagccuccccacccccagcucaggcucccuaccaaugcauuggugacuuaucagcaccaggaaggguggggaguuugcuuucccuugacuaccugcccaauggccugagagacagcauagcccaucagagagcagauugcccccucccuaacuuugagcaagggugggccuuuuaaauccacuucccuugguggccucagaccccucagcucaauggauggagcagaguacucaggagucauccugcuggguugugcuagcucauucagugccgagucugcaggcccuucuagcuguguguccuuggguaagucccuuagccucucugaguccaucucuggggagagggaggaugacuccagguccacggugccugacagauagcuggugcucagcagaugcugcuccuguuucuauugcaagaaggugcuggcugaguggucuugcccacacugcugccagucaccugagcugagaugggccccgugccuggggcuuaggaacagugaaguguaagccaugagggugggucucaagugaggcuggcagacuccucugacuccugucugcucccaaggcuaaggccagugggaagaagcugcagaaggugacucugaaggugucgccacggggaauuauccugacagacaaccucaccaaccagcucauugagaacguguccauauacagguacgcucagcaugggguuggcccauccacucugccacuuggggcaguggguggaguaucccaucugaauccaggcucuaccacuuccuaccugggugacauuggagccucaguuuccucaucuguaaaaugggggugggaacagauccugcugcacagcgcuguuaggaaacguggagugcacggcaccuggcucaugaugagcauuugguuaaguggcagcugcugcugucaucaucaccaguugcagaagacagcugagcccacccgugcccuuccccccuacuccccaccagcaugccgcugagucgggcuuggagcagagaacugcagagucacugccuuuuccuucugcugugaaugcagcagcucagcucuggguaucuggccagacauuccagggaggccucagccaaggucugaagucagaguauagauggucucucuaguggguccucuggucagcccuuagagccucagacuauccccaccucucucggcuggucaguuguaguuuuucagaacuggaagggacagcucagguccauuuuacagauggagaagcugaggcccagagagggaauugccuaaggcugcacagugagguaguagcuaaacuggaacuaggauauccgggccagagcccuguccagcaggcucccgucugccuggcaucccuccacccucuugcuuugucucuaagcagauggcucagcccguuggugcacaggccaguaguagggucaguagauguguguugugggggucuggcugaugucuuccucucaccggccugaucauaccugccuuccuuuagucaacaguuucagauaccuauucugccaacgucugugccagaugaggacuccaauccugcucauugcccucaaggagcuuccacucuaguuggguauagucgggaggaaacaggagauagagcauaguguuccaaaaaggcaaggaggagaucugccuggggaaaucccggaaggccucccaggggaggcggcaccuugcuggggcuugaagaauaauaggaucuaguuuguuguuaccaaggacccaguaacauuuagagcaggaagcuggacccccugggauggagaagagguaggcagggaccuaacaccuucacgcucugcccaccgggguguugaugccugugauugaagcuggggccacaugguugaggggugagucuauggcgcuccugucccaccucuggguugaggggugagucuguggugcuccugccccaccucugggcuaccggccccuccccgauugagacucugaggcugacuggaggcaacgaggagggaccagacaagugagggagggugggaggccgagggcucggguggccccuagguuacaggugcgacugggggcagagagggugcuccaugcagagggaguugcugugugucuccucccgggcccacuggggcuccuuguuggguccucgucacacacgcaccccaccccuacucccagcucuucaccccuggccacagcuccagaacuugcaagugucccagucacccugagagagauggaccugaaucucaccagaccucugggcaggggcauggaucggagggcagguggggugggggaggccaggugaagggcauuggugagcaggggaguguccugcuuucugcuuccccuucuggccaguuggcacacagccuuaagaggcagcauggcagucauggccucuggaguccuacaagugaguucaggucugggcucaggucuuuagccucaguuuacuucaucugaaaaacauggauagugauagaacccgucucagaggguagcuuugagaaucacaugaggugaggucuagaaagcucuuggcacauugccugguaugugguaaggguucagcuauuacuguuuugggguguggcucagugugggaugggagggagagggggaagugcccugcuuccagucuuuaccccauuccuuccuuccugccuggccugggccccuccugcacagauggccuagguacccagccuggaggccaaggcuggauucccagagucugcccugguggagugggaauagcagguucucugcaacucaggggagcugcccugcagggcuucccacaugugcucaggccccugugccaggucuggugaugcuuccuccuugccuuucaggaucuccuauugcacagcagacaagaugcacgacaagguguuugcauacaucgcccagagccagcacaaccagagccucgagugccacgccuuccucugcaccaagcggaagauggucagcggggagggcuggggcggggacaggguccaguggccuuggcagccuugcucuggguggggggcugucuggugugggaggcaggacccaaaggugaccauuacuuaagaagagggugaaaucucugggaaccccaagugggugccgagagcuaagggguacagugguggggcugcaggcaggcaggugaaccgccggucagcuuugugugggcaguagcuggcccauguccccagugugugucugggccuguucucucuguaacgggauuugcuggguugagauuguuuuggaucuccugucuuuaauauggucuagggaugcagggccuucuggugauugguccucggaaaugggagaucaggggggccuaggguggaaggcaaaggcgagagccgucagagaaccaggcuugcugugacuggaguguggagggcaauggcuguuucuuggugccuccugugaguucauuccagcugugaccagaguguggaggacagugaccgucucucggugccuccugugugugcauucuagugcuaggcuuccaggucuucacucguuuaauucucacggcucugcaagguggcaacuguuacucucuccauuuuuuuuucuucuuuuuuuuaaaguuuuaaugaggaaacagacucccagaggccagcuaucuugcugucaggguuagaguggggguuuaaacccacguuucuuccccucccugcgugacuggggaguucagagcuccuugucucauuuccaggacacccccugaccacaucuuagcugggaugagugggaaccuugguggucacgggggauuuguccugaauuugggggcaagaaguggagugggucaaccuuuggcauugcagcuuuuguuucugagacccccaggaucugagcauucucccuauaaggugcuuccugacauccauugauguagcauugacaccuguuaaccucuguugacagcucugagccccaguccccaugcccuauagcccuuggaaccuaggagacaagauccccuucccuccccugucaucaaaggacaugucagguacaucacagucuuugugguccccaggcuuccugcugcccaucaggacacacuuuagauauuguguaaguuguaacaaaugaucgcaaauuuaguggcuuaaaacacaaauguauucucuuauggagaagaaaaauguauucugugacagaaguagaucaggagucuaaacuaggucggcaggauuguguuuuuuucuggagguucuggggggaauccauuuccuuaccuuuucuaccucccagagacugaucaccugcauuuccagguuugugggccuguccucaucuuccgagccagcaauguagcaucuucuggucuccugauuucaucgucacauugcugcuuuuagcucugacucuccuaccccgcucagcacuccuucugaugacauuuggacacucugaguaaucugggauaaucuccaucgccacauccuuaacucacuucuguaaagcccguuugcuguguaaggcagcauucacgggucucagggauuaggauguggacaucuugggggcggacacacgauucagcccaccacaggugucauggaagaggcacuguaggaggagacagucuagcggucuccuggcugauuugcuguguuaccuuggagaagauccugccuuucucugggcugcuugccuaucagcagaaugagaagguugccucagugaccuccaggguuguucugaaaggccccggguucuuuugaacaccuuguuucuuuccugcagacucagugucacuggccacuugccucgugaggucccagggcuccaaguugcuguggcaucuccugugaguucccacagaugugacucguggcuuugucuuuuaggaggccacacagacuuaaaaauacagcuccuuauguccccauuguucaucucuuccugcccgcugaccagggcaggcccugggcagggacagcuggcccugggugggaggggccuucgacggugcagaggcuuccucugggaugaggggucugggaguaagagagaggugcaggcccagcucuuacaagggagaccuggccuguggucagagaacuucacacagacuugagugaaaucagccuacccucaggccaugaggucaguuacgaggaaaacagagccaggccgcugcucagccacugacugcagagcccugaccaggcagcagaagggccccugccagacacccaaacucuucaucuuucuuaguguauucuucucagguuggguugauggcuggagugguuuauccaucucccuacccuuugcuaccuggccucccugcuucaggggcccugcggagcccucuccaagacagcgcagcccagcaugguguaaauacaucaccugcuaccucaaggucuuagcccaacccaggcugacaguguguugguggccuagacauguuggaaauccuagauucuugggcuaaguggaaguguucuugggggaggcaggagauggaauagcugcgucagccuccgcaccugcuggcagcuccgccacagagguuuggcaccgucuguccuggccugagccauggagaaaacauccaaggcgguagagaacagcccagcaucaguaccuggaacccaggggggcuuaguucuggggugguaguaaaucucacuaacuucccugaaguuagagucagugagacuucccugagacagacaccuugaauggggcuuugaaggcugaggagccaggaggaguuugccaggccgagagaaggggguggggugguggguggggagugcacaccagcaugggauuaacacacgugcaaacgcagaggggcgaagugaaaugguuccccugggguggguggugaggcagcuuccguuugcagugggccuugaaucaggauguugagggccuugaaucaggauguugagggccuugaaucgggauguugacaaaacgucagucauuguggcugggggccuccacaucccuacucuuccuggcugggcugccggaaugaguucaugacccauugagguugggggagaaaggcuccuuucuacaucacccaccaguccguucaacucuggggcagcacagccaccccaggucuccccucccuggugcugcugggcacagccagcauaggguuccuccagggaaucccuuccaucugcccaaccgggaggccucugggcuccaaagugaaggugucaugcaggugcugggccugggcugaugguaagcaaagugcuacccccauuuccacccaggcagcacggggccaggcugcucccucccccaugaccauuggcaucuuggagugauccuugugcaagguuuuugcuucuggggcagcagggcugcuggggggcauguggcugucuugguuugaguuucuggccccuuuugagccaugagcagccugguuccugggaacaaggaaugugaaaaacugggcaagguagcauccacucaggauaauaaggcagacccgaaggccagaggcagucaggaggggugggcaucccgccugggcaggccugagcagucccuccaccuaaugcugguccucggaucccugcagccaccccaggaagcagggcccaccccacucccagucccugcccagccugggcuugcagcuaccugcacacauccaccucuuggguuguauucaguuuaacuuacagcuugggacuucagggcaaaaagguaggaauguaugcaagugaacaaucagauuuaugcaacuacagucuaagcuugugucuccagauuuccagcaggcuuaaauaauggcguuuucauaucccugccacauuggguguccagcccuugcuuggguggauagugaucugacuugggcugguaauuagcccauauuuuuaguucaugggcaauucucaaugguaacugggucuauuaaacuugauucagauaugacagcuuaaauuguaaacagcugcgaagaguuucauacuuaauuaccauauuuaaguuuugccauaaagugccuguacuuccaucaaaaauguaaauguuggagacauucaaaugagguuuuauacuuucgugaaguguaauuggcacggaucagucaguuuguuuaggaauuuuaaauauuuuuuuaaaaggaguuuuaaaggcaguggccacagguccauuucucaauuaaauugaguugucugggggagggcagggagcggggcugaggcuggugaggccugaacuuguagacuugaaagaggcuggugcuuucuucucucagccagggcuucagaaggaagcuagauguuuccggcuauagcuacgaacucugggacuuccacucccagaagcugagcugauuaacccuggacuggaauggcugagagaggaagguguugagaugaauaugggcuggggauagguccuggguggaaugaggccugcaccucaggugaauguaauucacccagcauuguugccaccucugggaggcuuuggccugcucccgagggcagggguguucagauugauucuugcuuuuagggugcacaaagcugggggaaacacaggcaggggagccagugacacuuucacaugcauagugccagagggagguggguggggcucgaggagucugggacuggugacaggagagguggugacaucugaguuggguuuggaggggugagggagaguuccccuggggugaagggccgagguguggcccuuccuuacagguggguuauagcacugaccgguuuugguccccgggccuucauugacaucuugcuccuaucaggaaauugacaagccuucuacucucuuugugggauccaguuauggucccaaccggaaccuaacuuucaccucucuggcuguggcucauuuggggcaauggcugggcccuuccaauucuggcuuuucuguucuccaauuccaagggcuaaguccacagguaauuagggaggguuucuuggaggaaguaagccucacaguucauugaauucagggaagcccaaaggggaaggaaaagaccuggagaagaacagccuuugcaggcaggggcccuagagugagagugagaacuuugguggggccagagauaguaaagauggggacucuacugccucugcgaggcuauggccuuaugacaccccaggcugcuuuggagaccugggaagggccaggacccugcucugcccagcaggcauuccagagccugggauggagcugcagaagcugcagggagggagccagggggccuggccuggaggccccagcccuccagugcagacuugcucugcccuggcugacacugcaccccuccccauccccacuuccuguuuucaggcacaggcuguuacccucaccguagcccaggccuucaaagucgccuuugaguuuuggcagguguccaaggaaggugagacuuugcaucuacauuguggguguggugggagguggggagacacauaaaggcccuggggucagaccuggaccgacuuccugccucaucacccaccuggcuugugacugugagcaggucccuucaccgcucagagucucgguuuucccaucugaaaaaugggaacagccgucucccuccccaaaggugcuugugaggauuaacugacauccgaaagguuucuuuccucccggcuggaaaccugaaacugccccuugagguuggccaccgcuaaucaccccugcccggugauugcuggggacagagugcuggggucugaggcuccaacauguugugccuugguccugcagagaaagagaagagggacaaagccagccaagagggaggggacguccugggggcccgccaagacugcacccccuccuugaagagcugugaguccugacggggaagggggauuggccaugcgguguugggguugcgcuucacccaggggggucccacuccugccugggcugggagagccucuugguuuuucacuuguguuuuguuaaauaaauaauacacguucauuacagaucaauuagaaaauguagauaaggggaagaaauaacucauuuuaguacauuuucuucuagauaugucccuaugcaaauauauaaauaugcgucuaucuuucuauauacuuaacauaguauugugugguugcuuaagaaaacuuaacuauugugaauacaaaaguuucagucuaagccauuagucagguucucacucugugggcagcugcgcaucugcuguggggaggugccagggccgggcucugcugggaggccugggcaaggccacaucagaggggagggucagggccaggacagcccagggagggggccaggaaggaagaggcugaucucccacugacaaccugaccggaucccucacaguggucgccacugggaaccugcuggacuuagaggagacagcuaaggccccgcuguccacggucagcgccaacaccaccaacauggacgaggugccgcggccacaagccuugaguggcagcaguguugucugggugagugguuguguggccagcagaucggugauccucagccugaccucugggugagccuggggcugcuccagggaccaggcccugggacccgugacuugugggccucugggaggaccagacccagcccgguagugcccaggcgcaggauaggggaugaacaaugucccuuuugaaccugaggcugcauccccaacaggcuuggcucccagcacagcugucuccucacaaugcuuggccucuuggccugagcguccacggcucugcccaccacaagaccagccaaaggcgcccuuguucuugguguggcagagcucgcuccuaccaccccucccccucagccgccugaaugaggacccagagacuugggcagucaccagcuuggucccugacucccucagggacucagggcaagcccccugaccucucugucucagcuuuuucaucucaguaagggugaugaccucugccaacggaaucuccccgaggaaccugaaauuuaauuuuaauuuuucauuuggaaauaauuucagacuguguuacaaaauuaguacagagaauuccuguucacccgucauccagauuccccaauuguuaacaucuugcaugaccacauuacacuggucagaaucaggaaacaaacacgauacugugcuguuauauaaucuauagaacuuacacauuucuccaggugccccuucaguguccuguuucuggcccaggauccauugcagaaucacauguuaacuugucgucucuuuaauuuuuaaaaaucuggguacugggggcuccccuggugucccucgagccuguucucugcuguuugggaaccacccuugccacuugcccauccucaccagaaggccauggagggaccucaccugucgcuuuucugcugaggcugugggacuccuggcaucaguuaucccucaugaacuuggaauuuuggcuuggcuuuuggaaguaaaugaaggcaagaaaacucccuuccccacccucuuccuuuuggaauuugaaagccauagaagucaucagguccaaugcccuccucuuauugaaggaaaagcugaguuucaacguggagcagugacuugcccaaggucucacgggcagguagcauggaccagggcacugaacccaccugggucuccagacacccugggacauggccuuucuccucucccacgucuccagcuuuggguccuugggcugagaugcuggcgaugcacccaggcaggaggccugccugaggccgugccuccaggcgcccacccugagcuuguguccugagucccuguagcuuacccagggcugggacaagccccagcugugagcaugggcucccccaaacauaguucuuaucuccugcuuuguuuuccccaaggagcuggaugauggccuggaugaagcguuuucgagguaaugcuagcuuccugugcuggguagggggccuggugugcgugggcuggcccugcugcccuuucuccuggggaccuuuccccugauuaagaacacaagccacucagacccccuccagagcaacagucccaucccuccacucaaaugcuuccaggggcagggagcucacuggggaggaaaccccuuccagcguuguccagagcuguuagaaaguucuuacuguugagucaaaaacuauuccugguggcugcucugccgcagucugaggugagcgaaacacacugcagcucaaguugauuuccuccgacuugaggaggcguggccuucaaaaaugggcuuuuuuuuuuuuuuacaggcuuugcucccuccacaggucuguguuuaugaacaggggaagggagaaaguguuuaaugaagcucgugaagcguuccauagcagggaaggucaggcacagugaggagguguuuugguauagccuuugguggcauuuccccguuuucccaggggccauccuuguggcccccugcagcuuggggacaugccacugagaaggcuguggcugaggagaggccugggcaggucaggguuccgagcccuggguccccgucugucaggccucccuuucucacuugagacccucagcagccuccuacagcccucccacaucaggggcuuuguuugggguuggagucagcgauuuuugguccagcggguggggacagagucagggucuuugcccuccugccuccuccuuccucuuccuugccuccuucuugccagggacuaguggaaaccccuugguccagccuggggcgagggcgacagugacaccuucccugccucacuggcugacgacaccugcccucugaagaaaaucuuuuguuugcuuucuccacauuauuuugagcaucaugugcccuuuauuaacaauuuugaaaaucagcaaagcauuaaacagaaaguaacaccauccuguaaucccacagcccagaguuuugggcuuaauucaugcuaauccuauacauauacauuauuuugcauugaucagcucaucguauuugcauuuugggauccugauuuuucacuuaacagcgaugugucagaagcauugcuccaggcuguuaaaagcuccucguaaacaccucuuccauugacugccuaacauucucuuaagggaagcugcuauaauuuacuugacucuccccuauucuuuuggacauguagguugucucccuuuguaaauuuauuuuucgaacagcacgguguugacacaguuauagccaaagaaucuuccguguucccucccacagcuuguuccccaccccacccccacccccgcugcucccuuuaccagccccuucuccucuuuccugggcauguccugacugagcuggggcacagagugggugcucuggccucucccgggggugggugcaccgcuggcugccccugacuuuucugagcuguuugacucucaaggggaggugcuuugaucugagguuacuccaccuccccugcaccgggggcuuccuucuugggccaugugcccugcuguuccccacuggugcccccucgcgucugacccuggggcgcgccagcccucacccaggcucucggcucacacagcucugccuuccaggcuugcccagucucggacaaacccucagguccuggacacuggccugacagcccaggacaugcauuacgcccagugccucucgccugucgacugggacaagccugacagcagcggcacagagcaggaugaccucuucagcuucugagggcccggggccagccggacacaagcggcccugacacgugauggaccaaagccaccugcugcgggggagccaguucuggggcccgccugccaccucucccagcccucagcauugucagccugaagaucagagcugcagccagucaggcaggggagagauuuuucuuuuaagcccugcucuuucucugagaaccaaaagaugccuugaauauuuauucagugacuucuggcuuaugcucagaagccagucugcgucaggcacgucuccugcugcgugacaugugcagugcuguaaucggcucccgcuugcucuccuggagcaagcucugcccuggcuguggguaucaggacugugaccaaagcauuucuagucccuucucucuuucuaaggacccaaauuucccugggggcauccugcuuccugaaagcuguuggauuucagugauuuuuccccccaccccccagcacaggagagcacccacagccgcagaaggggaauguguccuccugcucugcuuccucagggcccagcaggcggggguuugagcccuggaccccaggcucuuagagacuaaggggcagcuccugaccaaagacgauacagcuuggcacuuuaaagcauuaacagcaggugugacccugagggcuccuccauggugcugcauugaguccagcuuuccuucugcccuuccuccaggagaaggggcccaagguccccguggauggucuccaccugugcuuggaaccaguguaacuggcugcucccugcucccagggacugacacggggaucaucucugugaccgcccuccgucgggccccugccugccuucuccccuccacgcaaggcugugcucuuccucugguuucuguguguccguuugagugucugcgccccgccuccccauacuuccugggaugaugugugaaaccugacaccuagauuuauuuggaaauauucuaugaccacuuuacagaugaggaaacaggccucaagcguggagggguagagugaagaguagaacccaggucugaugccaaagcugcuuucuucucugccuccuccucacgcaacucacaccuccuuuucuucuagcuuuguuguccucccaggaaccaaaaaaccccagcuauuuucugaccaaaauguguuucauaacaaaccaucuggugccuuuccacacagaacuggcaggagccucguguccugcuagcugucucucuuguugauuuccgugaaaaugcaaguguuugaagucugcucauuccgagggugaaacaaaauccaacccugucagaaucaugcuguucucuuugcugacacugugacccugggucgggacagaccagcagcaaucugucuuuagaaucgcuuuccuuccuccccuuuugcccccguggggcucccggcauccugaaagccagcaaagccuccagcaucuuuuccauccugaggugccucccaguggccuggcuugucggagcaaguuucaucagcccuagggaaaacacggcccuccugggaaccuccuuaccuggaguaaccggacaccuuagacggaggugccugaggguggggugggauuugcagggucauuaucagaacaugaggauaacuuccuugccccugcucuguagccaccuccuuggcaccggccucuauuugucauaaggcggcgugggcgaggccugacacaggccagccuuggcacgaggggggccagggguucugagaagcgcugcccugugagagccacgcuggccuucgucuccaucucugguugacgggcuguccgugugccuccugugugucugcagacaagucuugcugugcuuuauuugugaaacuuuaaugaggaaaaaacaaauaauaaauguucucguuuugaaacucaa

SEQ ID NO: 61536 - RNA, 3537 nt, Homo sapiens
ggaguccgaucaugugaucuucaacauggcgacgcucuugguucccuacagaaaggggcggagccuggacuggggggcaggcucagauucagguuaaauuguggauugagcucgcaguuacagacagcugaccauggaagcgaauggguuggggugaguucuccagagcacgcgguguggcuagccgggcuucuaauuugagucuuccaacucaggacucuaucccucuacuccccuuuccccacccuggagaccucccaaccugaacuccguuagcugggauccugaauccuaaaaccauggauuuuugagauguucaucccagggccuuaauucaagggaugccucaggauuuccaaccaggaucucuauucugggaccaucaacucugaucccucuuuaucccccagccuggguauuucucagccccugaaccagcccagugacauucccguuucugaggcucacuaguucgaagacccccaaacuauccuuagugggccuucauucccuccccccagucccucugguugcuucgagcuuggaagaguagagacuaaguggagggaagaggccccagggcgggcccuucuggaguuugugcaccaccugauaggcagagaggaggcggaacgggcggaaagccaggguuugggagcuggccuggaggagguagauagcgguccuggacugaaucggccuuaugaacccgcgcuuuccccagccuccagcguagcauacugacaccuacccccacccccaccugaucgccagaccucaggguuuuccggagcugaagaaugacacauuccugcgagcagccuggggagaggaaacagacuacacucccguuuggugcaugcgccaggcaggccguuacuuaccagguaagagucagggucuggaaaucuagauaaaacuccggagggagaaaaguuuucgaggggcaggggagggcucuggagggccucaaggcugagcccugucuucccucuguaugcagaguuuagggaaacccgggcugcccaggacuuuuucagcacgugucgcucuccugaggccugcugugaacugacucugcaggugagggguccacaaaagagggaaagauuuaugccuucagucugccaccuagcaaccugucuccuguuuccuacagccacugcgucgcuucccucuggaugcugccaucauuuucuccgacauccuuguuguaccccagguacccacucaaaccugauccuagaauauaauccaaggacgccuugaaaauccuucuaucaguccagucaagguuuacaauaagcacuuauccuaacuggaucgagggaaaaacuaagguugaaagaaauggaguuuggcagaguuuuauucuccuuuuccuuccuccuggaaugagcugaacagaaccuuuccuccuggauuccauuuugggaacccagauguuuucucccccuccaggcacugggcauggaggugaccaugguaccuggcaaaggacccagcuucccagagccauuaagagaagagcaggaccuagaacgccuacgggauccagaagugguagccucugagcuaggcuauguguuccaagccaucacccuuacccgacaacgacuggcuggacgugugccgcugauuggcuuugcuggugccccaguaaugugggacagggcagggacucggggcgcggggagaucacucuggaaggucugggguagacaaaaggaagggucagucuggcuucugugacaccaucuuucuauccuucucuaguggacccugaugacauacaugguugagggugguggcucaagcaccauggcucaggccaagcgcuggcucuaucagagaccucaggcuagucaccagcugcuucgcauccucacugaugcucuggucccauaucugguaggacaagugguggcuggugcccaggugaguccugagagagagagaaauaggcugggauuuggucuguaaggaccagaagcaagaguguccuaaaccugagagggcaggggucuuaaugccagggaugaaagaaccuuggccuccagugaucuagcggagcagccaagcccauccugacacugacaguggggcuuaaugcucuaaguauucagacaccaaaguuagugcugggaucugaggaaaguaaauuuuuuuuuuuuuaauuacuggguuuuuagggucaggcaguaucagggauugaagucauuuggggaaaauugagguggauuuuguaugugggggaaacuuccucuuuguguguuacauauuuuucuucaccauacccuaacuaggcauugcagcuguuugagucccaugcagggcaucuuggcccacagcucuucaacaaguuugcacugccuuacauccgugauguggccaagcaagugaaggccagguugcgggaggcaggccuggcaccagugcccauggugaggauugggauggguugagugaaggugguccuguggagcuuucaggcuaaguccugcauggacuggagugaccacuggagggcagcagaaguacagucaagaaagauuagugguuguagcaaggcccucuguagccugagaucugcuuuuuucuagaucaucuuugcuaaggaugggcauuuugcccuggaggagcuggcccaagcuggcuaugaggugguugggcuugacuggacaguggccccaaagaaagcccgguaagccauggaagggugaggccuugagguugagguggggguguuggcugggggagcugccauguaugcaguuaccagaacguggcgcuggcuuugcuuccagggaguguguggggaagacggugacauugcagggcaaccuggaccccugugccuuguaugcaucugagguaacagccagggccccucugugugucuguuacugugcacuccuguggcuguggcuguauuauucugugugcacuuguuuuuaaugucugucuguccuuuucuucuacucuguacaacauaagcccuagaaagaccggacuuuuuguugcuguuguucauuuguguuuaugcuucaugccuggguccauacuagggaucugauaaauuuuauugaaugacugaauaacacugaguagaagcaugccuacauaugcguuugucacuaguauauauagggaggacaaaggcuugcugguccuccuguagccagugcccuguuggucccccaggaggagaucgggcaguuggugaagcagaugcuggaugacuuuggaccacaucgcuacauugccaaccugggccaugggcuuuauccugacauggacccagaacaugugggcgccuuuguggaugcugugcauaaacacucacgucugcuucgacagaacugaguguauaccuuuacccucaaguaccacuaacacagaugauugaucguuuccaggacaauaaaaguuucggaguugaacuauuguguaguuuuguuugugaaagauugugcccauauccucaguucuucuuagccucugcuccuucccugggaacccucucuauauccucuu

SEQ ID NO: 61537 - RNA, 3537 nt, Homo sapiens; identical to SEQ ID NO: 61536

SEQ ID NO: 61538 - RNA, 9831 nt, Homo sapiens
agcgcaaggugacgggcguggacgcggcuguggggccgggagcggaggguuggggucuggccucccgcgccggggcgaaggggcagccgcagcgcagaggcccgccccgcccuccccucccgucacgcccagccucccggcccuugggcugcucgcggccuuuuuuucccggcugggcucgggcucagcucgacugggcucggcgggcggcggcggcggcgccggcggcuggcggaggagggagggcgagggcgggcgcgggccggcgggcgggcggaagagggaggagaggcgcggggagccaggccucggggccucggagcaaccacccgagcagacggaguacacggagcagcggccccggccccgccaacgcugccgccgggugagucggggcccccgcccggcgcccgagccccgcgcgggggugggaaggggcugcggaaaaguugggagccccgggugccgcuuugucgcggggccgcggaggggucgggcugggaaggccgcggggccggggcgaggagggaggcggcgcuggcggggggcgcugcgggcgcucauggcggcggccgccggguaaggcgggcgcagcgccucaagggagcggccggggccggcgggccuggcgccgcgguguccgcggcagcgccgcccugagccggagaagcuuucccgggcaacagguagggcggaagguggggacgcgggggcugcgggcgacggggccgagccgugggcuucccuuuguuggggaguggaggagcuuggugaccauuggcgcgagagccuccacccuggcagcggcccgcgggguugcccuggccuggacgcguccuguggcuugggugggaggagaggggagggcccugccccguuuucuuccuaccggcccaccgugcccaccucgcaggcgaggucagagcuuccaugugcuuaacgggaaacaggaaggagcggcccggagcgccugccccggcccgguagggcuaaggcauaccguuaugagguguggauggcuggcaagggagcuccugguggaacuggcuuucugggccguagcuuguuaaucacuagaggcccguggcaaguggguugacugcagguguagagcacucaucuuuagccugcaguuggagucucucccucccuaagccuagcuccuggcaucaaaaccugguuucagucaccugaguugccaggcccagguucaggggguucugaggaucguggcgaaugcagugagccccuguuccuggagaagugaguccgagcaggccuccagcaggcagucacccccauaucugugcuggggcagggguggguggcgguugcugccgcauaccggagucgggaugaccgcaccggggugugaguggcugcacauguaaaggggcuccuaaggguaaggacuugccugcaguccugucccugaggaccuggcgcugaccauaccgugaucugcacagucuguuccagagagggauccuuuucuccccuggucccccacuucccucacuggggccucuggccagauuuuccccugggaggaagggccuccuuuuaccccugucacuggccauaggcuggcugaucccucacuguguccuucaacaccgccccagcugucucucaaacccaccggcgucucccugccccuggggccauagucucaugcaguguuuugguccguggaggccuuuggugggacuuugcagacaagcuguaggccagaugaggcugaggacuacuguucugacugccucucacccaccucuuuuuuacaaucuggcuuauuuugaggcccauccugcagccuggagggauaacacaccucucauuggcuccauccauggcuuguagacuucuaguacaugaccugcuucuguugccugaaaguuuucaacaaggaagacuauucaggacuucuucaguggaagcagggagccggugggaccuuugucacuccucccuugucaacaacuccuuucuauuuuccucaguuauucuuccaaacuaugagagccagucagacugaccaccuggagucugagagaauuccuuccucucaggccgaaacuucugccuucucagccguuuggaucuacaaacucccauggggauccucugcuccuuucauccaccuagaggggucuugugggggugucagucagaguuggggcaaagguuggggcuggacagaguccugcucaaguuccugcuaaucuaaugccaguuaaaucccugcucuucuggccccucuccagccugugccucagaaaguggcaucugugccuccaaggcaggugugugugagagagagcguagacagauaccaugucucuucauguguaugggggagugaagucuggguggaaaaguguuucuagaugugauuuucuccauaagaagucaaguaacugcccugaaggcccagggggccuggaaaaacaggguugucuccuuaccguguguacacuucagcuuuucuugccccagccucuuguuuauggggucuugcuuggaucugugugcuggugcuaagaggccuccccaguacugccacagggacccaacucuuugguucuguggggauguguaagugaggccggccaggccccagcuguccuccccucucuucauguugagucagagguccugacccugcugaaucuggggccucccugcuggggagauggggguagugccucucugcuaauggaggugcaggaccaccagggagggcuguggucaugggaagccugcaaccucaguguaaaagcccccauuaaucugcauuucccaagucuuccacucucccugcuuggaguggaagaggacaggcgcuaucucaucuuggggaugaggaaguugcacugcccaggugucuguccuugaccaugcucuagugccuacuuugccugccccccacccccuguuuugcaggcaugagacauuccugggccccaggaguccagcaggggcuccacccucccucugcgacuccagccugccgccugacuagagaaacaucccugccaguuuucacagaccugguuggggaugggaucugaagucuaggacugccagggcaacaugguaccuuuggcuuuacauuucccuggagaaguugggcuccaagagacagcagucaggugacugggucaggcugauuucucgcuuccaaucaggcugagcaaaaaagugggaagagggggccaugugcacacaucaaaguguuccgcauugucccuucucugugcauuuucuacccuugucccuucuuuauucaauuuucuacaacuuuucucuaggaaaaaaguguguguuuguguggggaaaguuccacuguggauaauuacauuuaauuuuguucaguucagaaggcuuccaucuguuuaauuaaauauuuauucuggcugagguggagggggcaggggcagugucuggaaugugugugugugauuugggggaggaggaggggagaagguggagcugaagcuccuuuacuggcagugcugaccucugauuucauccgagagagcagugaccaggaguggggacaaggggguaaaguccuugagcuggaauacugacccgugacaggcugagggauuucgcaagggcuacagugguggguggggguggagcgggagcugucagagcagcagcaggaccagcccagcccagcuguggucucaggcucugucuucagucaguggcaccaacuagucuccaggucacuguggauaacaauuucaccacucucuuuucuuccugucucugcuuucacuuucugggccagccuaaaucccaccgccucaucuccuucccaggagaacaagggguggggagccuggaaaagacugucauggucauccugcugcggcuucuugcugaguccuaggauugccagguguuugcuggacccagcaucccuggcucuccuggaccaucuugccauuccucucagcuucaagcagcugcucuucccucaugagccacacacgucugaccguucccucccuccucuggguauccaaguggucacucccaccauguuguucgucuuucaguugggggaggagguuuacauagcggcucuuuccuagacugagaggguauggguguuccccugcagacuaggauucuguuuucuggaugagcauuuauacgaaauagcucugaccaggcaccguggcucaugccuguaaucccagcacuuugggaggccaaggcuggcagguugcuugagcccaggaguucaagaccagucugggcaacauggcaaaacccuguuucuaccaaaaaaaaaauucaaaaauuagccagauguggugugugcuacuugguagugcaugcuacucauagccccaggcacucgggaggcugaggcaggaggggaggauggcuugaaccugggagguggagguugcagugagcugugauuguaccacugcacuccagcuugggugacagaggaagacccugucucaaaagaaaauaaaagaauagcucuuaauuccaucagauguauugguccgcucucuugguucccugccccacaaucccugacucuuugcagcccuaccuucacuuuucuuucugaagaguuauacauaggguccuucugccuuguguguagggacuagauggcuuggcauggagugucaaccuugugugcaguaguucgauguccagugauuguggagcucagugucauuuggggacauaauuuugcuuuaccuuggcuuuuuuuuuuuuuuuuuuuuuuuugagacagagucucacuguguuacccaggcuggagugcaguggcaagagcauggcucacugcaaccuucaccucccaggcucaagugauccucccaccucagccuccugaguagcugggauuacaggcaugugccaccacauccagcuaauuuuuguauuuuuuguagagaugggguuucaccguguugcccaggcuggucucaaacuccugagcucaagugaucagccugccuuggucucccaaagugcugggauuucaggcgugagcuacugcccagccuacccugucucuuaauuuuucuuuagggacuugcuacucagauggguuguagguuguagggaaggggaagaaggguuugccucagcccugcaauguuuuggggcacccccuggaagcuuucagcugaguuggcuuggaggcucgaggaaguggccagaguguagggggauaagggagggacuuuacucagauuguuggcuacagcuucuagggccagguccugccugucuugcagguuaagauagcaaaaugacaagacccccaagguucuucccccacuccccgaaaucagagguuguaaggaccccaaguuucuuaauuccagggaaucacgucugcagguugcuguagacaauaaaugcuuuuuuuuuuuuuuugagacagucucgcugucaccuaggcuagagugcaauggcgugauuccggcucacugcaaccucugccuccuggguucaagcgauucuccugccucagccuccugaguagcugggacuauaggcgcccgccaccacacccagcuaguuuuuuguauuuuuaguagagaugagguuucgccauguuggccaggcuggucucgaacuccugaccucgugaucugccagccucggccucccaaagugcugggaccacaggcaugagccaucacggccggccuaacaguaaauguuaaaacuggaaagccaccguauuacagaugaggaaacugauuugcccaaggcuacauagccaggauagggaucuagaguucgacucucugcccccuucuccuuuugauacauccugaaaacuuuuauucaucuaucucuuccuccauagcuacucccucuugaugcccuccccuuugccccucacucaggaugcuccagaccuuguaugauuacuucuggugggaacgucuguggcugccugugaacuugaccugggccgaucuagaagaccgagauggacgugucuacgccaaagccucagaucucuauaucacgcugccccuggccuugcucuuccucaucguucgauacuucuuugagcuguaagcaugccagccuacccucaugccuuccccuguugccaguugcaguuucuuggacuucaaguuuguuccuugcuguuuaauuagcccuugacccugauguucuggcuacucagguuccugcccacugugcacccccuccccugaaggcaccauugucuuccugaaggcucagcacccccaggcccuuuccaucaaugguuauuuguucucacccucuacccgccgcccgccuggccacuagugaacacacaggcagcuuugucagcugugggcagcccuggaggcuagagaaaaggggguugccaggaagcuggggaaacugaggccaggguaaaguugccuuagcuugcagcccuuucccuucccagcaagcuagauaccuuacucauaucccuuccccagguacguggcuacaccacuggcugcccucuugaacauaaaggagaaaacucggcugcgggcaccucccaacgccaccuuggaacauuucuaccugaccaguggcaagcagcccaagcagguaugagccgcaugcugcucuggcucugggaaucacugaguuuggugguggggggacaggguuugaauguuagcucuggcaggugaagagauggggaagcaguggugcugacugagguuguuacugggagaggcuggggaugcugcugaguuccgaagguaaacauaacaaugggcuucuucacugugcccagguggaaguagagcuuuugucccggcagagcgggcucucuggccgccagguagagcguugguuccgucgccgccgcaaccaggaccggcccagucuccucaagaaguuccgagaagccaggugggggaggcuggggcagaagcugggugacaaggaauauccugaugugucuugcugggagggauaggcgguggcuauacgcagggagaugugaggaggugaauucaguuauuaaugguaucuugugaggguaucugcagguauuugggggcugcugggggacugugcuauccucugaccuagccauuucugcuuccucugccagcuggagauucacauuuuaccugauugccuucauugccggcauggccgucauuguggaugugaguggggauuacugggaggugggaguagguucucuggcaaggucaggugaggccauggaauuuggguuccuccucuuuuaacuucucaccaucucucugcagaaacccugguucuaugacaugaagaaaguuugggagggauaucccauacagguaugaguucugcuuccucauguggggguggacuaagacacacccuagugaagagacgguuuguggaauccauggcagagggauuagagugauggaaugaagaaccucaggggcuaggggguuuguggaguggggacacccuugcggcugguugcucuuaccucucucuccucucccagagcacuaucccuucccaguauugguacuacaugauugaacuuuccuucuacuggucccugcucuucagcauugccucugaugucaagcgaaaggugggugaagggguugugcaauuaagccucagagccaaaaugaggcccugggaugaacacccucuccuuugacuucuggguacucugaauggagcuguugguauauggggaaccaaaggcaagggguaagaaggcauagugagagcuggggaauaaaaaaaggcccuggggccugcaucaucucugcaggauuucaaggaacagaucauccaccauguggccaccaucauucucaucagcuuuuccugguuugccaauuacauccgagcugggacucuaaucauggcucugcaugacucuuccgauuaccugcuggaggucaggcuuccucaaaucuagagacccuggugcagguucuucugucccuuugguuuucuuugggagggaggugcggggugggaauuuggaggaugacauuccugggaccaaggaggagggcacagagucagugcuccuaacuggaguguacauaugaauguacucgagggagucaggagcccaugaugauggaugggggcucucuaugcagucagccaagauguuuaacuacgcgggauggaagaacaccugcaacaacaucuucaucgucuucgccauuguuuuuaucaucacccgacuggucauccugcccuucuggugaguaggcagcuaggcuacacuccuguucugaagaaaucaggagccuugccuuucuuccccuccuguaucuccccggugucugaccugcucuuguccacguucucucucuccuugaauccucaggauccugcauugcacccugguguacccacuggagcucuauccugccuucuuuggcuauuacuucuucaauuccaugaugggaguucuacagcugcugcauaucuucugggccuaccucauuuugcgcauggcccacaaguucauaacuggaaaggugaagcccuguucccauuguguaggccuuacuacucucuacaacuuccugaacucccaucuugccaguaacucucuaaaaaacuaguguggagcccuggguauaacaggaacaagcccucagagagaagcaguacuuagggguuugaggaucucauguaauaacccuucuugucccuuuuccacagcugguagaagaugaacgcagugaccgggaagaaacagagagcucagagggggaggaggcugcagcugggggaggagcaaagagccggccccuagccaauggccaccccauccucaauaacaaccaucguaagaaugacugaaccauuacuccagcugccucccagauuaaugcauaaagccaaggaacuaccccgcucccugcgcuauagggucacuuuaagcucuggggaaaaaggagaaagugagaggagaguucucugcauccucccuccuugcuugucacccaguugccuuuaaaccaaauucuaaccagccuauccccagguagggggacguugguuauauucuguuagagggggacggucguauuuuccucccuacccgccaagucauccuuucuacugcuuuugaggcccucccucagcucucuguggguagggguuacaauucacauuccuuauucugagaauuuggccccagcuguuugccuuugacucccugaccuccagagccaggguugugccuuauugucccaucugugggccucauucugccaaagcuggaccaaggcuaaccuuucuaagcucccuaacuugggccagaaaccaaagcugagcuuuuaacuuucucccucuaugacacaaaugaauugaggguaggaggagggugcacauaacccuuacccuaccucugccaaaaagugggggcuguacuggggacugcucggaugaucuuucuuagugcuacuucuuucagcugucccuguagcgacaggucuaagaucugacugccuccuccuuucucuggccucuucccccuucccucuucucuucagcuaggcuagcugguuuggaguagaauggcaacuaauucuaauuuuuauuuauuaaauauuugggguuuugguuuuaaagccagaauuacggcuagcaccuagcauuucagcagagggaccauuuuagaccaaaauguacuguuaauggguuuuuuuuaaaaauuaaaagauuaaauaaaaaauauuaaauaaaacauggcaauaagugucagacuauuaggaauugagaagggggaucaacuaaauaaacgaagagagucuuucuuaugccuuccuugca

SEQ ID NO: 61539 - RNA, 9831 nt, Homo sapiens; identical to SEQ ID NO: 61538

SEQ ID NO: 61540 - RNA, 4830 nt, Homo sapiens
gagguaggguuaggcgcgugccgcgagaacagaguggacggagcguaggagagaccgaaaaggcugggggugggaguagcggauuugaagcacuuguuggccuacagagguguggcaagcagagcaccucagaacucaggcguacugcccgccgcccgagcccugcgagggccgauagcgaggguguggcccuuaucugcacccagcagagcgccggcgggguacggucuuaggaccucgaucuccuucucccucauuuucucucaucccuaccuauugugggugaguccuggccccuggacggggaccucgcuguuccaccagcccauccgugcacacuuaguuuccccuaaagcagugaguggccgggauagaacucaaaaccggcggggcuucuggagcgcagguuguccccggucugccuguccauaucgcccccuuucccccagguuuccgcaugggccggaccguggucgugcugggcggaggcaucagcggcuuggccgccaguuaccaccugagccgggcccccugccccccuaaggugagugcuccacuugugccagagggagcuucauuuaaugcucuucccauuuccaucaaaagcuagauggauccuggcccucugaauaugccucuuccccuccccuccugaccucucgccggcggcuacaggcggugcugcagugucucucccucuugucgccaggugguccuaguggagagcagugagcgucugggaggcuggauucgcuccguucgaggcccuaauggugcuaucuuugagcuuggaccucggggaauuaggccagcgggagcccuaggggcccggaccuugcuccuggugagaggcuugugggaugucuaggagagguuguggagggggcuuccauuggggaauagaguuuaggggaggaaguauguuuggugggucagaucuucccuuaguuucuccucuucugagggcauguggagagcagguuucugagcuuggcuuggauucagaagugcugccuguccggggagaccacccagcugcccagaacagguuccucuacgugggcggugcccugcaugcccuacccacuggccucagguaacaccagcaccuccgcuccuuuuacugugcccucauccucauaugccuuccauuucuuucuucuuuucuuuuuuuuuuuuuuuuuuuuuuuuuuugagacggaguaucgcucucgcccaggauggagugcaauggcgcgaucuuggcucacugcaacuuccgccuuucggguucaagcgauucuccugccucagccucccgaguagcugggacuacaggugccuaccaccacgucuggcuaguuuuuguauuuuuaguagagaugggguuucaccauauuggccaggcuggucuugaacuccugaccuugugauccgcccgccucggccugccaaagugcugggauuacaggcgugagccaccacgcccgaccugccuuccauuucuucaucucccugucagccuucccagcaaaaggaagccaaaugaguggaaaugaccccagcgccuggagcuggggagguaugucaggagcuucccccucacuaugccuuucuccaugcagggggcuacuccgcccuucaccccccuucuccaaaccucuguuuugggcugggcugagggagcugaccaagccccggggcaaagagccugaugagacugugcacaguuuugcccagcgccgccuuggaccugaggugacacuugcccagaggccccaaaccucuucccuccuaaaccagcugcagagcucccuguucaaaucuaccaccuaggggcucuucuguaucauuuggggaugcccucuucucuucauaccccacccccucauaauucccaaaacucauuauugggagugaaggccuucauuuccauccgucacagugggaaugucccccaacccaaacccuaucccacccucauucccuaccaaauaggggcuguggaaaucagucaguguagauuauuuuuucgcuccuuaguccuagucucacccuuaagguggcgucucuagccauggacagucucugccguggaguguuugcaggcaacagccgugagcucagcaucagguccugcuuucccagucucuuccaagcugagcaaacccaucguuccauauuacugggccugcugcugggggcaggugaggggggauugauucagagggugaaaauauuaaguacugccaaagugagggaguggggacaaggggugcuauucaaugauucuuuuuuucuuuuuugagacggagucuugcucugcugccuaggcuggagugcaguggugcaaucucagaucggcucgcugcaaccuccgccucccagauucaagcaauucuccugccucagccucuuaaguagcugggauuacaaacaugugccaccacucccagcuaaucuuuguauuuuuuuguagagaugcaguuucacuauguuggccaggcuggucucaaacuccugaccucaagugauccacccgccucggccuccuaaagugcugggauuacaggugugagccacugcauccagccucaaugauucuucuuugcuuccucugcagggcggaccccacagccagacucagcacucauucgccaggccuuggcugagcgcuggagccaguggucacuucguggaggucuagagauguugccucaggcccuugaaacccaccugacuaguaggggggucaguguucucagaggccagccggucugugggcucagccuccaggcagaagggcgcuggaagguaggggaaccccuggaguguaaugaaccugucaguguuuccaucuuuauccaaguggcuuaacuaggccagggccgauaggacuggaguuccucauuguuuuugugccuuagaagcuacuuagacaugggcuaccccagaauccuaggcccuauuugugaaccuuccucaaagagccuaugcaagucuguggauagaaguaguacuuauaaguggcuuagagauaggggaaagaacccagcuucacugaacauuucagaacagccacacuggccugucugguccacuuccuggaguacacagaggaaugauuuuuugugaagucuacauagucacccaaucucuucauccugggucaguacacagucuccccggccacaugggugccugggaaacugagagugaggcaccagaagucucuuuucacucaucaaauucucauuuucugggucucucaaauguuuucaugcucucagguaucucuaagggacagcagucuggaggcugaccacguuauuagugccauuccagcuucagguaauggaauagccaccuuccccuuccccaaccccuaccagugagaagcaaaagcuauaccuuccugggucagcaggaccacaccaugccccugaacuggucaucucuaugggagucuaaucccaaagaggacugacaacuguaaugggaaugccuucugagucaggccucugccugaucucuagugcucagugagcugcucccugcugaggcugccccucuggcucgugcccugagugccaucacugcagugucuguagcuguggugaaucugcaguaccaaggagcccaucugccuguccagguaugauaaagggacggagaggcugggcaugguggcucacaccuguaaucccagcauuuugggaggccgaggugggcagauaacaaggucaggaguucgagaccagccuggccaacauggugaaaccccaucucuacgaaaaauacaaaaauuagccaggugugguggcuugcaccuguaaucucagcuacucgggaggcuaaggcaggagaaucgcuugaacccaggagguggagguugcagugagcugagaucucgccauuacacuccagccugggugacagagugagacucugucccccccacccccccaaaaaaaugggaaggagagacagccucagcuagagcccuuuccuucugacgcaugaauguccuucucuccagggauuuggacauuuggugccaucuucagaagauccaggaguccugggaaucguguaugacucaguugcuuucccugagcaggacgggagccccccuggccucagagugacugugaggaggaggaaacuuugccuaguggcauuuccagagggcuccucugugcuccauuguaggcaaggccagacugaucagugcuauauucccuccuuaggugaugcugggagguuccugguuacagacacuggaggcuaguggcugugucuuaucucaggagcuguuucaacagcgggcccaggaagcagcugcuacacaauuaggacugaaggagaugccgagccacugcuugguccaucuacacaagguaaguugggauaaacuucccucagcucuccacugaaggccuugaagacagagacuggaacauuugucacuguaugucagccaaggccuaggacaucaauaauaaacuuuucccugcauccucuccucucuucucagaacugcauuccccaguauacacuaggucacuggcaaaaacuagguaaguugggaaaacagcugggcugaggagggccaaggacaucagacccccagcuaaaacauuccuuucauccuuuccuuccagagucagcuaggcaauuccugacugcucacagguugccccugacucuggcuggagccuccuaugagggaguugcuguuaaugacuguauagagagugggcgccaggcagcagucaguguccugggcacagaaccuaacagcugauccccaacucucauucaugaaaauaaaaauugcuggagcuuggc

SEQ ID NO: 61541 - RNA, 4830 nt, Homo sapiens; identical to SEQ ID NO: 61540
